United States Patent 7,868,149 (PLANT GENOME SEQUENCE AND USES THEREOF) - sequence listing, part 29

SEQ ID NO: 14311 - DNA, 50515 bp, Oryza sativa
gtgggggagggcgatttttgccccccccccccccctataaagcccagtccctcctctgtgaaatttcattatattcactaaaaatccaaaaaaaaacgaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtgaaaatggcttttgaacggtcatggcccctcgttatatttgtgtcggtacaagagaaagatacaaatgtttcaatgcaaaccgaagatgtggagggtcctagcaatgaaggggatgttgttggaccatcgatggaaaatgaggaaaatcaaccaagggaggagcaggccatgggcatggcggatgagggggagagagtcggtataattgttgatgaaatggagaggaaagattcggataatgagcaagcggaggacgacgcatcatccgatgaggaaggtgatgtaatggccactgattgggcaaatgaggacttctctggacttgttatatcagagggtgatcatgtaccctgggagtataaggagaacgagataattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaagtgaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgactacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggtgttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtttgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaatgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcagtgattaatttaattggaaaagtatttaaaattcaccttttccttttcgggccgaattaggaaaagtcctctcactctcggcccagtctcctctcagcctgcagcccttttcctctctttcccgaagtctgctttttgtccctcctttaatcagtctttggaagtagaagcccagcagaaagtctactatccctccctggcactgttcatcttccagctctggacagagccgagccgcccgtgctgtgccctgtgccgccgcctcttccttccaaatctcgcctccccgttgctcctttttccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgacgtcgtcgccggccgagctccatccgcgtcgtgccgtcgcctccgtcgtcgccgccggtcgctgtcaccgccgtaaggtgcgcgggagggtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttctattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattaggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcactggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactatttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccgtcgctagaccgttaattccgctgctgttttcttttcttttgtaagtatgtaacgtcattattaagatggatttgtatattaaattgtcagtttgtgtacctcggctgattcctggacgaggattttatgcacaaattagttcggaaattactagtgaatttccgggcgtgacacagaagcaggtgggaggactttacgctgcagcaagtgtgatctgcgcggccatacttacaagaaatgcccgaagaatgcagaagttccaagcagcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttagaaaataaaatgatgttgtgatgtaatgagtgttcggactaaatacttctatcgtgtaatttcaattcaatgttgttgtaatgagtacctcagactattgttgtattagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccatcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagttttttgtactaacatttcattcttaattgtaggcggaccgtctgcaacctgacgctgatgattactcggtccgacgctcccttgaggcgtacctgttgtggttgttcgggtgggtgatgttcactagaacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgatgtgggttagtgcaacttcgctgcgttataagtttaacagtcctcttcttttttttttcttcacataacatgtctaattccaatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcatgtgaccttcactccagacgcaccagagccgcacgttgccgctgtcacagacgcgtatcccacgcaccgtgaccgagactacttcgtggcggtacgtccaatttgtattacttccaacaattatttcatttatcttgcataatataggacaactactgaattttttatttccatcttgcataggctgatgccgcacgggatatcagtgccgatatcaccgcagtccaggtgaggttgaacagaggtttgcacttgactgacgttaagcagagggtgaccttcgcccggatgcaggagaagatgcgtgcggtcatgcgcgtcttctcctgtcgcagcgccgtggacgtcgtacctccagctggtccggtacacccacggcctcgcgcgcctaccgtcggagcaggacctcatttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatatgcagccgggatcttcggtactggggcctcttcgtctcacgccggtaggactggtcctactagccagttctacgacgacgacttgcacggtgcagaccaccaggacgtactaggctcctctcagcttggaggagctccaaaggcgcacactcaggagcagccagaggtcacacctgtacaggcaggacgggttggccgtgccatacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcatatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataatgtgaatcacgcccacgcgtgatcgtcttgtcacatctaatgaataatgtatctcattgagttcacatatattgcagtgaaaacgacgctatataattaacaatctgaaggcaacctcttcatatcttctttcccactagcacaccacacacgaaaatggaagcctatttattggtaatacgtaatctagatttgagattatgtataacattcttcactacaattttacattttggcagcaaaccaaatatgatcaaatgcaattttaccttactaaatatttggtagtgccaaaacttgcttatattttggcactaacaaaatatttgtacggtaacaatccaaatatgccctaaaaaataataaaattgtattttaccagtcttggatattttaatcttgtatagttttcaacataaaaatgataactattgatatttatacaaaaatatagagcacagtataaaatcgccctcccccagggcggcaagggggccgcctgcaaaattccatgccccctcgccgcccatttgcaggcggccccccacacagtacaaaatcgccctagcggagggcggcaaggggcccgcctgcaaaattccatgccccccctcgccgcccatttgcaggcggccccctgcacagtataaaatcaccctagcggagggcggcaagggggccgcctgcaaatttcgttgacggtcgtcgcccgagagcgaacggccgtctgccacgtcattttcgccgccctctgggaggtcccagagggcggtaggcgactacttccgtcaattttcaaaatggaaaattatttttgtaaaacttttaataaaaaaaattataaataaaaaaaattccattttcttgggtaagattgaactagaagaagtaatcagtgaaccaaacaacctttaagaccattttagtattgtgttagcctagtattaaacatatgtttagcgctgatattcaaagacctcaagatatatgaagcaactagttgaatgtgggtgcgttgcaacagaatgtggtaagaatcgtcaaaaaccaaaaaacatatgcatgtttgggtttctcttgtgttacaacttacaaggcttctttttggattttttgaagtttggcctaattagcctaattagccttctcatacactagtgtatgtgtaattagcctaattaaatcctcatacgctatgagaagtttaattaggcttctcatagtgtatgtttgaagggttaaatcctcaaaccttactagctaagcatttcggtacagttcagtacatcgacgtgaatgaaaagacttcaaggaaaatcaccacactttctcagtacacattatatattgcaaaaatcatttttacaggcggtagatccacacccctgtgaaaatattttcagtgaaaaaaaaaaagccgccggccttcccctcccctcgatggctctcctcctccatccgccgccaatgcccgaggggagtgccgtctccgcccccctcttctgtccatatctgggaggagcagcgagctagcgacgcggccgaccgtagtcgtcgtcgtcatcgcgcggtagggccgttgtcgtcgcgcggtagtcatcatcattgtggccggcagcgcaggagagtagagctgagggacatgagagagtgccaccgctgacccctccgcccgtgccgccgctgacgcccctcccctccgccagatttgggagctgacgggaggggaggggaagcgatgcggccggctgtagtcgtcgtcgtcgtcgcgtggccagcgccctccacccgagcagctgccgacgatcccctccgtccgtgccgtcgctgccgcccatcccctccaccggatctgagaggggagggagccggaaatgagagagagaagggtgaggaaaatgagtggttgtggagaggataaggatgggatagggcttagattttttctgtaggcattatttttgctggcggaccacataagattccgcctgcaaaaatcatattttttagatgggcttagatttttgggtaatttggaaccatgccattataattttacaaagtatgagatataccatcggtatctcaatgacatgtaggacccacatgagtcaatgacatgtgggccaggatggcatatctcaaattttgcaaaattataatggcatggtttcaattttccctagattttttctgtacgcattatttttgcaggcggaccacataagattcgcctgcaaaaatcatattttttagacggagcacttaagaggaggtttgccactgaaaataaatgtattttcacaggcggatttaacacggatctgtatagtggtccgcctgaaaaaaatgatgttcgcaggtggacggcgagcttcaccccggtttatatttttgtaggcggttatttagctccaaaagtgatacccgcctgagaaaaaaaatcattacgtctacgaaaatgttttttttagtattgtgtgcatggatgcgttgttgtaatttggataacccaaccttctctttggaaaacagcaaatcttctatctatctatctatctatcttctatctatctatctattatctatcttctattattatatactaaaagttcattagacttcctacaaacgctcttaagttgccacgtgagattcctataaacgttcctaagccgccacgtggcactctaataaattagaaaaaaaataatttaaactgatgggccaattagatttatctcataaaaaaatatccttcctcaattactaccgtacgtaagttctcatctccttctcatttctttccttttttatgtatggtagttaagatttttcttttattacttaataattaatttcttcacttttatctcacgagaatggctgtggactcttgattgcatgtcccatgcctaaatatataaatgattaatgattagatgcatgcttttataaataacaaatctatttttaactaacaatttagaaaaaggataatagttacatagcaaaataatcataattctaaaaagttactccctctatttcatattataagtccttttaacttttttcttaattaaaattatttaggtttgaccaaatatatataaaaaatttaacaacatctatcacacaaaattgttttgttagatataacattcaatatatatccataatatgacttttttttgtaaaattttattatatttttctagagtgaattgcaccttgagccacctttgattaccattgttacaatttggactaggctaaagccaaacttttcactttgaatttggactcccttattcttcctccaactctcttccccctctctccccttcaatctgtaaagtcttccaaagaattaaagggtagtttgcattttcaatcatcgactacctagtgcttgtggcttaatttcaaggacagcggagggtgcacaacaagtattcctactggtagcaactagcataaaaagaagctggccggcaatgacaggcagttgctgctactttctgaactgacaataagaactaagtcaagtagcagatagccacgctcaagctcatgctcgacctccgctagtgctacatgttatgctgcacgcctgcgctaaatttccacgtgtcgctcgagcttcaacaagttttgcagcgctcaagctccgacttcatagtgccacgtgcatttgagctcgaaatcaacttcggcgggtggctaccctgtgaagagttttgcttcttgccctttcatgcactacacctgatcgagaaagagaccttgagctgtacagagaaaagagaggaagaaagggagctggaggaagaagaagagagtctaaattgaaaccttgtgtaaacatacccggtccaaagtaaaaagtttactttttcactggtccaagttacaacacaggtaagaaaaaatagcccaagatgcaatttactcatttttcaacttggtcaaatgtaaaaaattgactagaaaaagtcaaaatgacttataatatgaaacggaggtagtatatccatttttgtttagtttatttgaacagctatttcataattagacagctaaataatttaaaatcaatattaccaatattttactataaaaataaaatatgttatttgaactgccacctattctttacatgataacccaaataacatccgatttttaatttatttacactgttgattatattgctcatattttactatgtaaaatttaaaatacgtaatttgaacatagaccaagaagcaaagaacactgaaacattaaaaaagtgacaacatgtattatgtattatgtattatgttatcttaatcattctacataataaaaattagaaaaatataaagtcaccatgtatgaccttttagagccaagttaaactaccaagtatcacattttaaaaattagtaaaacttataaattcagagaaaaaataaaacatctacccaacggtttttgcttagatcgatgaactattaatattattttcaactatcaaatctacttttagaaaaaaaaatctatcaaatcagtgacatgtcacatcttgaaaaaaaaacttgcaaatcttaggaaattaacatatgataatctgcttttacttaaattacttagaaaaaatacaaaaaaaaagccgctccatatgcgcccatcactacacacccactccttcccctctctggctcaagctctacgcttttcattcctctcacgttcctatttaactaaaagataaataatctataattataagtttcacgtctgatttctaatctgactattgctctgtttataatcaaaccaacgatataagatccatatgcctatatatagtttgctatataacaaatacgacattttaacataatcagcctattacttacaggtatctcaaatgcagcctacggtacatgcccgcgtgaatgcgcgggctaccttcctagttaataattaacagatcaagcaagaaatccagaaataatgcaatagctttcacatgcatgcatctgtgtgagatccggggaaaataggtgattaatccggaaaatacaaaggaaattttttttattatataccgttttttcccaaatcgccccctccaccaattctactacctatactactagttctatggtataattgattatggtgcgttacatcagatgaaatggatggtccagaagctaaggtataccttagaaaaaaatatatccgtgaaggaagccactaaattgaactgcaataattgcccctcgtaacttcaatcgatctcgggatacatcgttagcaaataaaagaaccggtcgagtttgagggaaaataaggtttatttgatttatgctcatatctactattgctcactcgttgtatatatcgttctaaggtctacagggttctcccctatatcaacgtccaatcaattctgtgccagattatctcttccattgtccaacttagcttgataaaacaattcgtcaagatgtaaacaaaagtgaactatttgaagtaggaatgattagcatcaggtattgatacaactggtcaacctcaaacagatgcccatgtatgtttatttcctcaactgtatatcccaatcagagacgaagcttctatatagttgccggggtctaatgacccgataaaagtttctaaacaccacagcaatcacgaattatcatcagaagagagtaatacatggtgcaatgagctaccctagtggttttctcctgtaggacgcccctgatcccaatcagtgtgggaagcaccagcaacgggagaacatgtgatctaagggaagacgaatcaacattgtaatgggaaacagatcaatgcgtatccatgttttgtttttgtgtcctcgttttcttagtcgaattcagtagggaataatgacagatttagctgtacacatttgatctgctaaagcatagcaggtaggggaactattttgggacatatttgtgttagggaaatagatacacgacaagacatgagtttttacatgcaaaaccttttcgagaaaatacaagggacacgtaccggcaatgatcaatattgagatgttagttgtaatgaaggaaacgacaataagctaactatcagatatttcccatgtagtttacaagaagatatataaaggaaaaatctagaagtaggagttctaatatagaaagaccagaagttctaggaaactataatcaaatacattgcacgatgaaattcggatcatatattttattctttggaagatcacataagtgattacacgagtgttgtatctacacaagaggttacctatttttctgtcttgtgttccaaattaaagcttcttttcggagctttggcccattagtacagatccttccatctgtggcagcctctaacatgtctaaaaatagcgggccgtcacaaggaagtcatctcaatcgggccgaaaatgtgtccgattgagatatggtcgcacagacatgttagatgggcataaaactcaggcctgtcacagatgacacctatcacacctatcagtgacgggtcgtagtttaggcccgattgagataacattccatatctcaaacggatctcaagttagagcccgacactgatgaccatcatccgtgaagggcatcaacttgaggcccgattgagataacaattaggcccatcacagatgactcatcagtgacggactcgtactaatgcccgattgagatgacttaatctctatcgggcattaactaaagcccatcaccgatgagtattttttctatctttatatgaaatgtttatatttgtaaattgacctgtagcaaaataattaactgaagtataacaattctttttatgagtcaaaataattttatgggtagcaaatgatttcaaatgaaaaaattgtcaacaacaaaattgtataacttatcaagatttacaacttttagtttggccatttttctatataacttttttttgaatagtttgaatttaaatttaaaaatatgacaaattcaaacaacatattttcaaatactaaatgatttcaaatggaaaaattttcaacaacaaagttgtataacttatcaagatttacaacttttagttttgtcatttttctatataacattttttgaacagattgaatttgaatttgaaaatatgaaaacttcaaacaacattttcaaataataaatgatttcaactaaaaaagtcatcaacaacaaagttgtatatatcatcaagatctataacttttattttggtcatttttctatataacattttttttgaacagtttgaatttgaatttgaaaatatgacaacttcaaacaatattttcaaatactaaatgatttcaactgaaaaagtcatcaacaaaaaaattgtataactcatcaagatctacaacttttatttttttcttttcttcatctgacaaagtgttagtaacattgttcacaaaatttacatatcaatgttactatcactttgtcagatgaagaaatgaccaaaataaaagtttcagatcgtgatgagttattcaactttgttgttgataactttttcagttgaaatcatttagtatttgaaaatgttgcttgaagttatcatattttcaaatttaaattcaaacttttcaaaaaaagttatatagaaaaatgaccaaaataaaagttatagatctttatgagttatacaattttattgttgatgactttttcagttgaagtcgttcaccaacaaaaaattctatttggatttctcaaactttgaatttcaaatttcaaattgttcaaatagagtgagatggagaaatgagcaaaataaaaattttgcatctcaatgtgttctataactttggttttggtgacttttctatttgaaatcatttattaatcccaatttttgttcgaagttgtcaaattttgaaaattcaaaatttgaattgttcaaattaacttatttgtacaaaggaccgatacaatagttgtagatctcgatgatttgtacaattttgttgttgatctcgatgagttatagaattttgttgtttgtgatttttgcattagatacacaaaaatcggcttaaaattaaatttaaagttctcataaattgcaaataaaaaataccacataaattgaatataaacatttcatatggaaaatggaaaaatattcatcggtgacgggcattatttaattcccgatagagataggtcatctcagtcgggcattagtatagagcccgtcaccgattactcatctgtgacgggctttatttttgacagatctcaatgagttctacacctttgtttttgacagatttttcatatgagttcatttagtatcataaaattcaattcgaaattcatttttgcctagaagtctgatttgcctcatcttcatgataatacttgctaaatatatattttatccaattaactcgattttgctgttgaaatatgtaaatagatgtgaaatatgtgatcaaaatggatgttatgcgaatgtggttgtgttaaatctattgatggttgtgtatgtgaatgaatgtatatgaatagaggatgttggggtgtgacatcctggctagggcttaataggattaatacaagttacaacttcttttccggaagccgatctctaaagaactttgatgttaagcatgcttgggttggagcaattttgggatgggtgattgatcgggtgcactcaagtgaggacaaaaaagactagcccagcctgatagaggcgggacgtcatggctagcaaaggcttgagactagccaaaaaataatttttttattatactcatctgtggcggtgttgatgcgaaaatacgatgcctagaagatctacttaacttcagtgcaggtccaaaaatcttgcttttaggttcgtgagcgtgccagttgatttgatcctacaatcaacaagaaacaaagacaagaaaatagcggttaaatccataaatgatagccgatcagccagccgccgatgacatatcatttatctttaagccaatgtcatatttgaatcgatcggcagtcatgcataagtaagaaagaactaaacctattcgatcggctgtagatattaacgacatacaatccttatgtcgatatatacttaaatcaagtgattgggatagatcggtcgccatgccgagacagtataaatcacttagatcgatatatatattaacaatgagattataaacgcttacagtatagccgatcagatagatctagcatgtatcggctaatactccgacactactctatattaagatattaaagcaagtaaaatataccaaacagaagcctaatatactttgttgtaataagatcttaacataaagggcagatctagcatatcaattaagcaaatgaaacataaggctaaatcaggtaagatcggctaaaaccccgataccaccctaatcggcaaccaaaagcaggctagagattgagattctaagtacgacttaatagatcaaacttaactgatgcagcattaagtatgaaaagaaggacaatatctagacaatcaagctgttggatgtttcatagagtggtggacaccctatataatctaagtcaacgttggtatttaacctgatcggctgccttctagcgtcagatgttagccgattgaaggttaaataacaatattgccagagattatataggatatatgataactcgacaacttacgtaaacaaaattagagtatcataatgatggaagcactaatcccgagaacgcaagccgccataacaagttttacctctagttgaagattgaaaccgatgcagctcaacccgaaagcaataactcgtcgaaagaaaacgaaagtaaaagggtggcgatgcgccgagattgtatttgaacgtgtgttgttgtattacattcggctcgggatctatttatacccgagattacaaaatatgtccatatcggacacgactcttatctttaacaaactctaagataccataagtctttgcggcagacttttgcccaaacttatctctaaggaaattacatgaaatatcctaattaatagatacaattgccttttcaggactcaatccatgcaaggcaatcctcatcaagcacattaactcaacccgacaatgtgtaccgagtcatattgtcggaatcggcttaatcggccaaccttgtccgactcgaactcttcgaatcctgatcgcagccgattcggactttagccgattctcgctctgtttctagaacgatctccatcttggattccacttcgattctatcttcatctccgatacttgaattaccaaatttggttgttaacagacgggcattaacttagtgtccgattgagatgagggtcatctttgacgggttatagttactgcctatcacagataagggtcatctgtgacgggctatagtttaggcccgattaagatgtgtgtcatccgtgacatgctctagtttaggccagattgaggttagtagtcatctgtgatggacgctagttgtgacccgattaagattggtcatccgtgacgggctatagtttgactggtcatcagggtcaaagctatcagtgatgggctttaattaaggcccgactgagatagcttcacccgtgacggccgtttgccccgattgagataacttttcacatctgtgacttctaagctgtgacggatgccgtacccgattgtaatgggggttgccgtccgattgagatagtggttaccgttctagtggccgtttggtgctcgagaacctatgaaattaagcccatgcaaataaaggaaaatttagttaaacttttcatagtgtaactgtggactgttaataaatcatcaaaccttcctacccgtttagtacatgttcagtaccgctacgtcaatcaatgacttcaatgaaaacagctcggctgcaataatatagctgtattatagcatcgcactttttcgctctatatattagtatgttttgttcactcatctttctaaatcattcattattttatctatagctgtattatagcatcacccatcagattagtattttgagctgctctaacatgaagacttcagagtaaccctgttgaagtcttatttcagaagatcttcaaagaaagaaacgaccatatattacatatttagtacagattcgacaatcatgaccccagacgacctaaagtatattaaagcagctcctcgatcaagcagcacaactctatctaagtttggaaggcatcaggaatcgttgatgggcgagagaaatggaagctgttatgcctgcatatacagcccttattgcgcacacaagcagacgcacggccattaatgggtaccctaccaccggtcagcctttgatggcttgtgccgacgagaagccacggctaagcgatgacctaaataatataatatgattacatagttattgtcatatagatagcacaacagcctgattaatatgtacccttcagaggtgtaggaattatgctataataggctatgacaagatacaaaaccctaaattacaaaaatctgacaaaacaaatacaaaacaaatagaagataggctatgatctaaataatatgattttatagttattatcatgtagagagcgcattagcctgattaatatataccaaaattatcaaaatctgatagaaacaaaacgaaaagtacaaaactaaaaaaaagtatacaaagaaagtattagctaagaaaactaattaatgtttagtagctgactaaactacaaaagtaacaaatcatgtttaatacctaacaaaactaaaaaaatttagaaaaccaaaactacgaaaataaaaaaaaatctacaaactaagttatgtttagtagatgaaagaactacacaaactaattaagttatgttcactagaaatattaatctctatacaaaatgaagaagccagaagaggacctggtcagagtgcaggctaaaagctgcgtccacaaaacgaaagcacaatacgttcgaatttcagtggaacaataagaagactgagtgatatatcaaggggaaattttgctacaggacactttgatttcgtggttttagcggtaagacaccgctcgaactcacttttggggaaaaacactccataaacatagtaatttgccagtggacaccacgccgattaaaatactaatttctggttgaagagaagagacaaatcgcgtgaaagttataaaatgcccttgggcccacatgtcatatcttccatctctcttcaaccgggagcgccggcagtcgtgcggcggcaacagtggcggagtgtagcactgggtgcaccgggagtcgtgcagcggcggcgatgctgatgacgaccacgacaacgcgcgacgatggcggttgcggcaactgcggtgtggcggtgactgcgccttcgctgcgtggggcggcagtggcggagggtgaggacgacgacgaggaggcggcggcggaaggtctcaagatcaagatcctggcgcacggtggcgacggcggtggctttgacggcggcagtggcatggcggtggtgctacgtgcaggtgacagctgcgtcggcatggtgacggcgaatgcggcagcggcaatgacgacggcacgaagacagacagcggtggtggccggccggacgagatcgagagagtttggagagggaggagaggtcgcgatggggatccgccgcgcatccaggaaggcgcggtgctcgggacggggtgcagctgctgctgcggctcccgctgctgatgtactcgatcttgccataagagagcaagtggtgggcgagctacgggcgggaggatgtgccatcggcaagcgacctgatgcggatgtgggtgcggttcaagaaggcgccgcagggcggcggtgaccggcatcgctggaagaagatagagagagaagagaagagagataggagagctgacatgtgggcccatgggcgtttttgacattttacgtgatttctctctcctcctcaacctgaaattattattctaatcggcgtggtgtccattggcaaattaccatgtttatagagtattttcccctaaaagtgagttcggccagtatcctacggctaaaagcatgaagtcgaagtgtcctgtaacaaaatttgccatatatcagagatgttgcagtcaccgatctctgaaaaaagtgcgcacacactggcagtggcggatggaaaggcatcaaacaccaacgacgatgatgtagcaaaaatggacgagattgttccacaacctcaacctccacaaataagccgcacgctccaccctcttgataacgaagccaagcccaagggttccgccatccgctggagaagagggcatcacgacaacggcgccgataagaatagatccaaatcaatcctctcttctctgcgtgtgtgagaaaaatggggattaaattttgaacagcatgagtaccgatggaaacgaaggcatatgcagcgtggaccgtgcagttatcactcttgggctcatgattcaacccggtcggctatccggcccgacaaccctccaacatgaatcttggaaaatattccaattaacataaattccgcaaatgaaacaaaaatattactactacaaaaaacatgttagttgctggatttcccaagcaagcagcacctttgagtctcctaaaaggtgttgcttaggaactgacacctttatggttcccgggttgggaaaaaaaaagggctcgatgcacctagcgcatccatccctcttcacccccaaaatcaatccacaacgaactatcgatcatagtcatcatcacaacaacaagaacaacatcatcacaacaacaacaacaacaacaacaatcaattggcctctgccggatccacccgcgggatccgccgccacaaccggatccgccacaggagaagcttagggtggagggggaggggtagaggactaccggaaccgctcgtcagaaatgccaccgccggctgccacatccatcggatccgcccgcaggagcatcgatgccaccgccgccatcacaggagaatcttgggggcggaggaaggggagggggtggagggccgctagatccgcctgttggaaatgccaccactgtcgcctatgcctgatgcgcccgtgggagcctcgatgccactgccgccaccgagggagaagcttgggggtagggggggggcggagagggggtagaggaccgctggacccgcttgtcagaaacaccactgccatcgcctccattggatctgcccgcgggagccaccgacaccaccgctgccaccagttctgccacggaagaaggttaggggcggagggggagggggagggggtataggaccatcggatccggcccgcaggagtcgctgacgccatcgcctctgccagatctgccgccgttgagggaggcgagaggggaagggggcagggatgagagagaaagaaagagagagacagtgggggagagcgagtaagagaaagtgagagagagagagaggcggttatatgggtgggtttaaggataaggattggcatcgattgacttagcttggtttttagctatcagttttttaaaattcggcatctataatatattatgggctcctttggatgcacggggagaaaacccctgggaaaaaaccccatacagggattttccctgtaccataggggaagcacttcccgctaggggagatttccctgctatcattaggaagcagctcacgggactgggggatgattagggtttttaagttttgagcctactctaccaaagaatggctagttggagcacacacaacaagataaaaaaatgtctaaataaacataaccgagcacaaaaatagaataattcagttaaaaatgcatgaaaaaaaaatctgaaaaatcatatgaactccaagtagagcaataaattctaggtaaaatagagaacattatagatacaagcatcagcttaattcatgagatgatcaaattgaggtaccatctacagtatttagccaagtattatatgaacatccaagaaatatcactttcagcaaatacaagatgtaattcatacaattatcatttacaaatattttggaagtgttttcctcctgcattcatgagcatcaactatctccatcgctgctccaaattgagaacaaggctgaatatacgagggcaaggcctgttgcctacatccaagaattaaaaacacaaagtaagggtgcaacctgtagtgttggtagaaaaaaaagtattcaaatacttcttgtatagaaaatgcagactagagtatagctttgtgtgggacaatccttgtttatgccaatccagagattcaaattgaatcatggcaagatgaagagtgcaagaggacaattatcattatggacatgacaaggaaaagaagtgcatctcatatatataccccctatgtgagtcctcattgggtaaacttttgcaacattttcagctgaactgcagtgctgttgagctgctgtttaggtgcaaactgatcagacagattaaagcctcatgctactacagtttgagatgcaaattaatgtgcaatgcttcagacggaccgtggccatctccagctaactctgtctcttagttttatgcccccaagcaagcacacaaacattgtcattagtgtagatagttatggttagcacttagcagtactaattaggagtagtagttgttgttttaattaattagtacttaggtcagtttgttttgccagtgagttcctatcaaaaatcagatttttaccatttatttagtctcacatgcatgctaaattaatcactaattatacagttccctgatagagactacaataatggatcagaattaagctaagctagtaccatcaagaatagagaagaattaaaccagatgaactgaatacaaagagttgcaacatttacatctgctgaaattgaatcaagtatacatgtagcagagctatcaaattaaatcgtagggccatcaaacatacctatgcagcaatttggctcctcagaaaaaaaatagtagtagcattagctggtctaatggatgagcgatatagtgttcagctttgaagggttgttgtcagtttaataatgaatttcatgaagatatcagaacatatactattgctaaacataaaatgttcctaataactccagcaaaaaatgattctctgtccagtaaaaaaaagattctttgttagatctaaatatattcatttcacagaatcatggtaaaactagagctagagatgagaaaagggaaacaaaacggagcagagaaaaaaaaactaaatagtaatcttgagtgaagaagttaaggtttacataccagtgcaggctaaagtacaataaccctttgcaaattgcgcattaaatttaaattaaattatggcaagagaggaagtacaaggaggcatacttgacgattcttgtacttgatctgtcgaagcagtggacgcgcgtcttcccttcttaatcaacgttgtttaatttacctcgtagcttgtgttaaagcatatgaacctgcacaattgtaaattgtcatcacacatgcgcgataacctactgtccatcttgactgtaagctctaagcactgacgactaatgctatcctgtttttgacatgtactaatcatggacagattcccaaaataagaataatatgttgattgttaaaacatgcaatgatgagacctgggctctactgatgcaatgttaagacattactaatcagtttttgcatgcaaatttcacactccagaagaaagcaaagcattggtttctcctgtggttcgttagatcaactcttttctgagcctggacatgtctaccaaaaaacaagaacttaacaagtctttgcaaagatcattcacacaagattcaccgtggtttctctcattagttccacattcacacaagatgcaaaaattaaatttccaatcaaaccaaactgaaccataaacaatcacagcacagatttgggatcaaggacacgaaccagtcgaactgagtcacggtgctagcgatgcttagtgacggccactggagaaccgctcttggttgctgtcgaggttgacttgggggatggggcactggcgcactgccactggagagagtgcgtcgtgttgcttcaggtgggagcaagattgacggtggccgttctagagaagctgttgggggaagatgagaagagaggattgagccactgagccaagatctgaggggaaaccctagaggagaagaagagcaaaaaccctaggaggaggaggaggagaggtgtggaaagagaagaaggcttaccctggtacggtggcagcgctggtggtgtctcgccggaggaggaggcgcggcggcgcccaacattggtcgcgcgcgagagaagagactctgtgcgagagagaagtggcggcggatcgcgcaaggaaaatttcccgacctctggaggtcggggttctttccctagggtttccccgcggattgggcggggaaatccttgcctcgtgagcttccatatggacaggaaaaaagcccgtggaaattttcaccgtgggcctttctcccaagggaatgggctgggatcccccgggatcccgggctgccaaaggtggcctataggtatttatattttaattaatcggtacctataatacattataggtgtctgttttttaagaaaactagcagccagttttttctttaaattggcacctatagttcctaaaaggtgccggttatatatttttccatttcactggaataggaaaaggtctataggtaccggttttaattattctggtacctctagtgccgcatcctttgtgattttctgtagtagtgttcagcaggctgttctatagcaaattccaaaaaaaatattataatctcatcttaattatttcaaggatagatagaactgttttcactttgtatcactgccgatttaatttactccgaccttagccagagaactgtgtgaactggcagtcatgcaccttttcatataggttttgtttaagtagtaagggacttatattcggatcaaaaaaatatgacattccactttattgccagcaacagggtttgcattttcgatttcggccaatttttcggttggaccgaaatttcgtgaatttcggcactttgcggaccgaaatttttttgatattttaaatggatttgatacctttgaccaaatttcggtcgttatgttgatttccaggtgggggccgaaatgtcgaaccgaaattgtaatcactgccagcaacagcgatgaataaattaaattaaactgcagtaatattcaaaacattattttccatagctacgcagacgcataaagagaacaagagattaaatgcgcagaattataaataatctcgtcgacgtacgtatatgtagcacagccagctataggctatatatgctatccgatcttggggacctgagcgacggtggcggagttgttgacgaagacgcggacgcgcttggggtcgacctcggtggtgacgacggatccgacgcgcagcacgacgacgtgaacgtccggccggtcgttgaggatgatgtgcttcgccgcctccgccggcagccccacaacctccggccacgacgacttgtcgctgctcattctcgcacaacgacgaccctagctagctacctgcctggagatcgagggacacaatgcaataatgcaatcagttgttgtgcccaattaacctgctcttaggctatagccgtgctggtccggatcatatatatatatatatctataggatgacaactaattgactggttttgtagagagagagacacacactactgaagaaacgatcttttggatcggtgtgccaaattttacaattaatagagagaggcgtggggcaaggcggccaaccggccatatatatgtgtaccatgaccaggtccgggccgttacatctgcaggcaccggccgccctaacttggccatcgatcattacaaataaatttcatatatagaaatgaaggcgtttggcattgcatgcttgtatctttttctttagcggtgacgacgttgatacgtatgccaaacggatcacatgcacatcatgcattcatttaagttggaatactctagttagcccaaatccattatatattaaaagtccattaaacttcttacaaacgttcctaagccgctgttgacggtcgttatcgatcagtttcgaccgtcaatattaccaaaatagaggagaactagtaataattgcattgcatatatatgttagaataataatattccactagtattaggtatactaacctttgcagagattgaccgtaaagtggaggagaatcgacatcaacacaaacgataaatcaatcaggcgatgtcgagaatcagacttatgtatgaatgggccaagaactcagaattgtcacgacaaactgggtcaaaattcacaagtctacataaaggaggaatagaggaggccgccagccgaaaggtgggctggttgggctggcccctggttcggccgaaccagggggttcggccgaatctcccgtggcaccggtggatgcagggtttggatggacggctaggattgatccccaatgacggttcgagggtaataccgaccattccaaccgtcataaccgtcattacctgcctataaaaggagctcatcttctcacttcacacacacacctcaagcaaagctctctcatattctctcaagtttagtttagtagaatagaattagtgtagaaatcaggcgttcggaagccttcagaagagttcgggtacatctctagtagttttccttttctcttttgtaagctttgtacttttattagaatattcttctatatacatttatggtattgaaatacttttcgagtatataaatgccaactttacattatgttcatgttatactgaatatgttgctagcttatctgggagatgcttagatgcgggtataatgtttgcttatgcaattactctatgtcatgacgatgatattggagtagtatttggtagtttagacgtggtgtctagattacgatatatcattatctggagttatatgctgcggatgagaggtgggccgccgatggtgacagctcagtatgggtattcctccgcgcgtgtatataatcctaagttaattccctggggagggtattcctccgtatttagccccggttgtatggtcatgacgggctgtcgtaagaagctcggcagtcaggagtggcttttcgaagtaccatgagagcatcggatagaaggtattagctagtatatcagatatctagaatgtatgtatattatgtatactagaagtataggaatagatttcctttttttattctttctacttagcttagatattatatcatgagaatgagtagctactgcttgtgtgtcactctacccctggattatcttaatccctgcttaggatatgatcatcacaagtaacaaataaattattagtcaagttctctctacatgatcttcccacgggataaaataaatacgatacccttggaatactatcgggtgaaatgctacaatggtatatccgtgcgcttgcggataaactctgtaaccataatataccaggagtatttctgcgttattgctgggaattatatttctagtaatgtcgttaagaaatattaacaagcatttctggcgccgttaccggggaagattcataatagagattacctgaactaatactttatatttacctctatataatcagtttcctttccaagctaaccttggttgttttcacttctgttctaaaaaaagggtagtgcatgactggtttcaacttgccgaaaaacttcaatgaaaatccagaagctttctttcggagcgtcaggccgtgagtcgttgctccacagaaaactctaccgacagagaaaccagccataccagcgccaccaactttcaagaccatggctgacaagacccttcgcgagttcattgatccctctgctgacaatgtggccattgggtcgcagatcaacatgggagacgtggatttcgacttgaagtccagccttatcacgatggcgcaggctagcccattctgtggcaagcctaacgaggatgccaatgctcatctgcagcagttcctagagatctgtagcacatacaccatcaagggcatcagtccagacgccgtcaggctgaggctatttccgttctccctcctcgggagagcgaagcagtggttctacgccaatcgtgctgctgtcaacacctgggacaaatgctctacggtattcctctcgaagttcttcccgatgggcaaaacaaatgcccttcgtggatggatttccagttttcagcagacgagggacgagtctattcccggagcatgggaacgtcttcaggagtacgtggccgcctgtcctcatcatgggatggacgactagctgatcctgcaaaacttttacaatggactcatgcccatgtcccgcaatcacctggacgcggcaaccggaggagctttcttctctaaaatggttcgaggagcggttgacttaatagagaatatggtctccaatatgggttggagcgaggaacgactccagacccatcagcgaggcatgcacaccgtcaaggagatagaactacttgctaccaagcttgacctcctcaggaaacacttggatgacgacaagaaacgaccacaagtaaccgttaaggccttggactcacacgttacatacgaggtatgcagcaacatgggtcattctgggaatgactgcccagaaactcgtgaggaggcgatgtacatgggcaacaacaacaacgggcatcatccacaaggaggtcaggggtggaaccagccacgcccagattattatggaggtaacaacaatggtaacttctctaaccaacccttcttgaaggatctcgtttctgcgcacaccaaaactactgatgctttaagcaaaaagctagctgctaatgacaagatcctagagaacataaatgcttagttagatggctttgcctccgctttccaaaaccagctgagattccataaaatgatagaaacccaactagatcagttagcttccttagtccctgcaaatgaaactaggaggattctagggcaacccgactcctccgtagaaaatgtcaaggcgatcacgacgaggggaggtaagtccactcgtgattcgccatatcctaaccctgcaggaactaatgggatagccaaagaagcgccatctaatgactcagctgacaaagaggttcagccagaaaagaccgtgccgcagatatactgcgacacacgattgctgccatttcctcaacggagtaggaaaccgttagcggatgagcagcttgctcgttttgttgaagtaatccagaagatccacatcaatgtgccattgttggatgctatgcaagtaccaacatatgcccgttatctcaaggatatactcaacaacaagagactgctcccaacaacggaagtggttaaactgacggagcaatgcaacgacgtcatactccacaagctcccggaaaagaagaaggatccaaggtgtcctacaatcacctgttcgatcagggcacatcagtttgaccgggccttgtgcgatcttggagccagtgttagcgtcatgccaaaggacgtctttgacaagctcaacttcacggtgttggcatccacaccgatgcgcctacaactggctaattcgtcagtccgttacccggcagggatagcggaggaggtgccatttaagatacgggacttcttcatcccgtttgacttcgtggtgttggatatggatacaggaaaagagacgccactcattctggggcgttcgttccttagcaccacgggagccaacattgacgtgggaacgggaagtatccttttccatattaacgggaaggaagagaagtttgagtttcaatcaagtacgggccaaacccgtagaatatacaagtggtcgaagtggagccacccaagatggatagcctggtgaaatttatgcagaactttctggagaaggaaacaacgatgcccaggaacggttattggaagacaccggtaaaaccaagtacactggccaaaaagtcagagcagtcgactcacaagaagccgtcttccgcatctaaaccaaagaaggtatggaaggaaaagctaaagatgcccactccatcacctctagagtcggctggaaaattcgtgcactaaactaaaaggaggtacagtcctgcacgtcggacttaaaatgacgtgaccttcgccaacaggtaaaatggtatgtatccgcatatttgttttcaccaatttgaatttttgcatcaacacatgtttgaatttcaaaattacatttaggatttttgaattttgaggaaattcttcaaatgaatttttcagagcaaaccaaaataaaattttcaacgaaaattcacaatgccacgaccgcgctgaccgttggaatccaacggccaaaagtggggccggttgggcataccaggggtttggctgaacccactggtgggttcggccgaaccagccaggcaacgactatttgccatttttggtagggtaacatctagtggtcccacatgtcatttttaaccgttgtgggtaccctataaaaaccagtcggccaagagagggaaatccaccccatttcagcaagctttgatagtttccctcaaattcaaatactagttgcatacatacaagtgctttgctgaaactaatcggcaggtgaaactcttgtcatttctaaaccctgccgagttaatccgttcttgctccattgtgcagaatgaggaggcgattgtctcgtctgttcaaggggtccggctcttcatcaagtcatcatgacgagtctagcactcattcatcagctgatgtctcgatggaagacgccgaagctccgcgacgactcctgaacgataccgacctcgacctcgtcggtgatcgggaaagacaagcctactacatgctgagtgactaggaatatgctcacacgcgagaatactctccagagctgctgaaaaagataggtatggatgttgaatttcgtgctatttagaaagttgtttgatggcagagatttcctgtggtagataaacctggttctcgtttgcttactttgcaaattctgtgcactttgaaagaaatagaagatggaatttattttcgcttcttccataaggagtatacacttacatggaaaggcttaagtacacttcttggttttcacgattcctgtaaaatcgatctctagaaaggaatttctgggttcgagaaaaaataggtttcgggaagatatttctggtgctccaatttgcaagaaacctaggacgaatgacattcataatcctacactttggctcatgcacaaatggattgctataactttgtttcctagaggtgatcttagacccattaggggggatgaattgattatcatgtttaccatggtttgaaagatcaaaattgctcatgtgaaatgtatgataagacaatgattagagaatataagattttcttctcctgttgactgcacttctctaattactcggatagcaaaagggctcggggttgttaacaaccaaattgcttttatgtcagccgctcgtccgtgtattgatgagacttatctagtgcaagggcatattctgaaacatggagtagatggatctttgttatactttttctccagttgtacaaatgaaatcccgttgccaaatgcgaggaatcatttgtacaactgccatgaactaaccattcccctgcagaccatagaagaatctcgtgtaggtggagcaaacagggagacgcgcaacatgacaaggaacgaacaggaaagttcaccatcctcaacacccgtgcagatgtatgaggcaggttgggaaccaactggggatgcacccggatggacccaagctccatgtcacaacatcagagtctcaagatgggcaagtgccagtgaggaccgatggcatgcgtctcatgacatacattcgggggacaaccaacctcccagatcaagtggtgtgcctccatctcgaagtgaatagcgctcgagatcctctcgttgggacttgggtgaaattactaggagaatggatacccttgatatgcagacgggggagatccagtacaacctcatggaacatgtagcacaaacgcaagaatggcaacaatctgctgatgctcagttcgccagcatcaacgacatgatgcagcaacagcatgatgaccttcaagcatagttccgcttccaggggttcaatccttatcaaggaccctgagcgaaagccaagcttggggggagacatttcttcccccactaaggtaacttgtatcacattgcatatttccctttccaaattgcatatttgctttccaattgcatcttataaactgaaaacaacataaaaatttgcaaaatagaaaataccaaaaagataggataggtttgagtcatgctaggtaagacaagctagttctctttgttgaaatgatgaatagttgctctgttttatatctcttatatatgggttcataggtaagtgctctctcaaagattaaatataagtagccaacaattatctgggaacctgaggtaaatgagctgcacttgctaatctgagtctaagttattgcaagatacgagatagtaaataagagttactatgatcctaatcctagtttgacttaaatttgaaagttcctcatttgatataaattcctaccggagccaaaaatgtactatcatggttaaaccttatacattttggttactcgccattccattgaactttgtcaaactcttgtgacttgtatagatactcctcatgcactatgatcaatatcatacacccacatatatgcacatgctaaactcctaccaagtattaacattatattaacattggacttgggagcagtatattgatacaccctggccaaggccattcacacataatgtgattattgcacatcaatgcaaggttaaggctatgctcaactccaaatcttactgtattcattaggaaaggctgctgcatggcttgtatgattgtaggttaaagcatatatttgtgtttaaagagagagacttgactcagatcgattaccaccagtacaccaaggcaaagtaatcgtgcaagacacttgctattatatgaacttaaactatcaattggactagtgctaccatctcaaggaccgactacgccaagtcatgttgttattccatcactaagagattgtgccaagcatagatggagtactcaacatcattaaatcaaaagaagacaaaaggttaactcgtttcttgctgaattgaactttactaatgatgaaaattttataatatctaaatggtgtacatttgcatttttaagttttatgtcaaaggatcatttcactgctacaacaacgaacgactgcatcgaggatgtgatgtattgcacagaagatgaagtgacacttgctcaaattgagatggttcacaacaacgagcagaccggttacgcgcagatgctccaatttccattggatgtgtgatccagccagtcgtcttcctccatgcatgatatatatgattggaaatataatcaagtctacttttatctctaacaaacggctcgtcatttcgagttcccataagagaataatgtctattttagtggatactgcacagaagctgaaagggcccagcgaacctgctcgggaatgactcatggagacccttgagctagctcacttactttgaatttcagcagtcatgtttatccccatctagtagggttgttcgtaatataaatatcccctatgttttatcatttgaaaaacttttgacgatgagaatatgcttgtttagctatgtgctaacaaattcagagagatatctacccctttgctgttgtgatttccttgtgggattacaaaagtggtgttcgatgccccctaattggtgtttctggtccctttgaggatttttccttgattggttctaggttgtgttggttggtaacttagagtgtggttgggtgaactctcaatttaggttgccataatagagacggtggtttgcttcgagtatgatcgtcaggaaccacggttatcttggctgcttgtagctagttttcttggtctatttgaggctttatcggttcttgatcctatgccgtgaagatcgggacatcactgtacacacacacatacacacacacacacacacacacacacacacacacacacacacacacatatatatatatatatatatatgtatgtatatatatatatatatatatatatgtatgtatgtatgtatgtatgtatgtatgtatgtatgttgatcagtcaataaggattgcacttcgttgtgaaacatataaacaacagagggagttgcttgtacaacctgcaaaaagctagccccttcagcgattcaagcatgcatgatgcacaagtaacatctttgtgatttttgccgcctattaattacggtctaggagacatggggaatttattacgctctagcttttgccttattttagcaatgtgctatttcatcctggtagccaagttgataccgttctatagcgaattggtgcggctgacaaacgcctgtgagatagggctcttcttgtgtgctagcattgatgaaacgcctgtgacagatgcatcgatagaatcctccacacctatatgattctctgttgagtaaattgcgcccgcggtacacaaacttgtaaggtgggtgcaatttagtgtaaaaacttgaaaaactctcttttcggtacacaaacttgcgtagtgcgtgcgaaccaaggccaagacatgacttcatcaccaattttattgagttggcttgtgattaggatgccacattggcgcatacacacgttatgggggcatgagttggctacacatatttgcaaataacccctcatacatcttccaattcctccgaatcttcttttgtgttgtagcccacgatgatgcccatgctagagatcagtttcacgatagcctaccgccaattgagtttgcaacaaaaggagataaatcaggagattgatatttggatcaaggtggaaggccgcgaattggatccaggcggtaggactttgctgggagaaaacacgccggccacgtttagggcagcggtggtaggacgttgccgccggcgctgaggcaacatggtgccagggctgcgaagtgaaggtgcacgatctcctgtatacagtgagtactttagtttatcatggtcaaaaatgagattgtctttctcaattccaatttttgtggagatttcttcctcttattgtcgatttattaggtattgcaaacgagaaggactatcagttgttttaatttatgccaggagctagttcatggtacacaaaagctgtaatttttgttgacatttatggtatagaagtgatcatggcaaatttgtatttttggagagcaatttgatcattaatgtactgctagcttctgttgttaactatgctttcttcctggatatacccttaaacatctgaacctaaagtaaactgttctgaagatgaataattatctgtacacaatatatgtagattccgaagatgaagaattcagcattgagatgcaccacggaggcttttttatgggaaatggtgtaaaccgggcttatgttgatggtagagtaagctggtttgaccattgtgagtcagattcttggtcactgttgtgggttgatgatttcattgaagaactaggatatgagaaatctgataacaccaaaatttactggttgcttcctggcaaacaattaaatgatgggttgaggagggttaagtgtgatgcagacactaatagtatggtcgctcttgtacctagggtccgatcatttgttttgtatgcagatcatcaagatatagtcgacgctattgacttagaagatgtggcaattattggttcagatcctttgcgtactgctgtgaacccaagtaaaataattaggtctaagagtgatggtggggagttgactgtagataaacgtgctaccgacgctaaaattgatgataaagaggagtcaagaactgaagatccagattttgttgatagtgattatgagattgatcatggggatgatgacttgtttgataattgtgttgaagggcaaattgagttagcgcataataaagtggagggttcagactatggttcatttgaagatgaaaggttgatgatgccagatatttctgaagaagaagaagaagaaatcaagttcagttttaagagttttagggctgatgtagacatggagacacctgagttcaaggttagcatgatgtttgtagatgctgtagagcttacgaaagcaatagatcaatatactataaagaaccgagttgctattaagaagacacggaataccaaaacaacaattgaagctaagtatgctgaaggttgtccatggatgttgtctgcatctatggataatagagtcaaatgcttagtggtaagggaatatatagagaagcacacctgcactaaacagtgggagatcaaggccgtcacagctaagtatcttgcaaaaaggtacattgaggaatttagagataatgataaaatgacactgatgagctttgctaagaaaattcagaaggaactccacttaacaccatctaggcacaagctaggtagagctagaaggatggctatgagggccatatatggagatgaaatatctcagtacaaccaattatgcgattatggacaagaattgagaacctctaacccagggagctcattctacctgaacctacattttggttgcttccatactttgtatatgtcattcgatgcttgcaagagagggtttatgtctgggtgtagacctatcatttgtcttgatggatgccatattaaaacaaaatttggtggccatatcctaactgctgttggtatggacccaaatgactgcatttttcccattgcaattgcagtagttgaagttgagagcttgaaaagctggagttggtttcttgacactctataaaaagaccttggcattgagaatacatctgcatggacagtgatgactgataggcagaaggtatgacttcgtctgatttttcataatatacataacttacattttagttcctaactataattcttcataattcgtttccaggggcttgttccagctgtgagaagggagttttctcatgctgaacaaagattctgtgtgaggcatctatatcaaaattttcaagtgttatataaaggggagacactaaagaaccaactttgggctattgcaagatctagcactgtgcccgagtggaatgccaatatggaaaagatgaaggcattaagtagtgaagcttataagtaccttgaagaaattcctccaaaccaatggtgtcgagcctttttcagtgactttccgaagtgtgatatccttcttaacaataactcagaagtgtttaacaagtacattcttgatgccagggagatgcctattttgtctatgcttgagaggattagaaatcagatcatgaacaggttgtacaccaagcaaaaagaactagaaaggaattggccatgtggcctctgcccaaaaataaaacggaaggtcgagaaaaatacagagatggctaatacatgctatgttttgcctactgggatgggagcatttcaggttagcgacaaaggatctcaatacattgttgaacttaatgtaaagagatgtgattgcaggaggtgacagctcactgggattccttgtaaccatgccatttcctgtctaagacatgaaagaatcaagccagaggatgtagtgtcatttttctattcaaccaggtgctatgaacaagcttatagctacaacataatgccactgagagatagtatccactgggagaagatgcagggtatagaggtgaagccaccagtatatgagaagaaagtggggaggccaaagaaaactaggagaaaacagccccaggaactagagggtgggactaaaatttcaaagcatggagtagagatgcattgtagctactgcaaaaatggtggtcacaacaaaactagttgtaaacaaaggaaggctgacttaaaacttcagaagcaacctatgtagcaaatggcgacttcatcaattgttgattcagaagagcttgtcatcactcgggtaatatttatacttattttgcttgtgtatttgtttatctccactaactatgaattttaaactcattgtatatttgtttcaggaacctgtcatcactcaggtactattgatgctcattttgcttgtgtatatgtttagctgcactaacaaggaattttaaacagaacatatatttgttttaggaaatgcacctacttagcataccccagcaaaattctaactatctgagttcatctgtggtggaagcttttattaaggaggtgacaatccttcattaagttctcaaagaaaaaacaatccttcattaagctagcattttgtcagctaatagcaaccatcataacattagtacataatcttttacaggctgctagcaaccatcaagaaagggtgaatccaggagcagtgccagagactgctttcattgctactaataggagagaaggggttcaaccaccactaaccacatcaaccaaacaaggcagggccacattgaggaagagaagtgcagcacccaagaagaaaaactctcccaagaaaaagaaacagtagtttatactatgcattcataaagttggttccatgttatcaattttgagttacattactagtgcacaatcaaattcatgtcaagttatgcatttagttttcattcaggttattcactgaattttattcaggatttcagtttctgttcaaaatatgcactcacgtgtttcattgtgttcagattttgtcacaatgtgtacaattaagcattacatccttgttgcttcagtggatttaatgttcatgctgttaatctgacggcacaatggcttaattccttgctgcttcaatgtctgcactgaaacattggagctaggcttcaaagttgctatatgaattgtcagagtctgagataaccaatgttggcctaaagcaagccactcaaatgcctaccgcagcatcaacttctaagctctcccactaaacttgacctcctcgccatctgtcactatcgtcagtctcaacaatactgttgcagccactgccgtcaaacttgacctacccgttgtagccaccgtcggactcgactccccccacggcgtagctatcgggctcgacccccatcactacaacctccgcggattcgacctccccagctccccgccgctatgaacacctctcagattcgtttcactgaaaaattatacatgatcgaaataccaaacaatagaaggggttttctgataaaacacggccattgcttacgagcaggcgaacctgtccttcttacgtgaatgcttagttggcggtctactcatcatccaactcagcaaaattagatttgctattctgtttagtcatagtccgcacgcacctatacaagtttgtgcaccaaaacgagagagtttttcaagtttttacactaaattgcacccacctaacaagtttgtgtaccgcggacgcaatttactcttctctgttataacttctcccttgtatattctcatatcattccttcttaatatcattgttataattcatttcttctttcgcgggaaagataatatgcaaataaacaatgcagttaaaaaaaaagttgatcaacacaatgcagtaggaataagtggtattaggaaaaaaatgtataacggtattggcgttaatgtggcctcgtgccgtctgttcattgtaatcgtgctcactgaaatatgacactctatggatgcatgttgcagtggaaaaaatgttatcaggctaacaaactcaaaaataaattaatcttagaaaagaaacatttgtatagagtattgtacatatatagatttatattgaaatggcgaaatatcatataaaacttctgtcgtaagccttcttttagaaaaggaagggtgaggagaggttatttttaaggtggggtttgatggtctacatagtagtggccgagtcttttaagtatgctcctaatcacctaaccacgccaaaacaaccactacattgagggtttcctacagaatacctcccgggacaagcaagaggttgctgttctttcctgctgcagggaagagagggagaggggagagaatagagggaggagaggtgtagacgtgtagtcatcttcttatgctgctattgtgttgttcttctgctttgctgctgcagtaggatgacgtggggatcaatcttgagaacagaaaggaaggaggagtaatccctggctttaatttgtttctttgattcagaatggttgcaccaaagaggagaatgcatagtactatttaaagacctggagatatatgaagagaaactatatgtgtgtccgtgcatggcaacacattgtgatgatcattgcatcaaaccgaaaaaatatattcgaaaaataaatcatattaaaatatttgaaattccggatgcatgtttggatttcggttgtgctgaaagctaggtatatttgtggattttattttgtagtttggtgtatgataagataccaaataattaggcccatgcatagaaagggaatttaattaaacttgtcatagtgaaagtttgaacttatgttaagagaccggtgtgctcattgtgccagcaaaacgacgaaaaccttatgttaagagtaacatgttggagtgatctttcagaaaacctccaataaagaagtaaacaagtcacaccatttagtacacatactccctccattctcatttatttgccgttggttagttcaaaattaaagtaaccaatgtaaataaaaacataggtataaatcaactttgacaatcctagacgacctcaagaatattaattcagctcctaaaggaccacacacttctcccctatatataggtacttaataagtgtccacacatgccaatagaaatacagaattgtacatttcgtatattatatcctaacttcttgaaagttggtagaacactagtttcaccgctcccacgcgtccacacatatgctacatcagataatgaaaaaaagaacacttcccctgtaagctaagtaaacctagaatgagaacgagggtaagctctcaaagagaggtgaataatcataaataattgtacgcattgaaagcaaagagaccatcgacccatgtgctttctgctcaataagttactatgctagctcctcccccataatatgacaatatagtccacattgttggaactaacatagtttacatcttttataacatgccagctaaatgttgtggtctctatctgtctaagcttggaaggcaccgggaatcgttcatacaagaatacaagtggaagcaggacatgcctgctcacatccgttattgggtttacacgtcggcgcgcggctgccacacggcactctgcctgtggctacgcttccacggcttgggccgtcgagaagccgctgctgcaaggtgaactgatgagagaactctggcgatcgaaggccagccgccacctcggcgtcttcaggtccagcagcagctatctactgacgaggaactctagccatcggcgctgtttgctgatcagttcaccagcacgcacgagctccgttatatacaactttagtgaatccggctggaagtaagtgaatagcgtgtgccattatttctgttatgctggaatggatatgcagtgaacagcggcctataaatcctagtccaacctgtaagataaaaggagacatatatgtcaagtatgagatgtatacctctccaataataggagaaaatctcaatatgaatacattttgtagctttgatctgtcaatgagttcttcaattcctagtaaagagcagccatgtagaaatgaatatgtttatcctagttttatctatctatctatctatctatctatctatctatcatctatctatctatctatctatctatctatctattatatactaaaagttcattaatcttcctacaaatgcacctaagtcgctatgtggcatcctataaacgcttataagccgtcacatggcactctaaaaaataaccgttgattttcattaaatttggtagacccattatttacaaccattagatttacttttttttaaaaaaatcatcccctaaacccggccccaccgagcattaagtacgtaagttctaagttacctacatacgccctcccttccctctttctatttccattaattatttctcatattttcttgctttatttgttatgaaaattaagtaactacgatatctaaatcatataattgttttttttatccatcgatgcctttagattgtttacgaccaaattcatgattaaagaccaaaattcactataattaaaagttgaaaagaaatattttaattttgggctatattttctgacttttgcatgcatttcaaacaattggaagaaatatgaataataataataataataataatgataatatattttatcatcttacataacttcacgataattaaattagatctacagttctaaaaagtaaaatgaaccgcctatgttacttctatggggttgggacctaatctccctagcacgcaaaatgaagcaactcattaaccatgttttaaaaaatgaattaatatgatttttaaagcaactttggcatagatttatttttaaaaaaaaaccataccgtttaacagtttgaaaagcgcgcacctggaaaaaaaattgtgctaaaaaattaggcaactatgatatctaaatcgtataaataatgttattttaataacaagacatccatgcctacgcacgtagcacattcttcatactattttacatttaacgacccacattcactataatgcaactatcaaaaaatatatatgtaacttttggttatatttttcgacctttctgtccaactcaaaaagttataaaattatggaaaaaaataatgatatagattttatcaccgtatatagcttaacaatgattaaattagatatacaatgaaaaaactgaatgaacctaaataatgttccaaaaaatactcctctcattccgatattagagtaagtcaaaataatattattatatttgtagtgtatatatttttaaaatatattgtatacatataaatatatttatgaaaagataactaaaaaagatgcatcttaatcaatcaataaggcatttattctatttttatacaataaaacagtagtaattataatgtattaaacttgtaaaataaatattcttattatatacatacgtactctttctcctcctctcctctctcattccattctttattattctaaattttaactcattaacaacttaataaaaaataaataacaataaaaaatctaaatgactatatctttaagttatactatcgggtttttaagttcttttgaactattgttttatttataaataaataaataattcaggatccatatcaaccatatttacagtacgtcatttgtaaacacctatgcgtgtcaaccaaataagaaaaatagaacaataaaaagttgataataattcttatatcatcttaaatcatcatacattctttatagagcactaacaatgtcatgtattaagtattaaatttaaaaataaaatattagaaattataataaaaaacatttgaccatcagtttcgacataaatatgtagatccattattttgaaccattaaaactacttttaaagaaaattttaagccgctaggtgttacattttaatagttagaaaaaaatatttgaaattttaggaacaaaacaatagatcatcggttttaaatcatttatagaaagtagggaagaactggcccaaaaaacaaaaacttccccctccacctcacatgtggacaaacacaacactagttagtcccctcacccctcagctcgcgccttcccctctatccctcctagatatttttatagctctcaaactaaaaggagaaataatcaataatattaaaacatacataatttttatgccacacttctaatttctagtctaaattgctctattcataattaaaccaacaatttaaagatctataaatcatatattttgaacttaaaataggagtggtataaaataaaacaagaaatataaaaggaacgttggttcctacttttcactaaaattagaacaactattgcatcttccatggccatatcattttttaagtgcttagatattataggctttcatgacattatgagttactccacatattattgcatatataagccacacaaagttagtgatttatagttggttgagaagttatttttgtaattattaaactaaaatgttcggagtcatattgactaggtatttttcttttttctttaaaaaatttatatgtaaatatgtaacaaattgcgtcaattgaaccaactagtaggactagcttggtggtacaaataaaacatattcattaacaataatgttaattaggctttgctaaaaaaagaacgcccctaaacattttattaaataagaaaaaacaccatatgtttccaaacaaacgaatagacacactgatgatgataagttatggataaacagtaagtttgaaatgacaagtatcatctggttggtatactataattttaatttttttcaaacataatctctaatacatgcccgtgcatcacgcgggctatcttcctagttatatactaaaagtccattaaacatattacaaacgctctcaagctaccacgtggacatcctacaaacactctcaagacaccacctagcactctaaatatcgacccttgaatttcatttaaatcgtgaatctgttattttaagccattagatatatagataacttaaacaggtgggccaactaatttattttatgaaaataaactatcctctcatccatactattaattgtacgtaccgatacgcatatagatctatatatactatatcacgtacgtatgaacattcttctctcctctccttccgtactcttgtattctcttctattttgtaactaaaagtttaatggaaaaaacagtaagttaggtagcaaattaatcataatcataactattggactgtcgttttataattagatagctaaataaattaagatttatattacacttatttaatttaattgaactgttattttatttacagttaaataaaaatcaagatatgtatacatatattactcatattttatcaactaattacttacctcataggtttgttatcagatccagctttactatcctgtaactttattaccttaactttattgttcaattgctacagcgagtgatcctgctatatacaggcggcatgcaaaggcgcgccccggtctctagtttttttaatagagggcactatagtaatttttactaaacattactctttgctaaataagcaaaatccaagaatgacaactatattggagaagaaggtaactctactcagaatgagaacgggtgccaggtcttatgaagacatgactgctcatcaatactcttatatatgtatatatatgcatgcaaagcaaagagactatcaacgtgcatgattttgattctgtaaataagtttgtcttatgtatgcatgcaaagcaaagagactgcatgattttgactctgtaaataagtttgtctgctagctcctcccccaaaatatatacatatatatgcatactccgtatggtaggccctcacaagttaacatatgccaactgaactttgcaactgttacgtttgaactctatctatctaagcttggaaggcatcaggaatcgttgatgggcagagagacatggaagcatgttatgcctgcatgcatcccttgttattgcccacacaagcagacgcgtggccaccactgggcagcctacctccggtcaatcatcgacgggcttgtgtagacgagaagccgcgacgagcagccgcaattcggacctataccgggattcgtggccaagtcgatagagattcactgctccaccaaacatgcctggccgcacgaatgccagccatcggcgctgcttttttcgagtcaagcaagtgcatataatcctgagctcgatgccatcttcggttaaggctgctgaatagtagtggctagcaagcagcagctgtcgactgaggagacaactcaggtgatcaccacagtatgctgatcctgttcacctgtgcgcaggagctgcggtcttgccggtggttttgatccgagagatgagaaaagtgaccgcatattttcaaaaactttcagatgcttaattgaaatcaaggcaatcccgtaccaaattaatgtatctggctgaaactgagtaaatcctcgtgtgccaccatttcagttgtgccgaaactgagtaatgttcccgtaccaaattaatatagctttaatatcctagttaacaaacgattgttccaggcatcaatgttcatgtttttcagagaagtgatgattgcagaaattagaatctatataatatggattgctcggagcacatcagtcttaattacactcgatgggcactgaaatgaactcaatttgccttaattatttgcattcttacaacaacaaccgcattagcatagatgagagatccgacaaatacttcaagtattaacagtacattaacttgggacttgggagctgtatatataccgatccgtcaatcagtaatgcactatggcgtgaagattaacacatgaacaacagagggagtagcttgtacaaaggccagcctgcaaaaggctagcggcctcttcagcaattcaatcatgcatgacgcacaagtaatatttctgttatttatgccgcctattaaatagggtctaggagacatggggaatttattgcgctctagcttttaccgccttgtttagttcgcgaaagaaaatttttggatgtcacatcggacatttgaccggatgtcggaaggggttttcggacacgattgaaaaaactaatttcataactcgcctggaaaccgcgagatgaatcttttgagtctaattaattcgtcattagtatatgtgagttactgtagcacttatagctaattatggactaattaggctcaaaatattcgtctcacgatttctatgcaaactgtacagttagttgttttaatctatatttaatgattcttacttatgtttaaagattcaatgggatatttttggaactaaaccgggccttattgtatcaatgtgctattttatcttggttgcgaagttgatatcgttctatagcgtggctgacaaacgcctgtgacgtagggctcttcttcttgtgctagctccgatcaaacgccgcctgtgataaaagcatcgatcgaaaactccacacctctactactctgttaaaacttctcccttatatctcatctcattccttcttaaatatcattgttataattcctttcttcatccgcggcggagataatatgccaataaacaacgtggttaaaaaaaagagggttgatcaacacaatgcagcaggaataagtggcattaggaaaaaatgtataacaatattggcgttaatggtgccctgtgctgtcggttcattgcaatggggctggctggaatatcgcactgtatggctgcatgttgcagtggaaataatattatcagtctaacaaactcacaaagaaattaattaatctcagaaaagaaacatttgtatggaatattatacatatatagatttagattgaaatggcgaagtattatataaaacttatgccataccctttcttttataaaagaaaggtatgtagtggccgagtctttttagtatgctcctatttcctgcagattacctcctgggacaagcaagaggttgctgttctttcctactccaaggaaggagggcgcggggggcggggggggggggggggg

SEQ ID NO: 14312 - DNA, 6218 bp, Oryza sativa
gggttgtagatcttatgctgctattgtgttgttcttgtgttgtactgctgcagtaggaagacgtgggaagcaatcttgagaacaaatggaaggattaatcgttggctttaatttgtttctttgattcattgcgcctatttaaagacctggagatatatgaagagaaactatacgtgtgtccgtgcatggcaacacattgtaatgaacattgcatgaaacctaaaaataatatttgaaaaataaatcatgttaaaatatttaaaatttcgaatgcatgtttggatttcggttgtgctgaaagctaggtatattagtggattttttttcagtttggtgtatgagaagacaccaaataattaggcccatgtgtagaaagggaacttaattaaacttgtcatagtgaaagtttgaacttatgttaagagactggtgttcattgtgccactaaagccatggaaaccttacgttaagagtaacatattgaagtgatctttctgaaaatctccaaagaaagaagtaaacaagtcacaccaatttagtacacatactcagtccattctcatttatttgctatattagttagtttagaaatgaagtaaccaacgtaaaaattaaaaagacaaattttgctacaggacactgcttatgtatggttttagccctaggacactgcccaaactcacttttgggaaaacactccatagacttatgtgcaaaattgagctgataaaaaatctattatacttttttttaaaatttctttcaacaagaagaagggaatatatgcatatatattcatgttcagaaaagtaacatgcatggatggcaatatatacatgtatattcgtggagcgttgtgtgcaatcatgttgttactagtgaattactaatgctgataaatagtacaatatgcatatattaaagcaagggaacgatgatgcatgcttgctatactctattaaatcgtgtgctccacctcgtcactatacaggctatacacggtgcgtatgggtgcgccgggaatcgttgatgcacagatatgacagatttgtctgagaaaatcggcttgtaagcatcacctccgatgtatggaagctcgctgatatggttacgacagccatgcgtacctccacccatcacaccaacagacggtcattccaagcacgtactggtgccgagtagtagaacacatagggacgggttggcagagattcgctacaatggctgcacgcatgccacccgttggcgttggttcttgcaaactttgagcaaggtagctgtgctctattctgcatatgctcccatcggcccgtaacagtgagagtaattttattcgatgtgatgttagtcggatcaaactctaaaattgtaatgttgtaaattttataaaatgacctgggacccggatgcaagggtgaaaccgcaatatcagagttaatttgtgtggtggtttttctacacagagaagattagaagttctttatggatcccaaaaaaaaaaggaaaaacaagttcaagttattgtaaacattaccttaattactgttgctttatagtttctcttccattaaattttgtattttaatttttcctttaaatatttctcatttcgaaggaaagattatgaagcacatatcttgtaataactatactgaatactttttttctggtctatacagcatgtttggagcaccagcttggtttggattttgcaatacagcaagtttttacgacagtatcataagccagagcaaactccaccaaaaataaagtagttgaggttgatagacactcaggacgaacatccctttatttaattatgtattggtctttgcccattgaagttccgtatttttcaggaacactagagcttgctggtgaatttagaggttggaggtgaagttatgtgaacatgactttaatttaaaccatgataattaacttcaaatttcatgcatggagtgcgttatcatcgtgatgtttggaatttaaagaggattgagatttgctactttcatcaaacatagttgaaaaaattcttttgttttgtaatcatttttatataatatgtcaacacaaactctttcaaaacttgattctcaaccttttgtattggactagtcaccctggatgaaaaaaaggagagtcgttacagttgccacagcagctgcatctattacagatccgctgtcaaaaaaagaaaaggcaaaaaccatgtaagccgatcctgctgtctctttttgattccctaccttcgtcgctgctctctctaccacccgttggccttcctctaaaccggtgaactcacccggtatcccattccgatacctaccctaaaacctttctgcttggggatgctgccttttatgtcagagtttgtcgaggtcgccggagatggaagagaatgatacaggagtagggggtgaaaacgatcggaattggtagtatctcttcggaaacgatgctcgatcggccggtaattgaccatatttattatttaaactactcagtatcgacattaatatgatgcagaaagaaattagacaaaaagaaatttaaaaataacaaaaacggtacggtcggaaaatgtaccccttaaacggaaacaacgcccggttaatcgggaatttctgtgactgtttttacccctatacaggagcatagaccacaatgctgatcagtgagaagaaaattttcagacattgcttccaatttttcatgcgaatgtagtttagtaaatacattttctttagtgacaaagaccatttctaacccaacatctactccctgaacaatcaaggcagttcctgacgtcagctgtaataaaagcatcgatcaaaacctccacatatctactattctctattataacttctcccttatatattctcatctcattccttcttaatatcgttgttataattcctttcttcttcccctgcagagagaaaatatacctataaacaacgtggttcaaaaacaatgtcgatcaacacaatgctgtagtaataagaggcattaggaaaaaattgtataacggtattggtgttaatggtgcctcgctatgggtacattgcaatggtgctcactgctggaatatcacactgtatggatgcctgttgcacaggaaaaattattatcaagctaacaatctcaccaagaaatctcaggaaagatacatttgtatgtaatattgtacatatatagatttatatttcgatggcgaagtaagtttctaaatcctattccaacctgtaagataaaaggagacatatatgtcaagtatgagatgtatacctctccaataataggagaaaatcccaatatgaatacattttgtagctttgatctgtcgatgagtaattcctaataaaaagtagccatgtggaaatgaacatgtttatcctagttttttttaaataataaaactagccaaaacttgtccgagctttaatctccaactctccttgacatcgagtgggtatgtcaccaactcagtgtcgccttctatatcaccagttgagctcacctcgtctactagttcttctttaaactgttaatttgatggccaactaatcaatgatgtgaacataggaatgaataatcaacgatcatttaagtgaaaaattaaacttaaaggttgtaggctgtaggtggcactaattattttctttgtcctcttgataagaaaactagtgacagatagagaaatcagttatcactacgttgttgggcaacaaatagtgcgtgcacgatcgatgcatatatacatccaccccattgatcaagtactgtaattgtattgattgattgtttcagttattaaagttgctgcttttccaagatcactttttgtaatatattaagtggcattaggggtggaaacaagccgacttggctcgacttgtgaaagcttggtgaaaagaaagctcggcttggcttggctcactacaaacaatgagctaaaaatgcagcttggctcggctcgttaatgggctcgagctggctcgcgagcctggtatcaagtaaatctcaagtaggtgtaagagaaatcgatcaacaattttctacatagaatgtgtaataaagtaatatttttctttaatatatcatcacaacacataaatagataatatgataatcaaaattgttttttcaataaataaatagttagaaaacttgcaaaatttttgtatatgaccctaatatactgagccaaacgagctcgctaatggctcgtgagctagctcggtcttggctcgtttcggaaacgagctaggaagcttcggcttggcttgtttggctttcgtgccgagccgagctatgtgagcccgaaccaagcttgagccgagctcacgagcccaaactttttgtccacccctaagtggcatgatctttcagaacattgagtttcaattacagacggtgagcactgcaatcaattcaatttgccttatctgcattcaattggtacataggagctgtatatataccgatatatcgatcagaattgtgctgtgacctggaaattaacataggaaccacaggagtagcttgtacatgcccaccgtgcaaaaggctagcctcttgagcaatttttttttgagacaaaggcagcacctcatcgattaaattgcatcagcattaagtacctcccgaatatgatcctggattacagaacgaaaaatattacatgtagcagattcggaacaacgagctacggtatgagctgcaacattggttaaatgattgacatgaataaaggagcattccaggaactcagtctccaaattcttgatatcacggacaacaacgctgacacttgaacgatctcgtgcctattctcttgataactgaaaggcaatcggaggccatcaacacttgctggaaaccttccgcctttgcatgttccaaggcgaaacggatcgccaaagcttcagttagttctggagagagcaatccggttatcctcttgtttgcagcaagcaggcaggaggcactctgatctcgaattacaaaggccaaacccgtctgattagaagctggaagagtgcagcatctgagttaagtagtactaccatgcttgctggcggtggtttgcactttgtaactggaagggagagagatcacaccagaggcattcctttccttggagcagtactgcacattcatatctacatacgacacaattttgtgaatcacttgacacgggtgggaagtaacagggttgttcctagaaaaatttcccgcttcccatatgtgtcacggagtaacagccaggactgtcttctgaatgagagagctacgggttaggaaatcaaacacccattgcctcgtattgcataattctcgtatgcacaagttaatctgaaacttctccttgatggctttccaaacagttgcagcataggggcaaacaaggaagacatgctcaattctatcatcatgaccacaaaagatgcatccctccatagcaggaacatggcgtctcctgagttggaaccctgtaggaagacaatcatgtactgacctccatagatgtatcaacattttacccggtgcattgattttccaacgtgccttcctaaacagcgagtccacattcgctgcagtgttatcctctcccattggagctctgggccaccacaaataaatttgatgtcactaagttgtaagcagagcgaacaataaacaacccctcttgtcatgtggccaagaaacaaaatcctctcccccatgacggcatataggaaccagcaaaacttctgttgcaatatcatcgttgtaagctaccttgacaatctcctcatcccaagcattccttccaggattcatgacactggtggagaaaccatctttactcggttagccaaaatccacaatagtcccggttgcaataaaaaccaggattaaagattatctttagtcccggtttaaaagtttagagctgctttttaatctttagtcccagttggtgtgatctatttctagtccctgttggtaacaccaaccgggaaaaaagatgcccactatctttagtcccggttggtttcaccaaccgggactaaagatctatttttaagtcccggttggtaataccaaccaaaacaaaatatcgtggcggagagtacgaggcacctgccatctgcgagatcaaggaggaggagactggcagccttatctcttcaacttttcctccactgaccttatctcttcat

SEQ ID NO: 14313 - DNA, 1005 bp, Oryza sativa
tttttaagaattttgtgattcggatctgtgtatttgatttgtgtgtgatgtccgttaatatgtgatgtatttgtgatgaattttgtagaagttgtgatgtaattttgttttaagcttttgtgatctatttgaatatggccgatttggggatttgaggattcggggataatttatttgggattttgggatggggatggagtgaaatcaatatattaaaaacacaatgaagaaaagaaactaataatagagcaaccggatctagctaggctagctctaccaaccgggactaaaaaggctctatctttagtcccgattggtaacaaccaaccgagactaaagatgtatttttactcccgattttttcacccgggacaaaagatagtgatctttagtcccggattggtagtcccgtttgaaaaccgggactacaggggggttacgaaccaggagtaaatcccctttctccaccagtgtgagcgaattgacagtaacatcatcagggatagggaagcgggtattcaccatatattcctgcttgcacaccaagtattcaattgtccatcgtgatcttaatggatgaaccatcaccaacagcccagtgcacccccttctttaacaactcctgcccaaacaaaatattacgccaggtgaaagaggcagatcgaggtttaggggcagaccaaatatctgagtttgagaagtacctaactttcagaacccttagcaaagcgaatttggatctgtgagaagatgccaaccctgtctggtcagtatcgcttggttaaagatgaccaagtccctgaaacccataccgccaagatattttggcgtagacagccactcccacgagggccaatgcatcttcttcctcccgcctcttgagcaattcaagcatgctagaggcatcagtcgagacattttcattttctaaaaaagttagtcgagacattttggcaggtggtcaaaacatatttactactacctccgtttttttaatagatgacg

SEQ ID NO: 14314 - DNA, 15154 bp, Oryza sativa
  unsure (1)..(15154): unsure at all n locations
tattcaaaaaatttacgtaattataatttattttgttacgagttgttttatcactcatagtactttaagtgtgatttatatcttatacatttgcattaattttttgaataaaacgaatggtcaaacatgtgagaaaaagtcaacggcgtcatctattaaaaaacggagggagtagtaattttgctgatctatggcacctttagttagggtttaggagacatggcaatttagcgttcacttattatacaaatctagctttcgtcttactgtaacgatgagctatttcttgcctcttgattgccaggttgatagatttccatagcgtgcctgataggggagatgctcacatctgtgacgtaagacactgcttcctatgatggaaaattttttatccatacgatagcacatagctcggtacccaaaaaaatgttcctactttcagtcagtaccacaggaatttcttttactttgatttgtagtaacaaccctactgtttattggaaatttggtcataattcggcatattttaatccaaaataacaagataatcagcatgatatttacaatgggatttgatccagtgatagtggtgaatgtaatcaacttgagcatgcttaacgtagaataagcatcaacaatcacataataacgcaatgttgacattgcgatgaacattaaccgtaaaacttctaattgaaataatgtaagaaggttataccccaagaatggtcttccgctggagtttgaggcagtattgcctccgttgttgttggcaggaacatccttgtccttgtttccagtgttgctgttgtgtccagtgttcgacatattggtgaagacgaagtagacgttgacgaacagtgagtagtcgcgccttgcgctccccaaaaacctaattgcccgcccgtccgtgcaaacgtcacagcagtacgtcgtttcggaggcctactctcccaacgtgtgtgcacacactcgtcgggatgggattaccgtagcagcaacagccttggaaatggatgaaagtgtgtctcacttcttcttagggagatcaaatccattctcattttatatgagaaatggaagatgaagagtaagagtcatggaatagaaagaggaatagagtaactaattctcatcaattagccatgaaccatcctccactacacaaccatcaaccaaccatcaattaggagtaattgatgtaggttaccaatagaacagaaagaggaatagagcaactaattatcatcaactagtgatgaaccatcctccactatacaaccatcaaccatccatcaattaggagtaattgatataagttaccaattcactaatcaaatggattaattctcaaaactcctcgtcccattgatatcccattagagaatgaatacacatgaattcctagcataatgagccttggaatttatttaatttaattgatttaaatggatcaattaaccaattaaatctaacaatccccaccaaattttaaggctcatgagaatgctctctattccatagcagcttttatataccagtgtttcggtcaagactgttaatgtcacagcctgaatttctgtctcaggatttataaattatttagtaaattaatattagaatttatattaaatgttcattaatttacaagtgaagttaaatgtgggaagtaaaaactcctaaatataaatcatggttggatttaatttttattaaattctccatgattaattatactctctggaattttctcggatttttcggagctcaattactaattttaataatacaaagaacatttcagtaattattcacatattaaattaatcattaaatgagctggttacagttttgttaaatactttgagtgtccaagtatgttcaagaattttcttggaactatttgagcattggaaatatttttaacaattgaaagatcatctcattggttaatttatttggaaaagtaataaaatcttcctcctccgcttgggcccttttcagcccattcccttctcttctctctcccttcctctcagcccgcatagaagtctgtttgtcctccctctcgctacattgttgtcttcaacatctggacagagcccgagccgtcccaagctgcagccgtgccgatccccttccgaatctggcctccccgttgctcctttttccaaattagttgcgagaacggaatcctctcaatctcctctacaatttccccaagaaatccccaaaagtttctatggaaatcctttccaatttcacggttcaatctttcctttttccggcgaagatcccaaactttccagagtttttcccgtcgatgtggactcgatcccgggctcccatggctatataaatgaccccctagtcgtcctctacctatcctctcaagtcccgtcttccgccatcgccggaatcgctctccccgcgagctccctctctctccacctccggccgccgctccagccgccgtggacagtaccttgccgcccttcgaagcttgtcactggccatcttccgtcgccgtctgtcgtcgcgtaagtgttggtaaggaccgtcgccttgcgctctttttcccggtgtcctcccttttatcgtcgctccgtagttcgccggtgatcgtcgttcctgtgtccgttatccgatgatctcgcttggctgtcttatcattgccacgtctacctaaaccctagatcaaattcaatctaatccgttgtttgtctagcatcgtcgtcgtctccgtgtgttgccgccgggtcgccgtcgtcatctctccctctccaatcgtttggttcggtgagacttctatctctgttcccttggtttaggttttaatctctcgtttgtgtcatcgagtagccgccgctgtgccgccgctaattgcctagtcattgctgtgttgctgctgttgtgccgtgtcgcaactatgtgccgcttaaacctagccgccgctttagcccgttgctcggtagttgagttgtctagccgtaggtgcaaccctaggttcctaccggcctatcgtttgtcgtaccggggctttaccgtgaatcgtgtctagcccaccggtttagccacagccgttgttgagtcattcactcgttcgttcgaatgaggtgttcctcgtgcttcgttcgttcatccgtgttgagtcgtcctttagttcagagccgccggttccgttcgccggtttcggttgatcatttgggtgatctcatgtcacgtagaattgactcgttgagtcggtatctcgtgaggttcgcttgccagatcaatccaagccattcgatcttggtcgactcggtcaagattaatctcagccatctaaaatcaatataaatctgttctctcttttcaatggcatattagtcctttttatcatatgtcatctaccaatataatctaatcttttccggagattgttttaatcttttatcttggttataaatcatttgtaaattgtttaattaatttggaatagtcttatctttaataggtttaattggaattaaatcttgtacaattcgtaactaattcatatgaaatcagaatgaggccgttcaagtctctaaagtcatttaaaattatgatctacatgtttgtttactttaaatgtactatttatttggtttttattagtctttttcctcgttttgcgtgttagcttgtcgttttcgtcgttttgaaggatcgtgagtgcgtcggaagtgttcaagaagacttattgaagaccaattattgcaaggtaagtcacacagatcccaaacacaattcctttgagcatgttgatcctatatttaaattctctatttatttcaattgtgcatttatttttgaatgtcatcaggtggtgtgaacttattcctttgtgtaacatccttaaattttaaactaaaatttgactgcatcatgctggcttttgattaaagttgtttggttcaaaaatctatttgttttttatttaaaaattggttcaagtattagagccctaccaatttactctaattattccctttattccaaaccttagtgaatttgagcaaattctctcaaaattcaaaccatagattattttcttaacttaccttaatattagtggagatttgctatacttcaaaccttagtgaaagcttttcaaaaccatagtttaaattcaaatctttctagggaaaatatccaaaattcctgaattttactgttcattgcacccaaggtgctcgacagaatgcctagcccaactagagcagcccaactctatccaatcttgcacaaagtttagatttgatcctaggggaccacaccccactcaaaaaccgtggtttagttggccttctcctccccttcacgcgtgctctctggcagccgactttgctgcgcgccgtgtcgccgcgcgtcggcctcggagccgcttacgtgtgcccgaccgccttggcgcgccgtcgcccgttggacgatctcagcccaccgccgccgcaccaatcttgatgacgacaaagccgggacgacgactaccgcaaggaatcgctgctcgacgccgtgcgctcccgtccaagccaccaccgagtgcgatttcgcttctaccctgggtgaatcgcgccaattctcgccgcacagttggattggacatagatggtggtatcccctctcacaattcaaaccattcacccccgagccagccgttttcaccctcgtcgcacccggattggcgccaacaagtcgccagccgattccaaccgcggtcaagtcaatacttggccggtaagtattcaaacgtggcctcccgccactcaatttgattttatccgccctctctcagcccctgccacctttgcctcatccaaatcccgagctcatccatggcgatgacggtgccggagctcatccgctcctcctagccctataaataggaccccaattccttccctgtccatcatcgatcatcaacaaccatagccccacaacccagaagctctgcttcaccaatccatctcatcaaccaccatcatccgtcggtcgaacaccttgtgcgcgatcgactccacccctctccatccatcctccgccctaaatatcctttagaacacctatattctaccatgttctagcatagtaagccctaaccgaagctctgcgtcgagttttacctcgtcgcaccaagccgagcacagccgcccccgcgctgctctgttcttcgccgccgcgaagtttttccggccgcaatccgtcgtttcaaccgatctcggtgagttcttccgtttcaaccatctacatactacctagattccattttagcaatccctttgcactatcatgccaccctctgagctgccgacgtgagcacggccgccgcctatggaggcgctcgtcggcaactatgctccgcgccttgccaaaggttggctagctgccggaatccctctagacacctcgtagatgctctagaacccctcccgtagccatgtctaactcttatcaccttgatcgccatctcagtctaaccgtgtcaccgccgccctagccattaggccgtccacacatcaaattaattccaccgccgccgctccccgtcgccggagatccctagctccctcacctcctcggtcgcaaccactttctccctctagcgccactgcaatcccaaaccctagcgtggctagcccgcttttggggatcggctggaggtagaagaagagaagagagagagagactgacaggtgggacctgtacatagtgccatttcacatttatttgattttcaaactttagaagcccatatcttttaaaatatagatccaatttcaatgaaacttggaccaatattcttctaaaatcatcctctatctattgggcccctttttgctatttttgttttttattttattttctatattttttcttatttttggattttatttaaactccttttgaatttgaattttatatgtctaaccctaggtcttgaggattcctctgacaccctagataatatcaatcaatctcaagacatcgagcaaggcaagttaccatatacctgttgatcatttaagcctatattttacaaattatttatttatagccttctattcaatattctatttttctatgcataaatcattcatagaaacccagataatttagtattgcttatttttgcttacaatatggttaaaatacctcatacttagattgggacaatatgtaagatttggttgatttccgggtggctagtattgtctcaatcgatataagttttaccaggtacttatgtcgaacgaacgggtacgaccgcagtttctagaatggggacagacctagttattaggttaattggcaatatggcacctctgtatagtggttcttatttttaagtcctcgcgcaggaggcaactatagccgcgaagggcaactttaaccattaccatgtacaggtaaaatggtttgtgatactcgagtataaactatatggtatatttctaaaccctgatcgagatgacgtggtgtcaaacgatcagttccccttaaatacctcgggaacgccagaactcctcttgctgctattaacattacgttcagagcatatgaggatataagttcatggaacaggtgccataatttgtaatgacttaatactgggccatgactaaagccaatgattatcagcaagtcgtggactgcgggtaaagcgtacatctgctgcagtagaatatctttgaaactattcgaatagctgtactcatggagttgagtaccgggaatcatatggtaccctggttagaaatctaaagtttatatgttttataaattcctgctataacttttttagattgtctaatactgctttttgcaaagaaccctattatatgtcaatgcataacatattcccgtgataacttgctaagtattgtaaatactcacccttgctcttataaaccctttttcagatctgggtcaagaggaggacccttatgactattactacgaagaccccaataacatagaaaatccctgaaggttatacctcactagtcagaatgtatagaaacttccgctgtgtattaattagataggtgagtacctattattgtaaaattcttagtattgtaagactttaacatatgcaatgaagaaccagttatattgtatgtatcaatatttactgatccagggattgatacattaatcttagttggatccaagttgttagttttgagacccgacactttgttatggccaatttgcattgattactctattccttgataccttgggttattataatttgactagttgagctttatatattggttcagctagatatattagatctaattgcttagccatgcttagaaacattagcacatgattgggataactaatgtttcactatcacttaatgatggatatttaattgtagctcacggtggttaatagtgattggttaattaattaatttgccaactaaaacttgataatggtgggttgtgagcacatggttttgatggtcatgctcatgacaattaaggaccggttcacgagtttcggttgtgaaacattaaccgtgccaaccacatgcccgcatgggcaacggttttaccttttgtatagcatggttcattgcggggcaccagactgagaagtggcggagataagcccacgggggtcgctggggagtccatgccttgtttataagggggtgattatgatcaaggaatggtgcgttgtggtggattgtgttatgcgaggggtactgtcacagctcctttccgaggtaccgtggtggtattgcggcgcatggtgacatattgtggggctgtgtcttgtgggtacagtggtacacctctggccagagtaaactattcgaatagccgtgcccgcggttatgggcgggtctaacaatgtctttcgtgattagtctcacacttctcaccataataaatgatgctataactggtaataatttgattagctcctggtttggaatggtacattcttggtttggagatagatctgtacagccgggtatggttgtttaggatggttgggcctatgcagcatgggtatgctgttcagtgttgattaatattgatgattaattactctattgttttacaaattctcaactctttgctaaatgctgcttttgcaaatgagtcctatattatgccattctttggtatccttgtgcacttgcatacttgctgtgtggcttgcggagtatgtcatatgctcaccttacaataatcaatcaaacctcagttgaagaaaagtcgcaaaggagaagacgtttggcttataccccagttgagctgcctgtgggagtggagccggagcttcgctagattttatttttcgctgcagttttcttcatggtgaggactaagtgcctcttaagtaagtatttatcgttttagttaatttgatgaatctgtatattaaattgtgagtttgtgtacctcggctgattcctggacgatgatttaatgcacaaattagtttggaaattacttgtgaatttccgggcgtgatagttaagttgaacttccacctagaaaaggagctgcacctaaccacaactgaacaatggactatgccttgaattgtcagtcttgtgcagttaggtttcactcaattccataactgatactaggcaaccgttagtattccctcggtttggagcttataagtcatactctaggcctttcatgagtatctagagattacccatatctcatagactgtgactagtagtcgaactcatataggtgtattccttctaagatgttctgcaggttaacatctctgcttaatgaaagccactcagaacacattgaggcataagccatcctaccatacaaaatagaagagaagtacatcatgaaaatgagcccatttaagggtctcttctctcggttacacagtagtttgtttcaccatccaaattcacgggatctccgatcacaatggacaggtttccactattgtgcatctctaagtgggtctcaagcccatttccctcgatgcactgtctatcacattacgtggtagccccttggtaaactgatctgccagatttttagctgtctggacatagtccagtgttatcactccggagtttttctgctttctaacagatttcagtcttctctttacatgcctagatgacttcatgttgtccttcgaactgttcactttaataatcacaatttgattatcacagttcatcaggatagctggcactggtttttcaaccaccggcaaatccatcaggagttcacaaagccacttggcctcaactgtcgtagtatctagtgctgtgagttctgcttccattgttgacctcgttaagatagtctgcttgcaagacttccaggaaacagcgccaactccaagtgtgaacacatatccacttgtggcttttatctcatcagcatcagatatccagtttgagccactatacccttccagtacttttgggtacccagtatagtgaattccatagctcatagtgccctttagatagcgcattactctttccagagcttgccagtgatcatctctcggatttgaaacaaaccggctcagcttgcttacatcacatgagatgtcaggcctcgttgcactagccaagtacatcaatgaaccaatgatttgggagtatctcaattgatgccttgctattcttcggtttttccttaatagcacattggggtcataaggagtagtagctggcttacagtcactatagccaaagcgactcaaaaccttgtccacatagtgggattgcacaagtgtaacatcagccactcccaaatccttcatttcaaagcttttggacagaaagtccttgacctcctcaatcacatttaggctggtcccaaagatcaatatgtcatcgacatatagacagaagatcactccctctcccccaccataacgatagtacacacatttgtcagctttgttcacaataaagccagcagatgtaactgttgtgttaaacttctcatgccatttcttaggtgcttgcttaaggccatacaaggatttcaatagtttacacaccatttcctcctgaccttctagtacatacccgtttggttgatccatatagatctcctcctccagctctccatttaggaaagctgtcttaacgtccatctgatggacgagaagaccatgagaggctgccagagcaagtaatactcgaatcgtggtcaagcgggcaactggtgagtaggtgtcgaaaaaatcctcgccttctttttgggtataacccttggccacaagccttgccttgtacttttcaattgtaccattaggattaagttttttcctgaaaacccatttgcatcctaaaggcttgcacccatatggacgctcaacgacttcccaagtaccagtagacataattgagtccatctcactgcgtaccgcttccttccagtagtcagtgtcaggagatgaatatgcctcttctatggtttttggagtgtcatccacgaggtatacaatgtagtcatctccaaaggattttgcaaccctttgtctcttactctttcgagtatctataatgttatccttctcaggattttcctaaggcgtttgatcattgtgttctatcggtgcaaagtgctcatggggtaaaacaaattcttgactagaagtgctaggtgtatttttcatgggaaattcactctcaaagaatgtgacatctttggactcagtaattgtaccaactcgcatgtcgggtactccagagtttactattaagaatctataactcatgctgtggatagcataaccaaggaacacacaatcaacagtctttggtccaagtttacgctttttggctataggtacatttaccttggccaaacagccccatgtgcgtaggtatgagagatttaatttcttcctttcctattcctcgaattttgatacttccttatgcttcattggaattttattcaggacatgacaagcagtcaaaattgcctcaccccaccattccttggaaactcccgcagtgtctaacatggcattcaccatctcagttagagtgcggttttttctttcagctaccccatttgattggggtgaatagggaggcgtcatctcatgaataattccaaactcttcgcaaaaagatgtaaactcattggaaaaatactctccaccccatcagacctcaaccgcttgattttcctttcaagttggttttctacctcagctttataggtcttaaaataatgcaatgctttatcatttgttttcaatagatacacatagcaaaatctagtgcaatcatctatcagtgtcatgaaatatttctttccccctttagtcaacacgccgttcatttcgcacagatcggaatgagcaagttctagaggtgccaaattcctcgcctcagatgccttgtgaggcttgcgaggttgtttcgattgaacacaagtatgacacttggaacctttgaccaaagtgaattttggaattaaactcatgttagccaagcgcgtcatacaaccgaaattcacatgacaaagttgcgaatgccacacattggactcatcattctcgctaatatggttcacaacattattattattacacatgtcatccaaagaaaagcggaacaagcctccgctgtcataacctttcccaataaaagttccatatttagatacgacacatttattggattcaaacacaagtctaaaaccatctctacacagtagagagccgttattgaagggacatgctgcacattcttcagctgcacggtctttcccaaagtaaactttagatcaaccgtaccaacactatgaacagccgcaagcgacccgtttcccatcaacatggaggaacctctcccgacctcataagaagaaaacagggaaatatcagcacacacatgaatattagcaccagtataaacccaccaatcaggtgaatgaaaaacagagagaactgtaggtaaaaatttaccgtaccacgatattcgtccgccctcgctaatgaccatgttggcagacttctggtccttgcgctcaggacaatccttggctcaatgcccaggcttaccacacacaaagcaatctccctttgcctttcccttgcctttcttcttaaaattggttgtagccttgggtttgacatcagacttgactttcttgttgttgtgagaagcgtgagggttcttcttctgcaccaaattggcagtagaacctccctcgatatttttgccccagttgtcctttgccctcgccttctcctcaacacccaaagagctaacgagatcggtaacactgaactcttgtctcttgtgttttagagaagtggcaaagtccgaccaagaaggtggcaatttggcaataatgccacccgccacaaacttgtctggcaactcacagttgttgttctcaagttcctttgccagcatctgaatctcatgagcctattccactacagaacggtcatcgaccatcttgtagtcatagaactgctccatgacatacagctcgctgccggtgtcggaaacttcgaacttggcctcaagcgcatcccacatgtccttccttgaaggcatgtgcatgtacacgtccactatattgtcagcgagtacactgatcaatgctctacggaacagacaatccgaagcctcgaacttagcctcctcctcaggagagagaggtggttcacttcgtttgccccgtgaaacatagaagcattgcatcgctgtcaaacacagtagtgcatgtgctttccatctcttataattagaaccatcaaaagcatgtggtttcagtgttgtagcaaagccaactaccgaaaatgaccaattaggtttttggtttattggaaatttggtcataattcggcatattttaatccaaaataacaagataattaccatgatatttacaatgggatttgatccagtgatagtggtgaatgtaatcaacatgagcatgcttaacgtagaagaagcatcaacaatcacataataacgcaatgttgacactgcgatgaacattagtagtaaaacttctaattgaaataatgtaagaaggttataccccaagaatggtcctccgctggagtttgaggaagtattgcctctattgttgttgacaggaacctccttctacttgtctccagtgttgccgttgtctccagtgttcgacatattggtgaagacgaagtagacgttgacgaatagtgagtagtcgcgcattgcgctccccaaaaacctaatcgcccgcctgtccgtgcaaacgtcacagcagtgcgtggtttcggaggcctactctcccaacgcgtgagcacacactcgacgggatgggattatcatagcagcaacagccttggaaatggatgaaagtgtgtctcacttcttcttacggagatcaaatccattctcattttatatgaggaatggaagatgaagagtaagagtcatggaatagaaagaggaatagagtaactaattctcatcaattagccatgaaccatcctccactacacaaccatcaaccaaccatcaattaggagtaattgatgtaggttaccaatggaatagaaagagaaatagagcaactaattgtcatcaactagtgatgaaccatcctccactatacaactatcaaccatccatcaattaggagtaattgatataagttaccatttccctaatcaaatggattaattctcaaaactcctcgtctcattgatatcccacaagagaatgaatacacatgaattcttagcataatgagccttggaatttatttaatttaattgatttaaatggatcaattaaccaattaaatctaacaatccccaccaaattttaaggctcttgagaatgctccctattccatagcagcttttatataccactgtttcggtgaagactgttaatgtcacagcctgaatttcctgtctcaggatttataaattatttaataaattaatattagaatttatattaaatgttcattaatttacaagtgaagttaaatgtgggaagtaaaaattcctaaatataaagcatggttggatttaatttttattaaattctccatgattaattgtactctctggaattttctcggatttttaataattttaataatacaaagaacatttcagtaattattcacatattaaattaatcattaaatgagctggttacagttttgttaaatactttgagtgtccaagtatgttcaagaattttcttggaactatttgtgcattggaagtatttttaacaattgaaagatcatctcattggttaatatatttggaaaagtaataaaatcttcctcctcagcttgggcccttttcaacccatttccttctcttctctctcccttcctctcagcccgcatagaagtctgtttttcttccctctcgctacagtgttgtcttcaacatctggacagcgcccgagccgtcccgagctgcagccgtgccgatccccttccgaatccggcctccccgttgctcctttttccaaattagttgcgggaacggaatcctctcaatctcctctacaatttccccacgaaatccccaaaagtttctatggaaatcctttccaatttcgcggttcaatctatcctttttccgacgaagatcctaaactttccagagtttttcccgttgatgtgggctcgatcctgggctcccatggctatataaaggaccccctagtcgtcctctacctatcctctcaagtcccgtcttcctccatcgccggaatcgctctccctgcgagctccctctctctccacctccggccgccgctccagccgccgtggtcagtacctcgccgcccttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14315 - DNA, 742 bp, Oryza sativa
agcattgcatccctgtcaaaccccagtagggcatgggctttccatttcttatattagacccctcaaaagcatgtggtttcagtgttgtagcaaagccaactaccgaaaatgaccaattaggtttttggtttattgaaaatttggtcataattcggcatattttatccaaaataacaagataattaccatgatatttacaatgggatttgatccagtgatagtggtgaatgtaatcaacatgagcatgcttaacgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttagtgacgggtggtgacaatgagttgatg

SEQ ID NO: 14316 - DNA, 732 bp, Oryza sativa
gagttcacagaaatttgatttactctaaaatgtgttgttttcaatttgttatggtttttagaagtttacatgtttttctgttgaaaatataaaagctttaggtacttcatttagattttttccaaattttaaataggttgggtccacaggtcagtgagaccaatatgcaaaaaggttcctaggtttgaaccaagccacagttctaggcccatactccctccatactcgtaaaggaagtcgtttaggacaatgtttaagtcaaaccttaaaaatataaatcataaataactatcgagttgttgagtttgaaaatgtaaaaattatatgaatagatttgtcttgaaaaatacttttataaaaatatacatatatcactttttaataaatatttttatagaaataagaagtcaaagttgtattttgaaaaccgtgtcgcggtcctaaacgacttttatacggatcgagtatgtcattgagtggaaaggttagacattgagttgtttaaattctcaaaacaaagtcgtgtttccttctcccaccgtgcgccgcctttcgtcccgatcctgttcggattctcctcgcttttatttatgtgttcggtttcgtggtttttccttctcctcgctcgcacaaattctccatggactcgcccgacggtacagatgatccacccccgttcgcagcctccggtcattactcattaccgccacgcgatcgtcgtgctccaccctt

SEQ ID NO: 14317 - DNA, 724 bp, Oryza sativa
tagattctcagactaggatcaacactatgcaaatccataagccatgtagccaccaaattaggaacttggtttagcttgcttagaaatagcagccgcatgattgatcttgatggacctttaccatcaacatatcatcggtcttaccgattctcttccaggttgtgggataggttgcaccctgaccagcatttcctgctcttcatctggagcatatgttcgtgcctccacttgaaactgcaaggtggtggggatagtgatcaaccaagtgtattccgaccctgcctagcctcctagaagcccagttaaggttcaaatcttgtgatgttctacgccaccattggagggccaaatcagatttggtggcattcaaatattgccattctggattgatattaagttaaaagttggagtaccgcatgatttatatttttctaactgacgaaatcaatagaatgtttgtaaagcatgttcctaaaagcatggtaacaaaaaggtttcttaaaagtcgattggagcaaggtgaaacctataggggcatttggtacgcaccactttgaaaccaaagagcaccacatttttgaaacatgtcacattagcccatggtcttaattctgaattgaaccgcaacaatttgatagatgaacacttaaagctcccaattgtatcagattgagatgcattacattgcatcaaacatatattgctaactgataattgtttgatg

SEQ ID NO: 14318 - DNA, 695 bp, Oryza sativa
cagtataaaatcgccctcccccagggcggcaagggggccgcctgcaaaattccatgccccctcgccgcccatttgcaggcggccccccacacagtacaaaatcgccctagcggagggcggcaaggggcccgcctgcaaaattcatgccccccctcgccgcccatttgcaggcggccccctgcacagtataaaatcaccctagcggagggcggcaagggggccgcctgcaaatttcgttgacggtcgtcgcccgagagcgaacggccgtctgccacgtcattttcgccgccctctgggaggtcccagagggcggtaggcgactacttccgtcaattttcaaaatggaaaattatttttgtaaaacttttaataaaaaaaattataaataaaaaaaattccattttcttgggtaagattgaactagaagaagtaatcagtgaaccaaacaacctttaagaccattttagtattgtgtaagcctagtattaaacatatgtttagcgctgatatcaaagacctcaagatatatgaagcaactagttgaatgtgggtgcgttgcaacagaatgtggtaagattcgtcaaaaaccaaatatcatatgcctgtttggggttctctagtgtacaacttacaggcttcttttcgggtttttgaagttcggcctaattagcctaatagccttctatacactagtg

SEQ ID NO: 14319 - DNA, 562 bp, Oryza sativa
  unsure (1)..(562): unsure at all n locations
tggtcagtatcgcttggttaaagatgaccaagtccctgaaacccataccgccaagatattttggcgtagacagccactcccacgagggccaatgcatcttcttcctcccgcctcttgagcaattcaagcatgctagaggcatcagtcgagacattttcattttctaaaaaagttagtcgagacattttggcaggtggtcaaaacatatttactactacctccgtttttttaatagatgacgacagtnttgaccgaaacactggtatataaaagctgctatggaatagagagcattctcatgagccttaaaatttgggggggattgatagatttaattggttaattgatccattgaaatcaattaaattaaataaattccaaggctcattatgctacgaattcatgtgtattcattctctaatgggatatcaatgggacgaggagttttgagaattaatccaattgataagggaattggtaacttatatcaattactcctaattaatggatggttgatggttgtatagtgaagaatggatcattactagttgatgacaattag

SEQ ID NO: 14320 - DNA, 710 bp, Oryza sativa
cctgggagtataaggagaacgagataattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaagtgaataccgaggtcagatattgacagcaattgggtgtgatgggaacaccaggttctaccta

SEQ ID NO: 14321 - DNA, 4111 bp, Oryza sativa
gaaaaaaaaacctatatatatatatatatatatatatatatatatatatatatatatatatatatatatataccttttttatatgtgccggtttgaaaaaaaaatcggcgcctataaagcatttttggccaaatcccaatcccactaagagaggagtattgatgccgattttaattaaaaaccggcactaaagaccctcctaccagctgtcaccaaaaaattagtttcggccactagataaaaaccagtaccttatagatgtcggttgtaaactccaaccgacacctatattatcatgacgtgataaggttaaaagtaaaaggtgccggttctcactaagattggcacccttgcttgttcatccacctgtctgccatgctctgcaagcttcatcagtaatagcaattaattggcctgtgacaggcaataatcatggcatgaacggcatgtaattaagatccatccaagtatccatatccaacaccctacatgcaggaaggaacgttcctagcaaggataatcaagtgtcatcatctctgatcagtctcacagaataataattaatgagatagatcattaggcaggcaggggcatggactaatgtcttcaaaatggttgttggatcactaacaagtaacaaccccgtcttgtttatggaacacattagctagctttagctagtgtagccatctaccccttaatcagtttgctaactggacacatggaacgagccactaaccaccttttaactcgcctaatattgatctctgctttgtttaaatcatatgtcatctcaaaggagagcaggaggcacactgagattattggggtggtggtcctctacgtacatatcaaatctttgatggcctaaaagatggagagatgctgtgcaaactgcaaagtgggattctgaatatctcccccgtgagtcacgacgtgtgcgttttgaaaaatgtcagaaatattgaagctagcagacaactcgatcgccattattcaggagcctcgtcggttgcccttatttgctaataagccaaaacggtttattagagaataaaaattaatttatagacaattttgttatatatttattcatagtgcctaaaaaaactattgttaaaaagaaattacgttaaaaatgtttgaaaatcaataaaaattcaaattttaatttttgcttcagctctacaaattttgtacaaccgattgggctctcaattcttcttcacatgcttcttcgcgtcatgcataaacacataatgcatttgattgattgatgatcacaagctaggcgacgacgtacgccgttcggtagggagagctgcatttgtcttttcttttttcagaagctagtagagtgacgtacagggtattcagcttaatcagtagcatggtacagtatagtaacatgcttgagctaatttcacacacatgcgattaatcagtgtatcgcatgttagcattggcgtattaattgcagcatatatcaagtggatcgacagcaactaatacacacagcatcagtggagagaactagtgagaactaactactctcaggatgatttttgcaacagttcatcgtctccagcggtgactgagttagaaagattttttttttacccgaacaaacttcattataaactatcatttgctataaaaatttcatcatcaatttattcaacaatgggagggacccgtgaacccccgcgtcgcccacgcgcaggcgacacggggggcgaaacctagctccgccgcccccctctttcccctttccccacctcgccgccgccggagctcaccgccggaaagttggccggcgagttaggagggcggcggcggggccttctcctgtggtggcgtcccctcttggcgcgggggaggcggcgaaaaccggcggcggggagtggcggcggcgagctctccgggcaagacgatgacggatctgcggttgctgtcaccggatctggcctggcccaggccggatccggcggaagcggccggcgttgtggcgcagcgcgaacgaaggaggtatggctggcagcggaggggcgcccctctctggcggcggagacggctcgcgaggccggcgcgcgcgccgacacacgcaagcggggcgcgaggcgtcgcccggtggagccgtcggcggcggggcacatcggcggctctgcaccggtggttggggcgacactgtcctagccgccgtggcgtccgcccccttcggcctgccccccctcccccttctccttgagttggcggcagggtcggccggtcgggcggatctgtgggcggtggcctaggctgattgctgaatggtcaatgtggcttgcgacgttccttgtgcaggttgcgtggatttgaatggggtatcgcgggtgaaagccctgctgtgccgttggccggcttgacgacggcggcgtctttcggcgtcgttcccctccttggaggcgttgttatagcgttgacccctttcttttccttaccgttctccgggtgaaaaccttgctccggcttccggatgaagcggtggcggcgaccacgtcgtgtccttcttggggcaccgctttggagaagctttctcgtacaaggatatcgttggtctttgcattggcttcgaagctttttagtcctaggtttcgacgaggcctttgctcttctagtttcactttttgtttcgcggcgggcgacctttgctccttgtttgattttgctaggtgaagtcggagctgcttcgttgtggtaatgaagctgggtaacgatgacacactacagtttctttctaggggtgttgttgctgaacatgaataggatgtggcgcttaggcagcttgggctgatgtccattgtgggatgttgaggccgcttgatcattatggcagcgtgttaggtatcgatgttgtattctaaagtcggagctgctgtgtcgcttggcggtaagctcggcaacgatgacagattgcaaagtcggaacctcctatattgctcttggtcaaatttggtatcgacaccctatgttgggctccgtcagtggtttttagttgtagtgtgttgtggcgagtgctgtgtgttcagccagtcggtggttgttttttcttttcttgtaacccgtctagggtttttactcctgcttattgaaaatataattggcagttctcctgccagtttagtttaaaaaaaatttattcaacaatatagcacgtgtgggcttcagtgcaaaggacagagagaagcccatctctgtatatgggccgtacatttggtccaaaagttccagattcagcgaactaattggcgcacgaacaaatgagtgaacacacccgatgcgttttattatcggaaaatgctgctacgaccaatctctctcaaaaaaaaaaaaacttgtacagttcttatatttcttttaatctaattcaggtggggtcttttccccccggtggatcaatgggcttgtttggttcagtaccctatcaaatcaaaatattgataggcctaaaatctaggtatgtttcagcactactaatattttagtacggcagagttgtaaataaatgtgtttggatttaaactaattgagagccaaattttaaattatagtgaagaatgttctataattgtaccaaatcgagcatgtgcattaccaaaaatttaacctcagaccaaaccatcacatttactattcaaaataaaaaaaatggtacaacacattttggtatcaaaccaaaacggcccaatattatcacgcgacagcagtcggcggaggtgttgtccgcagggagggcggtgcaacagacaataacagggatggagctacagtagaaccatcggggtcagccgaccctgatgacctccgatgaaatcgtaaattgtttaagcaattaagatgacatcaggaattaaacaagattagtatattctgaccccggtgacaccgatgaactaattcctccccgggcgacgagataattcagctgagcggactgataaaaaggttgactcgatcaacgatctgtgtttttgtggggttcggaattttattttccggcgccggtgaccccccaactccggtagggagcatacggattaggttttggagttggggtcagggtaggaggggg

SEQ ID NO: 14322 - DNA, 1422 bp, Oryza sativa
gtataataacacaaccttacctcacggccactccctcggaagaaaattacataggatggaagaccttcaaacatcagaaggaccgtgcttctccggttgacacgtgtataagcacaaatcttgaagcaatcatcccctacctctggcccaactcctctccactctccatccccgcacatctgcccttctgcacaccaagcctggcattggatggctgctcgccggcagcacctacagtcccagctgtggagattggtcgatacggcatacggtatcaagaaattgtgagttttcttaacttaattcagctgtatgtcctttatttacatgcccatgaataattttgacagacaaatcattaattgtttggcatataggttgaatcatagatcaaacttgggtactcgacgctcacaaagtgtgaatgaaatctggaaaccagtgattgagaatttgagataaaagtaatgcgagattcaccaagaaaacccacaacaaacatcactaattgaccatagtgtactcaacgagagaggggaactctggtcagggaaggccggaagactagggagaggagagaagggggagggggggaagttgggctagaggtagatggcgattgcttcaagattcgtgctcatacacgtgtcaactagaaaaagcacggtctttctgatgtttggaggacttcgtctcctacgcaattttcttcacactcacgccggcgcccctcatctccttccccaattccctctccggcgacaaggtcagggcggcgccgatcggcgagcttcgcactagggcgggcatggcgcgccgcgccgcttcccgcgcccttcgctcggagggctcgatccaagggcgagggggccgcgcggggggcggtggcggtggcgccgaggacgcacgccacgtgttcgacgaattgctccggcgtggaaggggcgcctcgatctacggcttgaaccgctccctcgccgacgtcgcgcgtggcagccccgcggccgccgtgtcccgctacaaccgcatggcccgagccggcgccgacgaggtaactcccgacttgtgcacctacggcattctcatcggttgctgctgccgcgcgggccgcttggacctcggtttcgcggccttgggcaatgtcattaagaagggatttagagtggaagccatcaccttcacacctctgctcaagggcctctgtgccgacaagaggacgagcgacgcaatggacatagtgctccgcagaatgaccgagctcggctgcatacctcctgagatgaaacaacaattaacctttcttcataagcatttttgccaacttctttaacctgaacgcaagcacctgtctgcaattaaaatattggatgcaggttcaaattgaatgaacaggttttataaaatttagaagcgcagaaatgc

SEQ ID NO: 14323 - DNA, 27437 bp, Oryza sativa
accccacaccaccaactctcaaaattctgacatgtgggatcactgtctatcccttctccaaaccaattgtatgatagaacagtgaaaatagcgaggtatgtcagtgacccagagaggaggggacggcgcgtggtgagctacaaggcatactcagtggagggcaagatcaaggcctcccgtccgtagtggactccgctgcatcaaggccaactgctccgaactgatcaatttatggtacggatcacttctcctttcctttctttttcaccttaagcactctcttgattcttcgctgctacctcccttaatttctttcaagatattgtggcacttgatcatggctgagacctaccttccagtgtgaaatggattttgtcaaagaacttattccattagcttattttccgattacatggaagacattcttttctggaataaatacagaactaaatcctatttcctgaataaaagttatgtggtgtgtggcatgctgcatttctgcgcttctaaattttataaaacctgttcattcaatttgaacctgcatccaatattttaggtgcagacaggtgcttgcgttcaggttaaagaagttggcaaaaatgcttctgaagaaaggttaattgttgtttcatctcaggaggtaatatgcagatgattattccaattgtcattgccttgccatttttatcacgagtctttacaattttatatcttcctacatattctttccagattccagatgatccagtgtctccaacaattgaggcgcttattttgctccatagtaaagtaagtacacttgctgagaaccaccagttgacaacacggcttgttgtaccatcaaacaaagttggttgtattcttggggaaggtggaaaggtaattactgaaatgagaagatggactgggggctgaaatcccagtctactcaaaagcagataaacctaagtacctgtcttttgatgaggagcttgtgcaggtaatttatttggccatacctacaccagagatccatatattacttttataactgcagcttttacttgttaacatttcattgtgcttttacatttgttccaagctttcaggttgctgggcttccagctattgcaagaggagccctgacagagattgcttcgaggctttgaactaggacactcagagatggaagttcttccaataatccgacaccttttgccccttttgatggtcctcctgttgacatcttgcctaacagggaattcatgctatatggacgatctgccaatagtcccccatatggagggcctgctaatgatccaccatatggaagacctgccattgatccaccatatggaagaccaatatccacaatatggaagaccttccaatgatccaccatatagaagacctgccaatgatacatcatacggacggttgaacaatgatgggcctcgtgatccttacaccgtgtatcctgtagagtacttctctaaaagagagtaccgtagtggaagtagcaaagtcaccatctgcttcatacgacagatatgcagcaactactcgcttgcctagtagagaactgccctcatctattagtcctggtgccgattatatgtcccgccgttcttatcttgaccaagtacctactgataggtactctagtagggtacactacaattaggcctctcgagagctgggaatagtaatgtgcaacaattaggaatcaccagagctggaaattccaatgcttatgattatactgaggtacatttccaatgcgttagcttgcctcttctttgcaaatggccctcgcctgatatgtttccattagaaacatgaaaccatatatatgactgttgcattatgtctattttcttccatgatggttcagacgtctgaaaaaaggacaaaaatattctagaatatgtcatggtggtccaaatatatccttctgtcttgtgcccactctaatatctatcattggtaacactattcaattgttaccatgttgttgcaaaccctagattcagttattcagctgttctctgctactgttgcttaccagttttcttagttgggtgttgatcttttctcattttttatttccttgtttcctggtacacctgatgcctctctgatgcatctgaatgtatgtttttgttctcttcagtgcttaatagatttaaatttcattcttttcaggctgcggagcagatccatggacgtgaggattaccgaagactgtcaggtctcactgggtatggcttacgcagactgaatttttacaggacacaaacatgaattttgtcctcataatcattgagtgatgatctctttgcaggtatccaggtggctctgtcgaattgcggattccaaatagttatctggagtctgtgactgtctgtcattggtgttggtggtgtcaatctagctgagatccgtctggtatagcgtatgcgaaacatcatgcactatccccagtcttaaccatgccccaatggccaccaatagttttcctcatgaaaatctccccttgatcccggatctgtggtgcgagagtgaagttgcacgaagcccatcctggttacaaattatttaataattaaacatgttacaaattaaagaagaaataaaaaaacatcaaaaattataaaatgtcaaaaaaatcaatgcacacgactagtgtgcttagcaatttttttatccacaattacttttacaatattataattaattttgttagaattattattataatatagaaaaaatagttgccaaagtttctcaacgaatatcgaataaagtaaaaaatatcatatatttaaatatgatggtaatatttgtttgcaaaactttgatcttcaatccttcaacagcatagatatacaacgtcgtaatcaccaacgagcccgagtgaccatacgggatagccgagcggcggatctgcactgtccttgggtgaaataaatctagaacattgtatatcttatcttaatctctactattagaaattaaagatgtttttgctcaagatttccgtacgttctctacttcgttacaatatcggttttgtacgcccgcacacgcgttgtgtgttctctggtagagatgcaagtggatagtcctgctacccgtataaaaacccgcttcctagttcattttccacatgatagtataaaatttagaagaaaaaataaactataaataaaataagcaggctgaaaaaccccgcttgtccactccgtttgcatccctattctccggttccaatacatgaagtgagtgtcttgcttctccctggtctggcaggccctttttccaccatccccacccgggccggcgggttacattgaccgatcatggcccacattatgtgatgaacactagctgagttgaaatttatcctttgatgattttcagtatgtttttttttctccacatcttctctttcaattttggaaaaatattttattcttgatttttgtgctcgtacatcactaataaatcagctgttacccttccacacattgtcaatttatcatgtctatttcagctcttaccttagtatagtcttgagtcatcgctactgactggctgtgttcgctaggagaagttcccatccagaacagtgattgtgaaaaacggaacggtttattagcgcgtgattaattaagtatttgctatttctttttcaaaaatagattaatttgattttttaaagcaacttttgtatagaaacttttttaaaaaaacacaccatttaaaaaagcgtacgcgcgcgaaaaacgagaaagaggggttgggaaaagctacgtgcctcctacaaatcaatagcctgccataacaatattttctacgacatgatccatattaatccatgcaatgcaagcacacacgctactgcacgaaaaaactacggtccataacttcaaaactaacatgttagaatgacgttaatttttcattgcaattatattcatcgaccgttaatttactaggcagcctgtttaaaaaaaatattcaccggccatacccacatgttccgtagttcattaggtgatggatcggtagttacagcagactatggtaagcaatagctatatatacacgtatatgcattgctaatccttcaattttgtccaattcttttagattgtattcacctattgtaacgcatgatcatttttctagtcttaacctgaactaatcttaatcttaataaccaattaaaagattcgtaatttttccatcgtcacctcggctaatttttcatcggtccaaaaaaaaatccctgttgttcctttccatcccgagaatcgagacagggaaaactgaagcatatacacacaaatatatccaaaaattcccatgcagctagatcgaagggaagggtgctgttgtcatcgccaaaccgccaccgccgtcgcagggacgccgtcggctcccctatcgctggatctggcggaggggagggcaccgcccctgtccgccgcctcccctcccaccggaagtgagggcgtatgtggaggagagaagaagaaaaagagaacataaaggagagaaggatgaacggtgattgagagaaagactgagaggaagagagagctcgggaataaaaatgtggagttaaggatcggtggaagaatcgaggtgcgcggcactctctccgctctctccgagcggttaaaaaaaggacaatggtaaatttacaatttttttgaatcgttaccgtaaaaatggcaatagaaacttgcaaaaataccactagaattatcattcgagtggcatccttgaaaaattgaaaaaaacggtggcaaatttacaaatgccctttaaaaaaaccacttataacttagtactttatttataaaaatggtatatcttatcttaactacttaaattagtaatttttcgtttgtcacctaattctttcgtccgtaaatccgtttttcggccgtatgcacatttgtgttggcgttcatccgtcgttcctttctcgcaatccaattcgagcgacacaaccagccaaggggctactaaaacgaagggaaaagcaaggatggattggatctggaccctgaatcggacaaataaccacgataaaatccgctggaagggaaccatgagattgcaatccaatgaaatcgatcaatcatctggtactttgcctcggcactgggcattgatcccctaccgaatttccgaccacgccgtgcatgctctcgcgcaccatgaggtggctgacctcatcggcgtgcggtggccgccacctgctccacgccgcctccggcccccatgtcctcgtcgtcgagacgcgccacgcacaacatcacgagaagccccctcgccatcagagcgcatgccttagtcgccgccgcctccaccacgccgcacacgtcgtccgtaccggcgtatctggctcccgtctcccccacaagcggggcgggtctcccacctccctctcttacaccgtggcatcagctaactccgcacggaagcttcgccgtcatcgctccaccaagccgccctcacatctctcgcttagaccagtgcgtcatacaacacgagctggccggcttcgcttcggtcgtggatctccactgtcaccgcctcaccggggctcaccgaagacatggacgacatgaatacgtcgctcatggctgtgttgtgatgtcatcgctgttgctctgggtggtcgccatcgtggactcatggttcgctcacttgaggcagaaaagtcacggctaatgggcatttttttttcattttttacaactttttttatttctaaagaatatatttttcttgaagggcttatatcatgaaaaactaaatcctaatcatctaatattttttataattttattttacacgttgcatctatttattaaaaatgtttaaataataaaaaaattctcaacctgtcccctctgctctttttttctttgtccctgtccgctctttttttttacttttttattttttttcctcactgtctaatctttttttattttttttcatgtctacttattaatatttgacctcaaatacaatttgtaaataaaaaataatacacgctctcacaaaaataataagattaatttttacgatttgttaaactacacacattttcttcaggtaacaatacacaggtatattcccacaattgcaaagtgagtatagtttaactggatgggtttcttgtggtggaaccagtcaacatggatttaaatctttgatgaataaagagcagcaccgacttcgaccaacaggagtagagctattacctatcatataagggggcacgaacctgtataaaaattcttgtctccatttcttttaccttaatctcgtatacaccctggtaccgacaatccccataccatgcaaatactatagttgtgacctcaaaggtcgacagtacaattgtagtgtaattacatgttagtctaactataactactacatccgtggctccgtaaaaaaaaaatctaagcatggacaatgacggagcgtgaggctcctcaccgggagactgcgcaggcccccctttgccggttcggccggggactcagggtgagattctaagctctctgtatgtggaaggttcgctagaccggaaacacacaagacacgggcgatgtatacaggttcgggccgctgagaagcgtaataccctactcctgtgttttgggtgatctgcgtatgaaggagctacaaggtatgagccagcctctcccttgttctgggttcccaatctggaaaagtccagtccccatctcagtgggcaaggtcctccttttatatcttaaggggataccacatgcaccatttctctctttttttgtggggacttaccccaccttttcataaatggacggagatttgtatagttgccgtccgagtcaccttctgatgagacgggccacaactacctccactttcgccgggagcaggtgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgcaatggttaggatgaagcctggcatatatctgaccaggactaacgtgccatctctgggaggtaacacgctagctccagctggggacgagcgcctagaagccctcgtcctgacgggatggggcgaggcgtgtgtcagatcgcctgtcgccacctaacccgcgatctgaccggtctgtgactggtcactgaccggataaactagtgcactgcattgcgttacatgcggcgtgacacgctcagccaaaccgcaataaatgtggttaggtgagccccactgttctcacctaacccatatacgcagagcaaagacccacgaggggtcggggcgcctcggccctcggggccgaggcgggtgcggcccgaccccctcgggggggactaagaggagggcgaacacatcaccctcgggcccgacgtccctcggaggtgccaggccacgtgtgcgattgtgtctgcctcaaacctctagtcatgatactcctgatcccatgtcaccgacagacaacaaatctggacatgagcacgtttagattcgttgtcctatgtaatgttccatccatatcttttttttcttaaggggtacatgtacttactccatcccagaatataagacataaccacttttcttctatgtctcataatataaggcatgcatacatgcatatattaattatcatctcttggttctttaaatttggtttattttaattcatgtaccattaagtctcctaatcacattgctcgtatgtatggatgtgattcaatcaaggaggtgattaaattctttcttggtctttatgctagaagtggttgtgtcttatattttaggatggagtgagtaatatttatataagttatttttaatacttatatatgagttattataattatagtatagatatattgaaattatattaaagttgtactatagttagatttaaaagtttttgttgtggcagtttttttagatagtctaggggaaaaaaaacaatacaccggttgcgttttattgcaggaaaatgcggccaaaaaagatgcacatataaatgtcacggcgagggtgattctcaattttggccaggtctaatgaatgtcaaatatactgtcttacatatgggttcttggattgtgaatgatgggaatcaaataaggttctgggaagataaatggctaggaaacttggcgtttaaagataaatatccatctttatactctattgtccgaaggaaaagttctactattgctaatgttatgagttctgttccacttaatgtttccttcaggagatccttatttggtcagaatcttatatattggcatgatttgtgtgcttccattatacatattcaattaaaccaatcctctgattgttttagatggaattatcatcagaatgttagattttctgttaagtcaatgtatcttgctctaattaataatggttatattgagagaaataagattgtttggaagcttaagatgccacttaagattaagatctttatgtggtacttgcttaaaggggtggtgctaactaaggacaatttggcaagacagaattggaatggcagtttaagatgttgtttctgtatgaaaaatgagatcattcaacatctttttcttgactgtcattttgcaaaatttgtttggagagtagtacagttttcttttggtttaaacctccctggtaccatatctaatatgtttgatggttggctttttggggttcacaagaagatgagtaaactcatacttgttggagcatctaccatttgttgggctctgtggttgagtaggaatgatatagtttttgataaatcaccatctatctcatatatacaggtaatattcaaggcaacatattggctccggttttgggcaaagctgcaaaagtgtaaagatgatggagagtttatgaaggttgtatgccgtaaactggagacgacggttatgcaaatatttgcgaaccatggatggagattcacaaatagacttgaatgagattcacaaatagacttgaataaatgtgtgctccttttcttggcttggtttttttatcgttgggtgtgtttaattttatttgaactttactcgttgtttgtgtgattccttgtaataattggctgtagctctaatgagcaaaggcagggatatttattccattatcaaaaaaaaaatgtcacggcgaggacgcccggagagccctgctcgccggcggcgagctcgctcgctcgctcgctcgtctcagttggcccgggacgagatgaggggcttgagcaggagcatcctgcacgagtgcggcgccacgtcgagggtgatcttctccgtcaactcgccgccggcgccggccaccgtcgcgtgccgccacaggtccctggcctcgacggcggtgccggcggggaggccgacgtcgtcccagtgcgcggtgatcgccgccgcctccgccgcgtgccggttcagcagcagcaccgccgtcctgtaacccgacagcggcgccgcccacacctcgctgctgccctccatcctcaccttcttcccctggatgcccagagcatctgaattcccaaaaagatcaatccgacaagcgccatgaaaactctctgaattcctgaagctcgcggcagcaggaagagtagagtaccttggttgacggcgatgacctccttgttggccaggatgtcgtacgtctcctgcgacatgtgcctcacgtcgcacccgatgatcagaggagcctgaccaattcagagaaaatttcgatctgtcaaacccagcaagagcagaataatgcaaagcagagtagtatatcaccgttcttttctggtcacgatatagattttatctcagtttttgtaaacatgtttttaaaactgttaaactatttggtcttaaaaacctttctatataaaagttgttttgaagtattacataaatctatttttagagtttgtaataattaaaactcaattaatcatacgctaaccgatgataactttctttttttctttacactattttcatcgtcatctttagtagaaacgaataccatcattatccgacatccgtcacatttggtagtaccttggagatggcccagaggctgaaatggacgatgtactcgtcgttggtcatcccgccattgccaacctccagcatgtccgggtctgacaaaccacaaattatatgcctaagtttagacgaaactgtagcatttgaaattcagacatggattgaactgatgatacagtaatatgattcgtcagtgattcactgaccgttccagccgccaggtcgcgcgtagtccgcccacacctcgttctcatccgccctcgacaccatgctgaaacagaacgaacacaatcacatatgaaaactctgaactctgaacactgatcctctcgtttcttgcatgtcatttaaatagttgaagacggcggttcacctctcccaggtgtccgcgatgtcgttggtggttctccagctgttgccgtacgccgcgccccacttcgccgggtgcatgtcgcccctgatcaatccgacaaacacgacagctcgaatgatgaacacgaaactgatcacagatttttctaatatactgatgtgtaatctttttgcatgttcgccaaaaaaaaaatgatgaacacgaaactgatcacagattcagaggttcagagaaactaatacacatcgagttgtcctaacctaccattcgcacagcgagaagtagatcggccggccggccatcatcagagccttgctcatctccgggtacctaccattggactacttgtcagagaaattcacgagtcatttttcagacattcagtatcgacggcttcagaaagttcagacaggtagtagcaccaagagtgatcacctctccagtggcttcaggtcgccattgttgcagttatcatacttgaggtagtccactccctgcgataatggtgtaacagaaccaatggatcaagaaggaaatctttaacactaaaccggttcttgaaaaaagaagacactgaacacctagataaaaccccaaaaaatagacatgtttctgaacatttcagtgtgattcagtggctcattctcacccacgatgcgaatgtcttggcgtcctgctcctcgtggccgagagaccccggctgaaccttcgcacacgtcttgaatcttcagaaatttgcacgcaagaatcagttaaaaaaaacaaaaaatggagattggagcaacaaacagattgatattttgccacagattatttgctccatcttctatttctactgcattggttaaaccacctattgtaatctatttgcaaagtttatttttcaaaatattgatttttttatgttcttggctcttaccctgcatcggagtaaatgcctagcttgagccccttgctgtgaacataatcggcgagcgccttgatcccgtgggggaatgtctttttgttggccacaagattaccctgggacagtatcatcaatattaagtactgtggatgaaatttttttttgtctgcctttaatcacatcaactctgttcattacaactacagtccagaagaaatcgaaattatcagtgctgcattatcacacacaccttcgaatcacgttgtggctctgcccagcaatcatctgaaaagtttttttatatatataaaaaaacacgattttattatactcagtcaggtcaagccattgacgacaatatcatagaatatcaaaacaatcatatcatttttctattaacaatatgattttattatactccaattcaagccattgacaatattatcctataataacaataaaaataatcatcagaaaagttttttaaaaaaagaacacatgattttattatactcaatcaagttccagccatcgacgacaagtaatatcctagaataataagaaaagggaaaaaaagggttagtccaagaagcaatgacgtatgcatgacgcacgtaccgatgttgacgtatttgtagccagcagctgcaagcccggttgacacaagtgcatcagctgctcagaaaaaaaaagggaaaaataattaatcaagattcaacaaaggctaattcatcaattattctgtttcagactttcagtcaatcagctcacgctggtagtaggatactactagtacaaatgtacagctgtaaacggcactgccggacagaaaaaaaaaagaagtttattactccaaacaaatatattgcaaaaaaggatttaacaaaattaattttttgttatagaaatattattacattttctctatatgttttaccaaacttaaaaagaaatttgatttaggacaaaatcaaaacatcctacgtaaaataactgaaattaccagtctccctgatgacgtcttctccgttgccgtcgcaggcgaagtgattccagctgttccagctgcatgaaattcagaagcttaaattaaccaagatgcagactcacaagcagaaaggcgctattgctcacatgacaggatagcagcaaagattaaccattactattactagctaactacgcttaacaattagaattaacattggattaattagatacgctaaattactgcatgcttagtgacgatgtgagtgattattattccttaccccatgggaggagccgtggcgaggccattggcgagcatgctcctccggtgctcctcccccacgtgcaccacccttccgcactcgccgccggcgatcatcgccgccgcggcgcacgccaccggaagcagcaccgccgccgccgccgccatcgcctcggtgatcaagaacggcacagctcgccggcggctggctgctgctgatcagctcgagttaagaagagaacgagagtgaattaatggcgctctcagccagtgacgcggcgccacgtgtgcgatcccccgccactgacgcggcgccacgtgtgcacctccatcgaagccactggaagctagagtacgcgtgataggggacacgtgtgcgcgaaagggtaacgtggggcccgccagtgggacccacttgtcggcgaccggaagcttccgaccgcgtaggcgtaggcgtcgatcggtctgatgatctgatcgttatcctgatgaccgagtaggtggtaggtcgacgtacggatagaacggaatttatttctaccgttttcctggaccgcgatgacgctgtccgtaggaagcccgcagagctacgctgctgctgctatcggataaggaaaactgatgaaaaacctctaaatataagcagttcaaaataatttatgaataaactcttatacagtaatgtaaaaatcaatgataggtgtgtttggaaaaccagttgtggctgcagcagcatatttgctgcttgatgcactattgacttgtaaacataaaaggtctgttcgttgcaacttttgtgcagctgcgcagttgtagctgctacagtgactatattgcttctatgttgtagctgctgctgcagcaagctgcaccgaacaggatcaaaagtagacgacgagggcatttagaaggagaggaattgtatttgttcctggtatttaatttttaaatttgtggtcggaagtttcggaagaaaaaatgtgctcatgagtgattattggctctgaacaccaacctctcttttcgttgattccttctgaggtgttgggtgttgggacacgatgctgccgccgacacgacaccgggttccacaatacactaatctactcgcgacaccttcattgaactgcatataattatttagaaagtccattaacacatcttataaaaccttgttgaatcatataatcattctacaaagtctatttgaacatcttataaaaaaataagatctgacctagtcgttacactctcttacattttccattagcctaactaattccgtgcaggaaacgcccaaaaataatagtaccaatagtccactaatcccgtgccagaggccgccaatgattagtgattaacccaaaaaacataatcatcatcacacgccgctaatgaccagctctcgcttagctaatcccacaggcggcccccacacgccactcctgccatgtgggcccacctttcacaccccccaccaaccagaaaaaaaactcccccaaaaaaaaaacttttaatgcttatctcgcggcagtataaaaggcgaccccaccacccacacacaatcacagtcagcgacccaacccaacccgagccgaggagtcgagtcgtgtgaaaattacgaaattgcccttcgactccaccaccaccacccaccggcgaggcgaggagaggagaaaaattgggaggaaaaaaaaagggaaaaagaaaaagggtggaggagatttttgcgaagctaccgagcccgacatgacgccgcatctgcccgtgtcgccgtcgtcctcccaccacctgctcgacgcggcgccgacgccggcgtcgccggcgcacgcgcagcaccggcggcggcggaggaggaggatgtgcggcggggggagggggagggggggagggccccatcctgtgaggtgttgcgcgcccccggcgccgcagccgagggtggcgacgggggcggaactgcgcggagcggcggcgacgactagggtgttcgtggtgtccgacctgcacacggactaccgggagaacatggactgggtgctgcggctccccgtcggcggcgggggaggcgggggcgacggggtggggatcgacgcgctcgtcgtggcgggcgacgtggcggagacgcgggacaacttcgcgcgcaccatggccgcgctcagggagcggttcggggccgtcttctacgtccccgggaaccacgacctctggctccgccgcgagaacggccgctacgtgagttggatttctccccacccccttttccgtttcctttctttcccacccctttcttgtccgtctcggctttcgctgcaagcaaggtgtttgacgaaatgccttggcctagtgattgatatgtactaccgttatttattaaagctacatgagtagttatgttagtgaattcgatcgaatggcatgacatatgcctacttagtgcttccctttatgtagtactagtaagttgcataagctgatacaagaaatcttagatgtagtacccagtttattgatgtcattctgaatcttgtcacttctttctggcagtattgtccagctaagctgtatttcagttgtgaatttgatgacatgttgatagtactggttcttgcttcatgacaaagggtgacccgtttgtacataagtaatggacattattaacacattagttgcgacatggggaagctgtttgatagctattctagctgttatacatgccgcaaagcatgacgaacagcacaaactatgaaatgagaactctactgttggatcatagctagtataacagtgaatttatttatttattttccttttgactgcagcattaatctttcttttgtacattgcttgggctgtctcagttactcaagttatttcttccagatggattcgctggagaaactgactgcattgcttgatgcgtgtagtgagctgggtgtggatacaggcccaagaataataggtgacttggggatcataccattgttctcatggtatcacaaggttgctaattttccagccagactgtaatgcaccgtgtttaataggaatatcctgtttgctcattttgcttaattgtcttccagagctttgacaaggaaaaggatgttaacagtgttcgcgtcccttccttagagatggtaactttcttttcccccaatggcctgatatgctattcactgttatagtgcaaccactaggagtgtcaattagcattgattaagatttctggaattccatgctgtcaatatgatatcccttcaagtgttattcatatgtaacctgatccaaaaccatgctgtgacctgggtgacaaaacaatcattagattgataccttgctttcagtgtttagctaccatctgaatttcatttttgcaagcagcttggccaacgttttgttctgttttgttttgatttgtgaaattggatatgttaatacgggtcttctttccatgggcactaacttacattgatattatgttactggtttgaatgatcaggcttgtaaagatttccatgcttgtcaatggcctccagacctggcaaatgaagatgaagctcttgctctctactttgacaaattgaatgacagaaatcaagatgcaattgaagaagtaaaaaagagcagcaaacagatactaacattttcacactttgtaccaaggtgagtgcaagtgcctcctctagttctatctaggatcccacatcaccaaaagttctccttcgtaataatttgaggatattgtttctttgatggctaccatagtactacctccgtttcaggttataagactttctagcattgcccatattcatatagatgttaatgaatcttgacacacatatgtgtctagattcattaatatatatatgaatgtggacaatgctagaaagtcttataatatgaaacggaggaagtaccatacactgggtgtatgatgaaacttgatagtctcctcacaaattctcactgagctctgtgatgtctgggatatctgatcgcgctagcagcaagtcttgtaataccatagtaatgccttcttttcaactctgcagacaggaactatgtccagagaagcggatgctttattatccaaacctcccaaaggtcatcggatcagattttttggagaggaggctgagaactatacatgacaacactaaacatggagccgcttgccatgtttttgggcatacacatttctgttgggattctgtggttgatgaaatcaggtataacaatagatgcactctctgatacaatgtatgaaattagcaatccttattctgactggatacatcttctgaccttaggtatgttcaagcgcctttggcgtacccccgagaaaggaagcgaaggatgaacggaggagacggttggctgcccttctgcatataccgcgatggtttcaatcctgaaatatatccagctctatggtctgactactacaacaagaacagaagggaaccagagaatactcagctcgctccatgggttgccaaatatttttccaagtactactgaccccctacaccgatccaagtcccttgggttcgcgacagattggatagagttgagccgctcaggacagtgtcaaagcagctgctgcattttcctggaagaaaaggagattgacgttttacctgtacatgtcttttgccttcttttcttgtttccactcttactatatgacttttgggcagggcaactaagctcgccctcctgtgatgtatgttggaaaaataatgtgtaaagattctttaaagcccttgctgcaaagatagtgacatgctggaaacattagctagttctgttcatccatcctgtgtaactcatttggcctgtctctttatctgcaaaatcaatctgcgtaggcgtgtagcctcctcactcctaaactgaacgaattcagtgaagtgatgcattggccaaaatttagctaatgactgacgatacgatactaactttgtaactacactagcatcaagaacaaacttgaaataaagttacttctacttgtatatgtttttgtcatgaaattaaggcatatgaaatagcagaaactctcgtatgaaaattgaaaggaagaaaaaaaagcctttgcagttccttcagaaattgttatgcacctcttctaaagtgaagaacccatcacccacgcaatgaaaacgaagcagtctattaacacgtgattaattaaatattagttattttttaaaaaaattagatcaatataatttttaagcaacttttatatataaactttttattaaaaaaaatacgccgtttagtagtttaaaaagctcgaaaacacgccatttagtagttgtttgaaaagtgcgcgcggaaaataaaaggggagttgggaacaactgttatcaaacacagccttattccccctaagaaagcaaacaggccaaggtccatgatgcgtgcattctacatttgtattgggctggatttcactttataatggaaacttaattatttatcattacacactggtagctcactgttcatacggatcatcatccgagtaaccaaccaacaaatgtacatgagctgatctggaccgtccatcccagcactggggcaagcaaacacaccaccccttattaaccacttaatcacactcacaaacaaccacacacacatagctaatagatattgtagctggaggtcgccggcggcgggtctagtagtcctccggcgccagcggctggtgcgcgccgccgtgcggggcggcgtcggctgacgggatgacgaggtactcgtagagaagcccggcgaggccggcgccgacgaaggggccgagccagtacacccagtggtgcctccagcgccagccgacgagcgccgggccgaacaccctcgccgggttcatcccggcgccgtcgaacgggcccccggcgagcatgttggcgccgaggaggaagccgacggcgagcggcgcgatggtcccgacgtgcccgcgcttcgggtcgatcaccgtcgcgtagtacgcgtacatgagcccgaacgtcatcgtcgcctccagcagcaccgcgtgccagtcccccacccccgacgccagtgcgaaccccggcggccgctgcacgacgtcgccggcgacggcgacgagaaggtatcagagaggaagcttagctagagagagacatcaaggtatatgtacgtaccatgccgccggtggtgaggcggaggaggagggtggcgacgacggcgccgaggagctgggcgagccagtagaagagggcgcggatgagggagaggcggccgccgaggagcgcgccgaaggtgatggccgggttgacgtggccgccggagatgttgacggccaccgccaccgccaccgccagcgccagcgcgtgcgccagcgacaccgccaccagccctcccggcgtgctcatgtcctggtacagcttccctgcacacacacatcgccatgccacatgtcactcccgcgcgccgccgcggctgccatggatggaagaaattatcaagaaacgagtgtgtatgtagtgcgtaccgagggagaggatggagccctcggcggcgaagacgaagatggcggtggcgaggaactcggagatggcggcgcggatggtgtccgggtgcgtcgcgtcctcgctccgccccaccgtgaaccgccgccctggcctcgccgccgccgtgctcatctccacaccgatcactcactctcactactcaccaactctcgccgccgtccggtccgcccaccgccgccgccgccgaagccgcgccttatcctagctagcctcgtctcgatcaccaagtgcgcagtacagttgggggtgtgaagcagctggatctcgtcggccatggccgcgtcgcggtgagcttataacgtggcggagccgggcgcgcgcgcgcgacacgtgtgcatgcgcgcggggcgaagcggtggcacgtctcgccgccgcgacgatgcgtgcgtgagttcgtgttcatctctatcgcggggggagtggggcccacatgacaggtcaccgccacgtcacgcacccacgtacggacgcgccggggagtaggtatcgtctcggcgtctctccttcaagcgatgggcgcatctgatgcatggatgggaggatgcatgggcaacgctgtgctcgcggtcgatgagacaaaatcataaaagagctttgattgatttgatttggaagtgcttaggttcgtcttgtgattaaatgggaaggggttgaagtaatgatgtggatttttggctttaatttggttttattagccggtaaatggatgagttcttttttttttagggggggggggggttgtttgggtgatttgcaagtttagttttgctttaagttgttgattctttcttcttcttcttcttcttcttcttctggtttggagggattagtattgcttaaattggactaaatgacgtggatttagccatcccgtgttgcttaatttttgtctgcgatgttgtgaaatgtcttgtatgagccacatggattgaatctccattctccagcaaggatcacgcatggtttgtatggcttgcactttagtttgttaagattaaagaggatttttataagtggagtgtactcaagctaaagtagttgtacaccttccgtttgaacagacataggcacctctgggtagttgagtttttttcccccagaaaaagtttaacaagactaatgggccaatttaaaaaccgatcaaatcccaatctcaactttacattaagaaaagattaagcctcctttgtaaatgggccaaatcctccttcccaagatgaacttcaaatttgaactagaattctggcccatgccaaacgaggcctaaaatcgacacaaacacagctacaaatggatacaacacttctcccggcaaattctgtgcagagctcaccgcagcgcgagctctcgccccgccgtcgcctccccgtctccggcggcggcggcggagccggcggcgatgtcgtcgatcatcctgacgacgtcgtgcgccttgggccggcgctcggggtcgacggcggcgcagagcagggcgacctcggtgagcctcagcatgtcgccgtggcggccccggtcggcgacgatctccacgtcgaggatgtccgtcgaccactcgtggctcagcgccagccgcgcccactccgccaggtcgccgtcctcgtcgacggggaccttcccggtgaccacctcgagcagcacgaggccgaggcagaacacgtcggcgcgggaggagagccgccgcctcccgcgcgcgagctccgggcacttggccgccgcaaggcggtgcgcgtggtgcggcagcagcgggtggaacccgtggtcagtcagcttggccaccggcaccgcgtcgccgccgccgcctccgcggccgccgggccccgggaagacgacgagcacgttcgacgacttgaggtcgccgtgcggcggccggtggaagagcggcagcgtctggtgcaggtaggccagcccccgcgccacgcccttcgctatcgccaacctcgccggccatggcagcggcgtcctcccctctcctctgttctctgcagcaaaatcgaggatccgatattcctttatttttatatgtctcttaaaaagtcacagaaaattttaaaaaatttagtaagatagatctatacgtgatttatcactccacaacacatgcaaattcaaattcaacttatataaatagaaacaaaaataacaaatttaattatgaatctaacgcgtaattcacgttcaaatttattattattttttaaattgtacaagttaaattttgactcatatatttacgaaaagatatatcataatttttttaaaaaaaattgataattttttaagctgcatacacaaaacgagaggatatcgtcttgaggtaaaaaatcacacacttccaaaaatcgaaactcttcgtcagatcagtcgccatggcagccactactccgatcaagaatggccatggactgaccgtggaggaggtggaagaggctgcggccggggacgtggtcgtagacgacgagcttctcgtccttggagaagtagcaggcgacgacctcgacgacgttctcatggcggagcttgccgaggagctgcatggtgtgggcgaagtccttgcgtggcacgtgccccatgttgcgcagccgcttcacgacgacgacgaccgggccgccgccgccgccgccgccgccgccggcgtggagggcgacgcggtaggtgatccctagccggcccttgccgagcatctccgccgtcgaacggaacagctcgtcgaggctgaaggtcgccttctccggccggaagaactgtagctgatccgccgctcccttgccggactccgtcgtgctccggcttccgttgccgctgccactgctcaccttcttgccggcttgctccgccgccttgtccttgatgtcacctgccactggtcacgtcgccgtcaatgactcgtcgagaagaaagcggcggcgagcgaagtggagtgggttttgtggcgtgcttacctgcggtggcggcggcggcggcgcgaccgccgccgagacgaaccacccggctcttcttgctgtggtggaggaagatgagcaccgcggcgaacggcaccagcgcggcgatgagcgcgatcaccacgacgctccacctcgctatcctgaaccggatgggcttgcgccaccgcgccggcggcgcggcggcgtcgcgcgccccgaagacccgatcaccaccatcgctgccgctgccgccgccgccggccggcgcggcgtcgaatggcgagccctcgcggcggcactccgtcctcacaacctcgccgcagagcctgaggttgtgggcgaacgcggtggcggggaaccggcggagcgcgcgggtgtcgggcacctcgccctggaggaagttgtacgacacgttgaacacggcgagcccgtcctgctcgaacgccggcagcgtgccattgatcaggttgtcctggagctcgagccgcgtgagctcacccagcgccgccgcgtacccgcgcgggatgggccccgagaaccggttgctcgacaggtccacgacgcggagccgcgccagcgcgtcgagccgcgggagcgcgccgtggatggcgttgtcgcgcagggacagcgtctccagccgcgccacgccggcgagcgcccccgcggggagcgcgcccgtgagctgcgcgccgtcgagctgcacgccgaccacccgcccgtcgccgtcgcacgccacgccgtaccaccggctccgcccgccgtggcacggcggccccgtccagttcgagtgcaggtccctccccgaccgcagcgcgtcccgcagcgccaccagcccgccccgctcgtcgcgcaacgcctccagctccggctctggccaccccacaccctccaccaccgccgccatcgccgccgcaagaatcaccaccaccaccatcaccacccaaacccatgtcgtctcacaccttgtcccgatcatggcggcgttcttgaagccctaaaccacgtcaagaaacaccataataaacaaatggatcccaacaatggcgggacgatgcttgccgggaggagaagaagaagaatgcgacggcgaggggagaggcgggaggaggaagaaaccatgataagaatacatggagggaggaggagtgagatttggtggtatgaggctacggattaggtggtggattcgacgtgaacatctcgatggatcgatcggcggtttggtcgcggttgcattgacgacggctcaaccgatagccttggagaagaagggtgagactcggaagagttgcaaagaaactgaagtgctcagttgggtgaagcttccaactctttcacctatatttccacatgagatgtgtggtcatgcaaattgttttgagatatatagcacatgagaggtttggtgcttgctgatgattcatcagtttgttcaattctcgtttccttttactattatttttaatttatgatccaaaaatatatggttttgcactattaatttctagattcaaaacgtaggttgtgtgccgtatggcagaggatgtggatataaaacattaattttcaattatatttacaaaatgtattttgcaattttttaaagaacttttcgtgactatttggttttttattcttaattgagttaacaattgagaacctgttcgtttcttctaaggctagaggataaaattttgcatacttgtggcacgtttttcaaactgctaaacagtgtgtttcgtgcaaaaactttctatataaaagttgttctaaaatatcatattgatccattttcaagtttgtaataactaacactcaattaatcacatgttattactatctcgttttatgtaaaacacttaatatttatcttcagaagattcaaacaccacctaaagctgaattttggagtaatcatgatgttttaaactaaggatttaagaaaacattaaaggtttgatcgaattttatcctacaacattaaatatttctgaccagatggtgatttttaggtacaattcacaactattcggttggtgatccttggttgagttaacacttgaagctgaatctagactactactaatcaggatattcaacttgggtgcaactccccaactgatcctgcagctctgcaccaaccgtaggatggcagttgcaggacaatcggacggccgcgaccacgccacgtggcgaccgatggagtgacgatcacgttgggaggttacggtacgctttgctctccccacaagccatcaccgtaacatggaagccaactcatactttggtagcagtagtagttagcagtagctggctggataagcagagatatcagaagaggtccaaaagaattcagagacattcagacaacacacaggctttatctttcacatctttatcttttcttttctctttctcactatcttttcatccctttcgggttccggagaagcatcagggatcaggggaagggtgtgtgtgtgattagtgtggggtgttcagaggctaaacccagtgtgtgtgaagattattagggcgtagatcgctgtctgatcttgtgtattgcgattttgcggcgagtcttttgagatggcgagatcgtgcttgaaagcgctggaggtttgcctgcaggatgttgcacttgcattagttgcatcctcgtgtcaggtcccagaatgactactactagaagctttggtgctgaattatttggaggctaacatgtggattctgacttaagaatcctgaagccgctgccttcgcatctgtaggagtactggtccgttccaaaaaaaatctaatcctaacaataaatctggatacacatgtgtctaggttctaggattaggttaggattaggttttttagacggaggggatatttcagttgaaggatatgcagccatgcaggtgtttcatacttgcattataatgtcagaagttagaggtcagaattggctaatgcttactacctccgtcccaaactaatagtcgcttcgaccttttcttgtaacgtttgactattcgtcttatttaaaaaattagtgcaaatataaaaatatagaagtcatacttaaagtacttttgataataaagcaaatcacaaacaaaataaataataattctataatttttttaataagacgaaagatcaaaagttaaaaaaaaaaaacttaaagcgacgagtattctgggacggaggcagtaataagtatgggctacgatggttttagctatattactgatgagttgtgaaacaaatgaacaaatctaacttatgggtaaaactttcgtatctaagttgcgatggttcaaaaaccgaggcatctcatgtaaaaaatagaccaatatactccctccatttcaggttataagatatttgatttttaaaagtcaaactgtttcaagtttgactaagtttatagacaaatatagtaatatttatagtactaaattagttttatcaaataaataattaaatatattttcataataaatttgtgttgggttgaaaatgctattactttttttctacaaacttagtcaaatttaaagttgtttgactttgacgaaagtcaaaacgcgtcttataacctgaaacgagagaagtataaattactgcaatattaaattttaaaatccagatttaagggccagtttggattgctaaaattttggtagagtagcacatcaaacatctctattaaaatactgcttatgccacaaaattgactttgcccatatacttgtctcttataggcatattttgacttcaatacaaatgagtatttttaactctaccctaccaaaattttggtagtgccaaaacttacctaagatttagcactactaaaattttggtaggacattaatccaaacatgcactaaccttcaaaactaaaatttaagatttagattttggctacggctaataatctaataagcatacatatacttgcctgccaagatggtaaattgatgtctttgtgattgacacatgttgatggttatatttgatggatcgggcgttgtaagtgcttgcatttataatatgtttctaaaaaaacatattttattcatagtaattataatactggtggtagaacaccgtcattagatacggtcttaaaaccattggacgcatgtacagttatgcaacatcaaatctgatatataatttacgagggctgctataaaacagaatccgttacaatgggatagacatattaattattctctcacacgaatatcacaggtatcaggtcctagtaatcacaggtaccgaataacaggtatcagaggtatcgagtaccatgcaactgttaccatacacaggtatcaggtatcttatctaggttttctgatgatttataattccatcaaggactacatgattttgttttccatattattaccagtatcatatggtagcatggtcagtacattttgcaacactgatacacagtggcggatctcagacatattctgtggggtcgtctgatcccacagttttttagaaaacacttgattttcatgtataaatttaaaatgtttaaataaatgaccctaattaaatacaaactaattgacctcacgggattaaattcctaactccaccactggtgacagcctgacacaaacactacaatttgtcagttgaactgaattttttcccctttttagaagcatgaaaagagactgactggccaccataatatttcaacgacacagatagcacataatcacatgaaaaatggagagatactgcagatactctaaattctgaaaacgacttgaattttcagagtgtatatatcggagcaagaacaaagcagagaaaaatcacaaaaatcaaaacgctaccacagccacactctcacacacacatatatccgatcgatttggcgccaattgcgagacgcacacacgttagaacccaaatcctccctgggcctcgagttccaaatccccaaatccattttctgaaccagtaaaatttcaaaaccacccaatttgagacaaattcctcaaaaattcagaaatcacaaaaccacacactgacccatcaaaccgggaggaggctttagccgtttaagtcctctcgcgcgccgtcgccgccgcgctcgccacgccacgccacgccacgccgcgcgcgcgcacagcaatggagctctcgcttgcctccgcgaagccctcgcctagcgccgccgccgccgacgcggaggcggtggcggcatcgtcgtcgctgctgtcgctgcgggggaagaggaggagggtggg

SEQ ID NO: 14324 - DNA, 13857 bp, Oryza sativa
gagggagctggcgggggtgcagccgctggtgaaggcgctgccgccggtggcgaggccggtggtgaagctgccggtggtggccgcggcggcggcggcggggtacgtggtcgggctccgcgcggggggcacgcggaccacggcggtggcgggcgcggcggcgctcggggcggtcagcgtcgcgggcgccgcggcggtgaactccgccgtgcccggggtcgccgcggcggggctgcacaactacgtcgccggctccgacgaccccaccaagctggagagcagcgaggtggaggccatcgcgagcaagtgagtgttggatttgcagattgctcgtctatacttgctgcatttggttgtgtgattttttatttttactcgtttacttctgaaactcccatttgctgttagaatgctagtaaaattttgttctagcttgtttatgcaaattgaacaacctataattatcaggaggaggaggatttttttttttttactaatgcgagctaaaaattctgtttataaaatgagatgcatattgccatacctataaaattaaaattagaattcatatattgaatgtatctctcttactccgtcaaatgatccttttactatcaattatttttagatacggcgttagcacagaggatgcaaccttcaaggccgagctctgtgatttgtatggcaggtatgtatgtttccttctagaaatcaatcttaaacatgtcctgtttttagttcagatccttttttttttggtcttgtagtatataagcatttgctcatcttgttctcatgtccattttattccaggtttgttttctcattaattcatccaggatatgaagaccttgaaggtactgaagttgagactattataaagtttaaaaaggcccttgggttgaatgatatagatgctgcaaatgtgcacatggaggtagtgccccaagatctaggcccttttatttctaactgtctgcctcagatatttcttctactttagtcttcattttcacatttccacagttttcccttcctcctcacttctttcattgcgcttgttgtaatagattgctaaacgcattgatcgcaatgctggtgtaggacaacagcaggtacgtggttgtgctgtgatatatacatgggtactttgaattttctattgatccgatgataaccattttaaatatttggcaggcatttgaaaagcttatatttgtaacaaatcttgtgtttcgggatgcatatgaatacctacttccatggaaacgtcttttcggggttcatgaatctcaggtacttaattaaaataatcatcattcgtttaaaccgtgcatatcatctctttgtttcatgatctcgtcatatggagaaagcaggggatcattagagagttttaatcatctatgctggtatttgaagtctagttgcacaaattctctgacattgttaccactgcaattcttaaaggcctctagcatgttgagtaatctctttgcataatgttgtactattgtgctgttctcagtgtaatggttgttgggttatggctttggccgaaagcctacactgtcaaggtcagcatcaggtcacatgtattggcaaataatattctccacttaatcccaaaaaatgcaacttagagcattgctcttgccactgtaacattattagcaattaaatgcaaattttataacaatatggaagtctgaattatgacaattactccaatattattttcttgtggttaatttcaatatctacaatttgtaaagttatcagctataactatgaaaaaaaaatacatggcccactgtggcatgctggatatggtgcatgtaatattatgtgatacaacttttatccccacccccccccccacccccaaaaaaaaaataataatgctcaacattttgcatgctggatagaaccaaaaaagaaaggatgtgcatgcgataaatttgaaagttatttataatttgtcctggcttggtcaaggtgcaaaattttgaattgcatgggcacaaaatgattttcgagttttatactggagatgtacttgaaaggggagacctctcttgggggaaaactttgttcttgccactagaaaagtatgctgttttttgccatcaaaattacaccatttcatttttgctttccaaaattttgcgcttatctaattttttccatcatcatcaaaccctgctagttgaccattactactgtagtactatggcgtttgactttcacatattttcttactaagaccaaaatgcctctatcaaattgtgtgcccaatttgtcagcctttacctctcttttgatgccctttctcaccatttctctcgaagggttggaactttcagtaaaaaaattcagagtgcaccaaaataaccaaaactacagacttctaaaagcttaggtgcttttatctacaaatttacaaataatttattttttatcaagattttagacgaattgaattattgaatgattttcatcaatttgaatgagtcagtattttttagtgtgacaatttcaacaaattaaaatttggtattgttttttgaaatattaaatgaataacaccaaatttggatgaaggggtgtgttcatgtgatggcaggaacttcatctgactataacgcctctttgtcaattatgtcggtgcgagatagaagtttgactaagactttggttagctgtattggcaaaacaatacacacaaagatggtgcagacgaaataaggaattaattttgtgtcaaatacaaaaaccggtgcttgcttattactggcattagttagtagcctatgcaaactttgtagtggcatgaacaaaatttccttatcagcaatgagtatgcagattgcctgcaagctgtacaaaatgcgcattcacatatttctcatgtgcttttgttcatattttagtgcatagcttcttttgggtttatatcttgtttgatgataagattttatttagttacattattgttgttttcggcagatagacgatgttatgagggaaagtgccaagagtttatatgcatcattgctcaagtctattgggagaggtactgagacacttatatttctctttttaaggcattagttccatccataactgtcattatgtatactagattcactgttacagagtatttatgtctgaacagagacttggagcagtgcagaactgcagatagcaatgttatctcctgcttgtataattatacttgatagactatttactgcatttctacagaaatctcaactcaacatattctgtttctctaggtcttgacataggcacattaattgaagtaaggagatcacaactagcatataaactttctgatgaggtaacacttttcctctgaaaattttactgcttatttgcttttccccattttttcgttcattttgataaatacttgggaaaataccacttatatctaagtgtgcacgcttgccaagatgtcagactctggcgtttggacaacaaaaaagttttctatatttgattattcacataaatcttaaatatgatatgtaagatgaatggaattcatataggcatactacgttgttaagcggcatattctattatttaaatttattgcagattgcttctgagatgttcagggagcatgcaaagaagttagttgaagaaaacatttcaacagccttgaacaacttgtaagtcgtgtaccaaagcaacgtatgaaatgcacttttggacaacttgtccatgtgaatatagattcactacatttcataacatgaatggatttggcttcataaaccatatctttacaggaataaccgaacacaggttgttgaagaagtgaaaagcatcctttcatttaatggtatgcttacagtactgagcaatttcccgggagaagaaagatttgtccgcgggcttgggcctattacattaggtagagtggtaaagtatttcgaaattcatgtgttaatgaggtggcccttttctaatgctggctcctgtgctttgctttgcacaggtggagacagtgatcatgaaaagagggtagaggatctaaagatgctctatagtgcctatgcaatggaggtactttcagatggacatcttaacgatgacaaggtgatttcatgtataataccatcttttcagtttactggtgctgcttatgagatgccaagctgaaatgaggctgccggatggcaaattcaattaaccatctgcgttgaaacataacattgcaatttcaccgacccttaaaacatagcagcagttgagacagtctggccttcgcaattgtgaattatgtcaagcattagttcagtggcttgaatctactagcacatggatactagtctggtcttaacttggttcagctcagatctacgttatttgttgaaaatcggtgatcagtatctagatggagattctcatgatagagcccagatcattttactggtccagctttgtgagaatgccaaagacagagttcaatacactttacccagttgattgtgaaataacaagtactgtaaacacttgtaaataatgcagtcaatccggaccaagattgcttgagcacataccatcaacattttgttttttctgttgatctgcttatacttaggtgcatgcatgctttatgacagctgcgtctaacaatttgttctaccttggtagcatgatatcatattaaccgaatcctttacatgattatggtaatgcagcttgcggctttgaatcaactgaggaatatatttggactggcgaagtacgaagcagaagcaatcatcacagatgtcaaggctcgagtatttcagacctactaaattctttaacaatgagttggctgcgaccccaaagaaggcagagttcctccaagatatctgcgaagagttgcaatttgatcctctcaacttgcaagtaagatgcatgaaggtgccatcctgacaccttcccttgttccaccactagtttcacaacgtagctgccctgaccgccttgaaatctgggcaaattgagaactgggtttctcttggtggctctatctatatatatggtacttagagaaaataacattataatattgcaggccctattccttttcaatatctgcttatactatgtgtaaatacactctaatataataatattataataattagaggcctctattcccctctggctggcttttgtatttagaggactgagagaactgggacagtactcactgattgttcatatttatgtattagttcatgtgttgtgtatactgtatacatagacatatttggttgtttttgggagtgtacatatctgaaattggtagcaatttttcatgcgatgtggtagaagatatactagttgagaatggcagctggaagaactggaatctgcatggaaattggttcagtttcaggctttcagcagcacaatacagacattcagtttgcacttgttcctgtttgggttatgtaatctgaagaaaggaagatggataattgatcatatagtactttgttccggtctgtatgagagtgtatgcatgtatgcttttgttgctgacagttcacttgtgcaagcctcagcatttcttgcttgtaacacatgataatcacaatggtatggaatgtgtgtgttcaaagaacttaatggttgaactgctgggatttgttggtggcaatgattaggaatgaatcagcaacagagagaggacaaatatggttggaccaaaagtactattgtcccttatggctctcatcgtctcacctatttcaaagaattcagttaggaataataatactccctctgttactaaacatttgacgccgttgatttttttaaacatgtttgaccgttcgtcttattcaaaaattttaagtaattattaattcttttccatcatttgattcattgttaaatatactactactactcaagttttttaataatattcacaaatgtttttgaataagacgaacggtcaaatatgtttaaaaaagttaacggtgtcaaatatttagggatggagggagtaactaataagaggtcacagtaactatggatttagttttttcctctttgaaaataaaattgccctgggatttgttggtagccttcgtctcttgagcttatgctatacatgttcgtacatccatgcgtgtattgtgttttccttgttatataaaaaggggaatacctatatgacattccctagaaaataaccccgaaatatttcaaattctggaccgttggatcactttgaaatttgtacaactattctcaaccctaatctaccttctctccctccctaatgttgagttattatctatactttcccaactcaccccctcgttttccctaatgccgaaaggcgccactggtgcaggtgagcccacccccaaccgacctcctcctccctcccctctttttcccaagatggcggtggcgagtgcccctaccctgcaatcttccctgtctcttacggctccccatcactactggccatcacttcctaatcacaagcttcgctttgcccctaccggcaacgctgacctaccttccttcccatttccgtggctttggtgtttttgttggtgcctcgttgttcatgtccaccgtctatcgtcggggcgccaactcccatagccatccctctaagtccggtgatcttccatctctttctccttccccatctccaacccatgccaaccctaacccaagaccttaaatcctaactagttggatcaccatcgatcgctgtaacaggaggagttagggttgttggaacacaaattgtgaaatactccctccatctacttttgatagtcatatttctaaatctgaaaaatttatttttgataggcatatttcaatccaacaatctatccttgaatttctcgaatttaatgcgtgactctccatttttccacacaagattggctacagggacaccgagaaatgtaaatactaatgaatcgcttgtatacgaaaaatgactagtagcatgtttgaatgtatgataagtagaattacttattcttggtctgtgtgtcaagatgaaatatgactatcaaaaatagatggagagagtaaatcttaaggtctgaattttgcaatattggagtcctaatttttcgtcggatgtgatctgccaattttcacggagaatactaccttaatataaaaatatagcaatctttgtatagttgattatggaagtcataaatatattgaaatactcaagacctcaggatctgagtattgtcaactgatgaagaacatggagagcatgaagtcacgacctgagtttagggtcgcagcttagacccacaccaccacccatcaataattccactcccctcctaaactccccacttcccccagcattcacgccgaccgagtcaccgacacaaacgcgcaataatatgtcctcacctcgacccaaaaatcgagaaaaatcaccccaaaacagaacactgtagcatcacattactactatcacacatcactagaaaacaatccaaaccacaattgcagcaacactattaccactaacagcgatcatacactactattaaactaaaaagagaaaaaaaaacactaacagcgatgcaaatgcaagagaagctgccatctccttcctgaaaagtcgtgcttaattagtgggacgggtgacgagcaaatcactccaaaccttgcttctcctcctcctcctcctcctcccccatctccggcgccgcgcgccgccgcccggaggagagcttctcgccggtgctgctactgctactaatccccacacccacctgctctcagctcagctcagctcagcttcccagctcggcgaagaagatgaagacgaggagctcggggaggggaggaggggagccgaggaggaggctgaggaatgcggctgtcatggcgctcatgctctcctccctcgtcgctctctccctcgtccgcgccaggttctcccccatcggtaatcgaatcgaatccccccatcctcctcctcttcgccgcttaattgttttttgttggatgctgctatggtggcgaggagaaggcgagagctgattcggagttcttctcccttccttcgcagctagtgatggaggcgaggccctcaagctcaaggccgacgaatccaagctcgtcgtcaccaccaatcacgccgtcgtcaacaccgaatccggcgactcctcctcctcctcgtcgtcggcggctggtaattacgagatgcgtttcttggatcttgagcggcgcagtgcagcgcattgcttggctgattcgttcttggcgatttcatttcgtatccgttttttcgattcgagtttagttcaaacgaggactagaggagaggaagaaaaagaggaaaaggaatcgaagaatccatgaattccactggctgtttaataactaagaagaaattgaatttgtttttttttttgcgagttgttgtcctagttcataatttatttcttgggctttttgcggagtttttgcgctaaagaatggcgtggattcggctgcgagattccgcgaccacagatctaattaaaaccgattctcctcgtgttgctgcagcggaggaggaggaggaggtcgccgctccggcgaagcccgccgccgccggcggcggcggggccaggccggtgtgctacgagacgagccgccgctccgacacctgcgaggccgccggcgacgtgcgcgtggtggggggcagccagaccgtctacgccgacacgcttgaccgcgagtggaagacgaagccctactgccgtaagcacgacgcgttcgcgctgtcccacgtcaaggagtggacgctcaggccgctcccctccggcgatggcggtggcggtggcgcggcggtggcgccgaggtgcacgacgaacagcacggccacggcgttcgtgctgtcgaccggcgggttcacggggaacccgttccacgactacaccgacgtgctcatcccggcgttcatcaccgcgcaccggttcggcggcgaggtgcagttcctggtgagcagctacaagtcgtggtggatgaacaagtacatccagatcttccagcagatgagccggcacgacgtggtggacgtcgacgctgacggcgacgaggtgaggtgctaccggagcgcggtggtcgggccggagttccacagggagctcggcgtcgacccaaccaagacgccgtcgggctactcggtgctcgacttccgcaagatgctccgcggcgcgttcgggctggaccgcgccacagcgacgccgagcggcgaccggtgggacatccgccgccgaccccgcctcctgatcatctcccgccgcgccgcccgtggccgcgcgttcatgaacgagcgcgccatggcggacatggcggcgagcctgggcttcgacgtgcgtgtcggggagcccgacgcgtccacggacacctccaagtttgctcgcctcgtcaactcctgcgatgtcatggtgggagtgcacggcgccgggctcaccaacatggtgttcctacccgccggcgccgtgctggtgcaggtggtgccatacggcaagctggagtggctggcccggaacaccttcgctgagccgtcgtccgccatggagatccactacctggagtacgccgtgcagcttgacgagacaacgctgagcgagcagtaccccgccgatcacccagtgctgcgagaccctatggccatccacaagcaaggctgggaagctctcaagaccacttacctcgacaagcagaatgtccggccgcatctcggccgcctcaagaacaccttcctccaggccctcaagctgctgccccatgacaaggaaaccatgaattagcttagctcatcagaactgttgatcgtcatggattgtcatcggcaccgtcatcgccatcgccatgccatcgtcatggtgacttgaatttgtggtataaatagatagataggtagctaattttttttcttttttcaaaattattagtattttgtattgatccctagcaagttgccaagatcaggtataatcagtagcttatctgaaataatccgttgcaacgcacgggtatttggcaatgtctatagaaacaatggtgatattgtttgtatgcaccatatttcttaacatatcaagtaagccaaattatcttatactagcagaaacccatattttcatggatttcttccaaaatgtcttctcctggcatatgtgtggttcatgatcattattttgcattggttagtcaaggttgatggcctgttctgtgttagtgatgtttttgcaattgtcaggacttctcaggttgtcatcaaggaagcaatttgcatgtgtttgatgaatagtatgacactaatagacaacatgttgatgtgaaggcagcacatggtctgaagaacctgaacagggaaggtgtcatggccatcatcttcagtaaactcaccaaattattgctgagaggcagcttatttcttattttcagtatactcctactaactttgaatcaagtttatttctgtattgccagatccaaagaaagctgtatcaggagaatgcaatggtctcccttaacactgttgttaagtgagcttttcgctgacattaaagaagaaccagcagctgctgacactgaaactgagactgagacatcaagtgcaacatcagaaattaatcaatgagatgatgatagatctgaatgggaacgactggagacattagacattaaggaaaacaaggcatatggtaaaagtgatgctggaaaaggttcaagccagaaaagagagaagacttgtgcatgagcatcaactactactcctatgtgagagtagtataaatggagacaagagagacagaggtgagctgtatgaacatcctgatgttctgcatcactgtagagacaactgaatccgaatgatgtttcgttttggatctgcaatccccacaaagaatgacagttcagagtcttcaatgcgagtaagcgaaagatgttgtcattgaaggcatttgtgcaagagtatgggaaacattggaaagagcaccgaaacccatccagcgagataatatatacattccagaattgcaatttagcgcacgtacgttgccagttcaatattttcagatgaaagtttcgtattttgaattgaagtttttgtaattcaaaaaaaataaagttttaaggtcacagtcgaaagttttgtatggtttgagttaaaagttgcactgtttgagttgaaaaattcttgtgaaagtacaggtgtatgttagaaacacatgttcggtaattagcaatccatttctctctgattatggattaattctttgtacttccgtcttgtagttatattgtttctatgctagttttgtcatccccacctatctaacaagtagtggccactatctaccttgtatgtgtccatcattgatgaccaacactgtactggaatgagaagctatgtttgtttcatgcacaccatacaacacaccgtttatcctaccatcattgatcagagcttgagagtgatgatttagttttaatcagtccatctaatataattatgctagtattaagaaaaagaaggcctcccctattgtttccagtaaaaaagtaataataaaaataaaaagcaaaacctatacattcatgcattcagctacccctagaggccttgtttgatactccgtttcatattataaatcatttgactttttttaagtcaaaactctttagatttaaccaagtttataaaaaaactagcaacatctataaggccatccccaacccagaaactatccagtagtttccatacttaccatgtcatatagatactatgtatagaaactatatatctaatggatagtatcttcaaattaaattctcatctaattatctcccttctctctccttttatccacctatccttttgtcttcattcttagttagatggtttttttcatgataaatggtttcttcgtacttttatctctctccttattaactctattgccacgtcagatttttacttatatgttaatgtatttaacaataaattagtttcattaaatttaacatttaatatattttgataatatatattttttattaaaattgttactatagtttttttacaaacttaccaaatttaaagaagtttgaaaaaaaaatcaaacgacatgtaatattaaatggatggagtaatgcctaaacctcggcccatttatgggatagatggaccgggcccaatgatcggtaggccgctgcagctgcaagtgcagcagcaagacaaccggacggcggcgatgcagccgtcggcgagttggctgggtaacccaaactcccaaagtgtagcgtgagagaatcagagagagtaacagacgttggctttatcttttttctttctttctttctttctttcttcattctttttctccttttcctttttcaataaatccaatctgttccttggtttggaggctcaagaaagcatcatgctttgcgaagactgctgctgcgtgtgtcttgagcctcaagacgtcctctcccaacaccattagctggctgccaaagtgccaagtgattgggtgatgtgtgtattaaccatattttcttcaatgaaatgtagcaatcactatgggcaacaatatgaggcatgcttttactcgcaaaccaaataatctccaacgatatgaattttatctttgttataacaaaagcactaaaaattgtgcttacatttgtgcatagtgttatatatttaagtatttaatgcaacacttgtaaagtgatagtaataaaatatatggagtataaaattacaaatcatctcttctaggtagtaggaaaaatagggtcacttcaggagtggagaaaagcttgacggatgaccacaaaatcacagaaatatcgcaatcacatgaaatgtgttatggacacttataatagacatcgaaaatgacttctgagaacaaaacaaattgtagaaaagcaatgctatgcacgacatctatatatatacatcccattcaacatcgtgtgtgagaggtcataattgcgagcctaatttttctattaaatttcacatcttttaaccaaatgtttcaaatactactgtaacatttgaatgttgagaatgacgtgtaataagtagccatcatatgaatgattgctcatgtacgacataggataaactcatctaacatacgtctaattgtgatcgaaataaaccccatatacaatacgtatttaccactatttatctctcctagaaatcaccatattattcacaggccaccatttatagatgtgcaagctaaactctctctcaccaccaccacctccgtcgttcccgcttgtccctccagatgcgttattgtttacatattatttttcatctcgtatgatgaatttactttcacactattatatttttctcacccttaatgactttattgtagagattgacagtatgtaaccttctgctcccctttgttttcaccgtagtctaacaagctagtgcccaatattgacaatcataattacctccttctaagaagaagaagataatcgcataaaacaaccatcaatacaattttagaagtataagtaaccgagtaatcctgactaggagtttggtttcgtggtcttattggtggaaaacatcacacacctcctctctctctctctctcgtatttcttttagtgtgtctcacgtgtcttttggggtgactcccatgtattcactctatttattccgtgtaagttcatttgatgtaatatatttatgtgagcaattcattcctcggtgatccgtctaaaaaatactccctccgtttcaggttataagactttctagcattgccc

SEQ ID NO: 14325 - DNA, 6215 bp, Oryza sativa
agctgccgggggtgcagccgctggtgaaggcgctgccgcccgcggcgaggacggcggcggagctggcggtgtccgcggcgccggtggcggcggggtacggcatcgggctccgcgcgggtggggggtctagggccgtggcggtcgcgggcaccgcggtgctcggggcggccagcgtcgccggggccgccgcggtgaactccgtcgtgccggaggtcgccgccgtcgggctgcacaactacgtcgccggatgcgacgaccccaccaagctggagagcggcgaggtgaaggccctcgcgaccaagtgagtcgtctcgattgctcgactatattgtaggtgtgctgcattggccgtatggcccgtatgctcgattcgattatatatcagatgtcttgactcccaccctgcaatgtgatctgtattttccttccaatttatgcgccctcctagcatttactcattaattttgaagctcccatttgttttcggaatgctagtaaaattttggtgtagcttgtttcagcgaataaggacccaataataatttcgatgatacatctgatcggctaaaattacctttagggatgggacatatagttatatttttgcactaaaatgtttaaggaaaaggctatacgtactacatttttattattaaactctctttacactaatgtgtcatgttatgagttcatctacatttcctataactcctatctagttgaatcaaacagttgatatcattttgtgtaagaatttttaagtatgtgcatcagtgctcaatgtaacattgcccccacccacacacacagaagcaaaaagtcttacctgtttattttgtttcatatatggagttagtacacaggacgcagccttcaaagcagagctctgtgatttgtatgccaggtgatcctcttggcacctgttgtccagttgtttccaatgctttatttgaatgttggtaaagaatgtccatccggaaatggcctctaagcctaactgtatttatgacactaattctgttgtgttctatgtgttgaatttggctcaagtgcccttattatagctattgttttctcctagacacaagtatttgttcttggatgtttcccctctcttctcttaatattcacccgtcccaaagtatggtgttattttgcagtttttagttgtcgatatgcaatttgagcttcaaccattacatccagtaatttatattattatataccttgaaatatacaaagaacagctaaaatattacgtaaaataatatttactaatatcatttttattgccaatctatcaatgcggacatctcgatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgcccgggcaccatggtgccccatatgagtgtcctatatatagtatatatatatattttgttccaatcacatttcacataccacagttttgtatgtatgtgctcagacgtagttgcttcttttggcaagctcttgtacattactcagtagctaaactagattcttctaaaatcaatctttaaaaatctaccatttattggttgcatcttattgttttggtcatgcagtgtatataggaagtgtctttgctccatcttacctccattttatttccaggtttctttactcagtacttcctccaggagatgaagatctcaaaggtgatgaggttcagaccattataaaatttaaaaatgctcttgggctcgatgatgtagatgctgcaaatatgcacatggaggtattgcctcatgatccaagcccctttatatcttacttgcctgagacgttcttcctactttagtgccattttcacatttcctccattactccttatgccttcgactttgcttgtatagattggtaggcgcatatacagagaaaggctggaaacaagggaccgggatgccgacatggaacagcggcgggtacgtttttgtgctgtgatacataaatggatgtttaaaactttctactgcccctgatgataactattgtaaatattttgcaggcatttcaaaaactcatatatgtatcaaatcttgtctttggggatgcatcaacattcctgcttccatggaaacgtctttttggggtcactgattctcaggtattttattatgaaatagtcatcacccatttaaactgtgcatagcatgtcggcattttctgatttcaccccatggagaaagcagatggcaaccttagacaatattctaattatttgtgttgattttgaattttagatgcaccacttccctaacataacattattgcaactgtgactacgaaggatctctagtgtgctgtacaacctctttgcattgttttgtgcagttctagatgcaatggttgggctagttggcttgcctgtatttttacactagatgcaatggttgggctagttggtttgcctgtattcattataatggattgcaaatttcatgctctagttatagagtactgaaaaaaaaaggcaggttgtacatgtcatatcaaattgacattcctttttcccctagcatggtcaacatgcataatttttactagcatgggtatcatagagtctcagactggagtgttgttgaaattaaagaccttttctgttgatagggttgaggatgcggattgcctacaagctctagtgcattcacatatctcgtctatcttaggacatatttcagaaattgaactgcttgtttaagccttattacttgtgctcatagcttctttgttttcgttcctttttatttggtgatattgtttggtgacactaccatgttcttcttgcagattgatattgctatgcgggaaaatgccaaaatcttatatgcatcacaactcaagtctattgggagaggtatcactgaaatgcatatctttgtatttgtaggcaccccacatccgtatttgttatgcttacaagcttcagtgtaattatgtcagattagagacttagggcagtgcatatagtgatgctatcttattttttgatacactaattacttgatcggccttattgcatttgtacaacatttttaattttgacattctgttttctctaggtcttgacataggcacgcttatcgaagtaaggagagcacaacttgcatacaaactttctgatgaggtactgttttttctttctcgcaattcttctacttcatttggtcttacatcttaatataaatacctggggaaattacttagctaagcatgcatggctgctcagagtcgtgtactggagactagacaagttactgtattttgtttgtggacataaatctcagtatgccaggataagaaatgtggtatcaatctaagcattatatgttactaaatagcatattgtaatgtttaaattccttcagattgctgctgagatgttcaaggagcatgcaaagaagttggttcaagaaaacatttcgtcagctttggacatcgtaaagtcgcgtaccaaagcagcgtaaggaatctacacctctatggtgaattgtctaagcctacggattgattgccgttgacagttgacataagagcctgagctaacacctatttcctcttttcccaaatacattttgtttcaaactttgtttcatatacatgttgcagctttaaattgaactttttacccattttcccttaggttgattgataagtattatgtacttacaaatttacagtttattatttcatggcatgaatggatttttacctcactcctaaactatatgattacaggaatagcccaacacaggttattgaagatgtgaagagcatccttgcttttaatagcttgctcataacactaagcaaacaccctgatcaagatagatttattcgtggtcttggacctatttcgttaggtacggtgatatatctttttgaaatcatatgttaatcaggtaggactttctcttaaggctggtcgttgtgcttttcttgtataggtggagagagtgatcatgataggagggctgatgatctcaagctactatatagggcctatgcaacagaagtactatcagatggacatctggatgatgagaaggtgattccatgcatcctcttgttataatcccactttattgctaaacatcttgatgtaagtacaccggtgctgctttggaatgctgccaatcaatggtggcaaacctaactcatttaactctgcagtctagatcctgtaccttgtactgttattcctgatgccactggaactgctgtttacggcagtacttataaatggtgttttagttggaacataacatatcctgaatgcacgaaaaacagtctgccacctgttgttaaaaactaggagaagattaattgtgcatctatttagtgtatcaagatcttagcaaaagccagtattgttaacccttgaaaagcagagcaagaagctgatccgagacaatctggttcttgccataaccgaagtgtcatttggaaaaagcataataaaccattcttattgccagatgacagttgtgaattatgtaacattggttcagtgtcttcaatctacatggacactactctcctgtatcgtcaacttggttcagatcacttcttgaaaattgttggtctaagtactcaacaaaaattctcatggtgagactgattaactatacccagttggttgtgtaataacatgtgctacctctatcccaaaatacaaggagttttagggttggacatgggtattaagaaagttggtgaaattagttggagaagttgttatattttgggacaaattttgaaggctagaagttatattttgggttggaggtgttccattattgttctgtaaatggtactagcaagtactccctccatattttaatgtatgacaccgttgactttttaaccaacgtttgaccactcgtcttattcaaaaattttatgcaaatataaaaatacttatgtcatgcttaaagaacatttgatgataaatcaagtcacaatacaataaattataattacataatttttttaaataagacgaaaggtcaaatgtttgtcaaaaagtcaacggcgtcatacattaaaatatggagagagtatatccttgctgttcaaatttggttgttattagttcatcttatatttggtgcatggattatgacccctgaatctaagtttataaggtatcaagatagcatcttaatagaagccttttaatctgattacaataattcagctcgctcctttgaatcaactgaggaatatatttggactgggcaagcgtgaagcagaatcaatcatgtcagatgtcaaagctcaagtatacagaaagagacttgctaaatcatttaatagtgagttggctgcggcccctagcaaagcagcattcctccaaaatatctgtgaagagttacagtttgatccggaacttgctagtaagatgcatgaaggtaccttcttgacaccttctcttgttacactataattttcacagcatacctgtgcttagctcgactgcctagtcatttattgaacggagaactggttttcacctgatggctctgtgcagaaaatcactatacaccatcagctctatgttgacactgctgaattgttatcctagaccgtatgtaggaagtacatctgtagcaattcagttgtctgcattttggttcatctgggctgtattgcttctcatgattaggaatggatatccaatagaaaagaaataagacaaatgtggtgggactagaagtactatttgtctctatgttcatgttaaacagcattactatttgtaagataagatattcctcaccattccatcttaaggtacatcatcacatgctttaataaagcatcaaagtcccagaaatgctatcgacaagtgtgag

SEQ ID NO: 14326 - DNA, 20003 bp, Oryza sativa
ctcacacttgttgatggcatttctgggatttggatgcttgtcaatggcatttcttggattatctctattaaatattagttggcaaacatgcttttttcgagatgttctctcctggttgctttccttgatatattgttaatacccactcatattatgctccttcgaactccagacatttacaggcagaagcttcagcagtttgtagcggatggagagctgaacaaggacgaagtggaagctttgatggcattccaagtgcgtctctgcattccacaagaaactgttgatgctgtccattcagaaatctgtggcaagttgtttgaaaaggtgatatgaaatattctatgttgcctgttctatatttcccttgttcaggcaaagttgatggcctgttctgtgttagtggtgttcttacaaccgttagtgctttgcaggttgtcgtggaagcaatttcatctgttgatggatatgacactaatagacgacaggctgttaagaaggcagcacaaggtctgaatttgaaaaacgagtctgtcatggccattttcagcaaagtggtatgttaatccccattaccaaaaaaaagtgctagatgatattatttttcaatatattcctactgtgaatgaaattcacttctatattaccaaatccatgaccaggtacggaagttattcctgaactacattcagagagcaaaagcagctgggaaccgcattgaaactgcaaaagagctgaaaaagatgatatccttcaacacagtagttgtgagtgagcttttagctgacattaaaggagaaccaacaactgctgaacctcaaacatcagatgcaacctcagaacctgaagtcagcgagtctgagggggatgatgaatacgaatgggaacagctggagacattaaggaaaactaggcctgataaagagctcagagagaaactggcaaagtcaagccagaaagagataaccctcaaagatgacattccattgagagacagagctgagctgtatgaaacatatttggtgttctgtgtcactggggagacgaccaatgtttcatttggaacagcaatctccacaaagaaagataattcagagtatttaatgctgaagcaattaggagacatacttggtttaacccgcaaggaagctcagaatgttcacattaagatggcagaaaaggcatttgtgcaacaggctgaagtgattcttgctgatgggaagttaacagaggccaaggctgaccagcttgcaaagatacagaagcaagttggtcttcctactgagtatgcacagaaaataatcaagaatatcacaacaacaaagttgtcttctgcaattgaagcctctatttctcgaggacagattggtatacagcaggtccgaggattgaaagaagcaaattttcaattggacagcttgattgcagaaccacttcgagaaaacatttacaaaaaatccgttgaggagatcttttcgtcaggcacaggtgaatttgatgaagaggaagtgtatgtaaagatcccagctgatctcatcattaatgctgagaaggccaagtcgattgtccaggacattgcgaagattaggttggataacgcccttgtccaagctgttgctctgcttcggcagaagaagaaagatgaagtggtacgtaaggaatatccctgcatatctcctacttatttgttttatgttggaacttagtttctccaagaatctgaaagattaaaacactgactacagttatcaaagtactgatttagcgttgactttgatcttggtgtatatcaggattaacctattcttgataactggcacgtcataatgacaaaagaaattcaactagagtataaataggaaagttacaataactgcactgttagaattactcagcgttctaatttttacttggaatatattgccaatgcaggtcgcatccttgaacgacttgcttgcatgcgacgcggctgtgcctgcttcgaagcccctatcatggcctacatcaggagagctggatgatctgtacggcatttacatgaagagcattccgaagcctgaaaagctgtcaaggttgcagtatctgcttggcataagcgacgagaaggccggccagattcgggatgccgcatcggcaggcacactatccgttgcaactgaagaggaggatgaattggtattctagggagggagatgtgaaggtctttttttgttaggtagccagcagagttgaggacctaccatacttggtgctgtggcgccaaccgctgctattgtagctaggcgctggcatatggttttgagaagcaacgcataatcctgacgtgcgttaactgtttgtatagacagaaattggcaccgaatttggtgacaaatctcttttgctgcatttttcattttcagaccatagcgagagcttttttttttgtattttttttcttccccttttcattatgtatcacagtcgccactgctacctcagtcataaaatccgattttgttgtagctcaactgcagcatatgatatgtgtccctttgtatgggtcattgtagccaatatgtttcagcaatttttctttcagtttacattatcaaactgagtgtgtacaccacacaccaaatgctatgcgatgggatttcaaattccaattcctcaggttatggatggaactttctccttttatgacttcaaaaataaacgcggccactttgggaaaaaaaaaacggggtgggggtgggcgattatggatgaaaatttttccttttatgactgtaaagtgaatgtactctgccagtttggtaacaaaaaaaaaaggtattcggccagcatgtaacagcattgcaaacagttctatacaacaaaatcatgatacaagaccagcattctctccagaaacatccattgaatcaatgtaaacattttagccacatacaacaagggagtcaaagctgttgttctgtacaagggagcctaataagctgaagccagcaggtcgaaccgcccagcaaggttaacctcctgttctacacattatcgggccaaaattccctgaagaaagccatttcaaattccctctcttgtaaccgcttctcttcttcttgcatcttccgtatcctcttcgcggccaacttggccttcttcttcggtgcttccagctgacaagggcaacacgtttgaatcagttagttagaatcccatcagtaagtgtgatttactaaaagtagcttgttgaagatgaacaaatacatatcaaagcagcagtattagctaccaaatgagacaagtattataatgcataaagaataactggtaccaatacaattagtaacgatgcaagtaaccacgtttatctgtaaagtctgaaacctttttactgaactacactatagagcagtcatcagtatttttcaataaaaaaggctattaagtagaactaatgataatagtgaactattaatacaatgctcggaatgagaattacaaggaagccaaagaaagtaattaggtattgtatgcgggtatcatgaataaactggatatcctttgctcaccttgggttttttagggtctttttcaccatcctcgtcaacctttggctttagctttggttccttggaacccaaaccacgcttgttattcttcacacgactttctacaggctccaatcttccctgttccaggattaaattgggctaagtgagtatgaaaacaaaaacacagcataaaaggcaaatctaacccataaactggcttcatccaagtgacatgcaaacatagtatgtaacacatatatgactactaaacatcagctcttaattaatacctatgaacatgcgagataatcattccggtcaaaatgatatataatttcagatcctactaaacatttggagttaacagccaactaaggtaagctacctgcctacttggttcggaaacaaattttggctttaccattcctccagagaccactaaccattatccagaaactaaacatatatcttacgttgatctacacatttttttgagctttcaacagttcaacttgcagtagccttgtctcaacatttaactctacgcaccattaacaactacggcccgtttggttggagggagttttaaagagggattgagagtttagagggatgaggctattaagtgttttgtttggttgggagacatgggaattttggtgggattgggatggagaattgaggaagaaactccctccttttcaatacctgggtaggggcaggtaattgggagggaattcctcgtttacttggtctaagcaaatctcagccatccgtttttattaatgagctaatctccaactaaactccctatcaatttccatcacatctaccaaacaagacattgggattaaaaatcaaattcccatcttaatctcatcgtaaattctctcgtgtaaactcccaatccccttccctcgagttaccaaacaagccgagggaaaacaaaatcacatgcacgatgaacagaattaagcatcaaagtgcaaaaccccaaaatataactacaattggggtaaatggacacacacacacacacacacacaaaagatttccggtgacgcaagaacagaggcgcaaacctgctcttgcgcgccgaggccggtgccctccttccagcccgatttcttcagcagctgcagcagcaacaagatcacttaagattagctccggattcaggacacgacacgagacgcacgcaccgagatgcagaggaccaaatcgaacaaagcatcaaaccctagccccacccacccacccactcccatggccatgggattcgaacggacggaagcccaggtgggatggagagcttcgcgcacctggaacccgacgttggaggagccgatcgccgccatcgccgcctcctctcctctcccctcctcgccgccgcgccggctcccctcctctcccctcctcgcctcgtgttcgcaaccgcgacgcgtgcggcctcgaaggctcgaaccaaattgggccgggccttgtggtctccgggtcggtttcgaaccggactctactcgatcaccaccgtccgattattcagatcggacggaccaccccttcccacgtcgacgagcctcgcctatacttgtcgttcccaacgagtccgccacgcagctgagaccaacacaacctagggcacacgccacacgatctcgcggaaccccggcggccggcgatgtcgacggtgatgacgcagatatttgtgaaagggctgacagggaagacgacggctctgaggatggagccgtcggatacggtgaagagcgtgaaggtgaagctcgtggacaaggaggggcttccgccagaccagcagccgctcatcttccaggggcatcagctggacgacggccacacgctaatctactatggtattcaggaggagtcgacgctgcacctcctcggtcgcatctgtggtggcggcggcggcaacaagaagcgaaagaagaaggcgtacgcgacacctaagaagggaaagcatgagcaccgcaaggaagagcttgcggtgctccgtcactatcgtgtcgatgacgtgatggggaaggtggagaggctacgactgatgtgtcctaacccagagtgcaaagacgttggcgcacttatggcgaagcaccacgactgactcacctgcggcaagtgtggacttacctgatgaactgaaaagtggagaggagatgttttaaaagttgatacctagaaatgataaatcctcaattttaatttaattgaattttagccagaggatatgaaataaaattagtacttcaaaagatcgtgtgagagacggatattatttaacgttttcttttatcgtttgaattggttaattagttgctgatattttaatttggtcgcgtcttgatctttgcttgtcttgaactgtgttggtcttagcactgcactggaaaattctcccatgaattagtgttatggctatttgaatttctatacttctatacatataattattttggttgaaaatatctgactattgacattttattctttttaccgtctttaaggtgtgcttactactatacttattaattagttacgctaatcaagtttccagatattccagttattcctagtttacctaggacacgttttcagcctgcaaatggatagagagcactatcctcaacacaagattttacacaacagtatacatacgtagattaagacgcatacgaggagtatatatatgaaataaaaatactaccacaataaatctatactttctatatagttggtatccactaacaattattaattattagaagccaaagctcaacatgcaaacataccacatcatcacccactaacaattactattctagctcatttaaaatcccataaaagcatgtcacatcttcactcacgagtaattactattatagcctattttaaatccccatacaagcatgacacatcatcaacaagtatgtgtcaaaccatcttcctcatattatttttttaacattttaactttcatcatttcgataatatttaatatatactcatctataaatctcacaacaaagtgcgaggtatcatctagttaattatatgcatatatccaagtctactgtacagaaggtgcgtaccgttgttgtgctgctgcagtgcaagtaagaattaggatgtgccatggttgaattcatagcatggaaaacattttactatcggtttaccatataaatcttttagataatgaagagctttattttagtagcataatgctcgtacattgcaataaaaataaatataaaagcaaaccgaattttgggttcgctagtaggtacacgtacaaaatttacatagttatgcgtcagacccatatatcgcacacacatgataacttacaggttgcatcttattgataaaatcgtttattaaaattgtagctttgtgaaatacctgtcttttagtatactaatagttcgaatcattttattgaaatttatgaaaaacaaaacaagaaaacagagggttccagagacgttggtgcaaatctctgaattcgaccgagcaacacactgctcaggcttgtaccacctgtcacatagcactagcagcaagttgtaatcaccccagagaaaaaaaaggtaaaaagaaaaaaaagaaaagaaaaagggaagaacaagaaaatttcttcgcaactccagcgtgtccagcgcttttggacttgttcgcactagcccgaaacaaatggagactgctacggatcggacgtccgatttgatgcaaattattggacggtgttgtaccgtattgttgaagaatgtttcacatgtttcacctctcgataaaaattgtctcagatgtttcactaccagataaaaatgtttcaacacttgagtaaaattgtttcaaccaaatgcaatagtaaaacatactgattgcaacaccttaatacaatgtacgcaaaattgagtcaaaatagaatgaaacaacttgatagaacaaagtgcaaccaaaaaaacaaataaactgtaacatcactaaaattcctaacaaaacccacctctgtcttctattccggtcaccgaaatcaagcggccaacacggcgagacaagtgaggtgtggtgatggtgtagacgaggacaagcaagcagccatgtcgaaagggcgacctcgccaaggccagtcgcatcggcatccggtccaacgcctccttcgcatcgtgggctcgtggctgctccaccagtggtgcctcatttggtcctccctttcgggtcggcctgctctgcctccgccggtgtcctcctccctcttcacgctgcaccgtcagcaaggtcgccggcgtcctcccccctctacacgtcgcgccgtcaacgaggtgcagagcgtccgcctccttctccatgttgcgccgccccatcaccgccagcgtggtcaccgtcatcctcctcccttttcacgttgtcgttggtgtcctcctaccttgccgctacggtgttgatgggggagagagagaacaagtggctgagaatttgagatagggataagtttgatgagaaaaaggtacgtagaagagtggttaggtgggacccactcggtggtggcgtccgattttttatcgcgtatcgaacgctcgagtcaaagcattcctgaaacaagtagatgtatttttggattcatcgccggaatcgccacagaatgtatcccaaactattttgggattcgtatgaatttgtatccgggttgtgcttttgccgtcgtgtcataccctttttatacgtcgttcccggcgcagccgtgcaacaccaactcggtcgatctcgacgaaactgcggtggcagccgccaattccaggggaagaggatgcagctcctcgtggagctgatcagggggggaggtgggaggggggtacgttgacactggaagtggagctgatgaaccctgagttccactcgacactcaaggctgttgttggcccgatctttcagtgagttgagataactacgatttgagagaaacgttgacgacccgactacaaccgtacaagacgttgtgttgcgccttagcgatcgatacacctctccgttggttgttgatcttgccgatgcagatcaaccttgttcctgcaagcaaatcgaagaaacaagcaagaacaagataaaagcaatctgaattacaaataggaattgagcataaatgataagttggggttccgattacaagcagacggacggtctagcccacatgcgcgctgcaaggaagtagcaatagctaaactttcatctaaacaaaacccgaaaaaccctgaaggggtacctaactatttatagaggtaggaggacgaccaagattgtccaagggtcgtgcttcaccagattgggatgcatcccacatgggcctcacttgggccgggatcccagacgaggttacaagcccataggcccattacaggtgacgcaacactttgcttctgtgattatggccaaacgagatggaattccgagatgaggttggatccgttggaaagaagacttcgagagctttccatcaagtactcacgggcccaaaacggagcacgtatgtagatttggcggccgtttgaagtcagcaatgtagcacgtggccgaatcagattgcaacacatggaggacttgatcttgatgtcttcttgttaattcatgatgtgagcaacggttgtatctataatagccatggtcacatcaggagccgtcggacacggtggagagcgtgaaagcaaagatcaaggatatgtcggggatcacggaggacttctggttgagatacgatgggaagcagatggatgaggtcggcagtcgcacgctggccgattacggcatccatgatcctgctacagagatggagatcttcgtgagggggctgatggggaatactaggacgctgtgggtgaagccgtcggacacggttaagagcgtgaaggtgaagctctaggagaaggaaaagatgttgccgtgctagcaacggttgatcttccaggggtggcagctgaaggacggtgacacgctggcctcctgcggcatttggaaatactcgaacatgaacctctgctatcacttcgctgacagttgtgattgcatctgcgcacacatcgagacacaaagactaattcaaaagcatcaaaccctagctcaattacattccacgcagcctgctactgagatgcagatctacgtgaaagtgtgttgatgaggagtacagtgacactgagagtgaagctaagaatggagccgttggacacggtggatcggtcgggtgactattccataagttgatgtctttagtgaaacatttcatgaaaccgcaacaatagtaaatggtttttatcacaaaagtgcaacttcatacacttgatgaattttaggcccgttagtcaactctggcacgcgcaaaactcacgtcgttacgtgtcggacccacatgtcacatgcatggtgagttaaaggtcacagttaaatcgtttgctaaagtcgtagcttttcccaactaaagttgccgtgaagaaaaacaaaacaaaacagagggttgcagagatgctaggacaaatctggattcgaccgagccataggggtgggcgttcggtcagactaaaaaattccctttggtttctcgggtaattcagtctttggaaagtcaggaccgaatttcataaaaaaaactcaggactggcaaattcggtcttggactcggtctaaccgaaatttcaggagaatgaaaaattttgacagcacttccctctttttagaaatttttcacagacatatatatcacaaaaataccaaacaataggcaacatcaagcaccaaattatcacaggatagatctcaagtctgaacctcacaagtcacaacagccacagacccacggtacaaggcggaggcgggatggaggcgcagaggtgggatggaggcggagggcggaggcggcggcggcggtgctggcgctggaggcgaagggcagaggcgacgtcgaggcggaggcggcgccggtgctggaggcggagggcggaggcggcgcgatgcaggcgaaggcggaggcgtggaggcgacgcgatggatgcgaggcagtgaggggctgagccgctgagagacctgagagcgactttactcggttgctccctctagggtttgttctatttagtgggcttattaggcctcgtacacctgttaggccaaatttcagttttttggggtaattcggttaacggaagcctatgaccgaattacccgaaaaaaattcggtcttttgatggctgatatcgaatcactaaccgaatttctcggtctcggtctcggtcttttcggtccagttcttcggttcggtcttattttgcccacccctaccaagccacattgcttcgatccggcttgtaccacctgtcacgtagcactaagcactaagcaggtagtaacgaacccaaaataaagtgtgttatggaaatagatgtgcagcggagacacgaatttttacgtggaaaacccttttgggaaaaaaccacgggcgccaaccaacaataattactattgaggagttggatacaaacgcagagatacattgggctatcgtaccctcctagtgcggcttacgagggatatacacaggagaaaactaggagtcgtcgtgaataaagactaagagttatactagaaaactaatctaatagtcaggttctattagaatactataatccaaatatattgtgaacccaaaattcaaatcacatatttaaaagggaagaaaaacataaacaaaaagggaatatgaaaagaaaatttcttggcaactccaacgtgtccagcgcctctggactcgtatatatgtatgttgggattcatcgccgcagaatatatcccaaatatattttgagattcatatccgaacctacttttgccgtcgtgactggttcgaactccaacaccagaaccgttctgacctaagcctgccctgccctttatattatttatatacacgtcgttccggcaagtcacgcagccgcgcaacaaccagagcaacaccagctcgatcgtgacctggacgaaactgtggtggccggcggcgacgattaattccagggggaagaggatgcagatccccgtggacctgatcacgggggccacgttgacgctggaagtggagccgtcggacacggtggagagcgtgaaggcgaagatcaaggccatgtcggggatcactgaggacttcgggttggcgtacgacggaaagcagatggatgaggccgacggtcatcgcacgctggccgactacggcatccgcgaccccgctacggagatgcagatcttagtgagcgggctcagggggaacacctggacgctgtgggtggagccgtcggacacggtggagagcgtcaagctacagctccaggagaaggacgggctgccgccgtgccagcagcggctgatcttcgaggggaggcagctcgacgacggcgacacggtggcctcctgcggcatccgcaagcactcgtacctgaacctctgcggccgcctcgccagctgcgactgcatccgcacgcacatggaggcgcagaaactgatccaagagcatcatcaaaccctaacgactcgacctgctgctacggatgagatgcagatcttcgtgagagtgctcggggggaagaaggcgacggcgctgaaggtgcagccgtcggacacggtgggaagcgtgaaggtgaagctgtactacaggaagaagaagaagaccatgccgtgcaagcaacggctggttttctccggtatggagcttgcggacgaccgcacgctggcctcctacggcatcgaggaggagtcgacgttgtacctttgcgtacgtctcgaaagttgtatctgtagctgcagatatctcaagtcatggatacaaaattaaaggcaccagatagctcacccatcaatcacgcagtaattgcaatggtaaagtaaggtattctttataaaacatgtacatctcagcaatagactagattaacagtaaaccacctgatcaatagtatgtctacatgggtatctatagctctctaatccattgcctcgtttttctctatagactatcttcagtttagtagatagctttactctctctctttatttaatctcttctaagtagaaaaatataccgacatgaatctctcatagagagccatagataactattgtgggtgctcttagttagcgcttaatttctttcattgttcgagtcgatcaattaattagttgctcgttatttctggtattatggttccggccgtgtcctgatcttgtactggccttgaattctggtgatgttttgcttgtttagtagtagtagtactctgcagaaattcttccaaagaacagtgtgtaatcagagtgttctatgtcttaccacttaccatatgttgtttaaatgtttattagtcgatgccaataataatcatctagataatcgaagacgatgtatcgtggcgaagggcaggaacccaagacctcgcggggttgcaacctttgggagagtgatttttctggagctttcttttgccgacattggctctatttgatcatgtcctatacatattttttctgaggcccaaccattagctctactctatcaatatggctgtgttctactggtggggaaatgtcttttactcccggttggtaaccaaccagtactaagaatccaagactaaagatcgctatctttagtcccggttcaaatacctgggattaaagatcctcggttagtaacaccaaccgggagtaaagaggaaaatctttggtcccggttggtgaggctagcgccacgtctctggttcctatcctttttttttttcattattctttgcatattgatttcacaccaatctcaccaaaatcataaaatcatcacacatttcaaatctcctctctccaggcgcaacgaccaatggcggcagggagaaggatggtgaccggcggggagaaggggcggcggatggaggagatccagctggcgctagaggccaccgtgcgcccgatccgtgcgaatgtcttccgagcccacgcacgtatggcgctggcggctgattcagtccaccggtggcaacgacgacactagcagctcgtgttccatctcgatcgaaacttgatgacagattcagacacaaaacatgttgattacacgatggttgccgctttgtaacacgaactaggtgaacagatgctgaattcagaatatccaaagaacatgacaagattttcggcattgccaactcatgatatggtattaatcacctggaataaactcatatattcagtgcatcctattcagacgtttttattcaactattcctttgagttcaaatttcgcatcggccaagaacaggcaccaactctgaatctctaatactcaaacgcattcatcgagattcgagacaactgaataataagctaattcgattgagatttgcatccatggcttgccatttcatcaatacccattcatcaatctgaacgagctacctggacagtagctgaagcagtgagccggcctggtccggcagccatggaaatcgttgctgctggccgccggcgctgtggacaccggcggcccgtactcgccaccggcatcttcgccgggaggctcggcagcggcgccacgaaccgcagcacgctgacggcctcaggccgcggtcagcgcgcgctccatgtctgcgccgtcgaactcgccgttcagccgcgtgtcggccgcgtcgaggatgtcgcccccgccaccgcgcgccgcccgtgcgtgtcccagacccactgcacgaggtggatcgcgtcctcgccgccgttcatgaccaccaccgctggacgccggccgcaggagaccttgtacaggaagacgccgaagctgtcatgatgctcctgcccgccgcctaacacttccaccgccggcgaccaatcccccagcggcggcgtgctgctggaagaagggaggagagagaggggatagagagaggagggaggagtgaggatgacgtgtggggccacacggaccctctattatttttgtttcgtgtgtagctaacatgtgggtcctacggtttttattatttttctcggatcgaatttccacgtaagcgacacatcaataccacgtggaacgaacacctagttaaaggatcccacgtagacgccacgtcaaccaaaactgggcacaatattgccgagagaccccatatttgtactgattttgtaagctaggggatgtgttgtacccggttttgcatttcaaagataaatttcggactcgacgataaattgagggaactaaagtgaacttctcccttcccctttatctataactaaacgattacgataacaactatcgacatcatattaagtaaccttggttttagtattagcattcaaatacaagtaaacaaatcatgcaagaattaaaccatatataacaagtaaataaaccatactagtattaaaccatacatgaacgttcaaagtaagtaaactatcacgctaagcatataggtattttttacccataggtaaggggtacgagtggctaaagaactaatacccatctatccaacatgtaaggattttttttctgttgataaatccatagatacaagaattagatcatatatgactcctaataaaataaaaacctatagagtctctggttatggatctctgttgccatctctacctggagggtagcagagggtctctgttatggatccctgttgccatctctacctggagggttgcagccttcgtagcatcgtgtgcccgagctaccgttgggacgaggagcaggatatcccacgacgggaggtctccctgcatcaaattatacaattaaattcctcagtctattctctctattctctaataatagagattatactatatccgtctcagaataaattatattttagacatcaatttaagatattctaaatttattttataactaaggtagtagacattaattataaatttacaatagtaaaaaaaacttattaactcgtttacctgaagtagtatgcagggcgcagatgagcgcgattaccatcaggagcaccttccaaagggacatgatctcgactttcttctcactctttttttcctccctcactgaaactgcacctcgctttgttgctttggtctagttcttgaggttcagaatttatagcacctgcaggacaggcaggggagtacaattcactgtcattgactaggggtcaacggcccttcttcaacaaccaatttggcactagcaagccacaggcccacagtccacatatatgttcacatgaagcaaccacccatggccaaggatagtggatgtaactgtaagggtgttctttcgaatggaatacaacttgtcagctttagggtacctgcagttctagttcgattagtatggtcgaacaaaattttgatttgttggctacaatatgtgacatggatcgttggacccttatagaaaaagaatctctaatcacatgcgtacatccctatcttgtgcagccaaccaacagctgcaaaccatctttttaacgctaagttcgactcttcttttgtggtcgatattttactttaacatataacaattggttgctgcagtgtgttgtagtcgattttttcaagcatggttcgattttacccgtacaatttgtggggattggaacccctcccccggcccacaacacgcaaaatagagcgaagatttagcgcatgactaattaagtattagcttaaaaaaacttaagaaatatgtgttaatatgatttttaaggcatatatatatatgtatatatatgtatatatatatgtatatatataaatatatatatatatgtatatatatatgtgtgtgtatagtaaaattatatatatatacacacacacacacaatatatatatatatatatatatatatatatatatatatatatatgtgtgtgtgtgtgtgtgtgtgtgtgtgtgtgtgtgtgtgtgtgtgtgtgtgtgtgtgtgtgtgtgtgagataccatgtttattagtttgggaaacatgcgtcaaaaaacaaacacatgatatgttgcatggtagagcctcttaggctgcgttcgcgaggaggggttagttctcggcacgtaaaacgaaacacttattattgcatgattaattaagtattaaatattttttaaaaaaatagattaatatgatttttttaaaaaacaactttagtatataattattttttttaaaaaaaaacataccatttagcagtttgaaaaacgtgtgcacaaaaaacgacatgggagagttggaaaaactagggaaagagcacaccctagtcgacttgccagctatgtagagactaacctcgcataacaattgagacaacgaaggttctagctattaatacttcaaaataatatttattaccttttttttttcattttccttacccttatgtatagaaaatattccttttgtaaatgcaaatagttaattttaaggcgttgtgaagctttacatttgatttttttctttcctctattttagcaaatcagctgtctaattgacaatctaaaaagcctagctatatttattgcttgttgctgtacatgccaagttggagccaggatgggacctgcacgaattgtgggtatttccattggtccatcctggaggcttgaccgatttcactacatccgattcatccttctcaagccggcaggttcgttggctgatcactggtccaagtgtcaacattcacttatactaatacataataaatagtaaaagcatttagtaagaaaaaaaaacaccggcttgttggcttatcgttggtccagtgtcaccattcacttgatagatactctatccgtcttaaaatataatgctctgtttaaattcatagtattaggatataccatatcttgatggtgtaattaaatagcaaaagcatcttaaagataaaaaaaactagacgagcggctgggcgtgggtgagctccagtcttatgtcctccccgtaaaagaaaaatatagaagaaggagcccacatgccccacacttacgttggttaactactcatcacgtagaacttatgtatgaatgagcatagtaattctatcctacattctcagcaaaattattagaacagcaatacagcttgtccacacttatccttataaaacacacacaagcatctccgaaaaattaagtagtatattttaagattaattagataatcacaagcatctcactctcaacgtatatttcatttatttaccacttaaaatataaccaatcgtaaatgcgaatacacatataaaatctacaacttaaacctgagtacttaggttctatcataaggaacgctgtcaacatatatgttgccttttgctagaaaaatattactccattattcccaaattgataaaaactaaaaattttcaaattataaccgcattgacacaggttttagtctcatttgggccacacaggggcttgattgaaccgccatgctggcttagagctgtgacggccggccgccgtctcgagcgccacacggatcgatcgaacaccgtggcactcacggacgatagagaaaagctatgcagagcgtcaacatggcaaagtaatctaagggcgaagtagaagaatgcctctgatcttggtatggaagatatcttgttcttttcgaaaagagggtgctggagtagaatttcatggtcccattgttttatgcaccacaaaattacggtttcgataattgcactcaataattcagatgtggctaggctaatgttagttatttcagcactgtcttggttacattgaccatgtgatctgactgactacatgttgttagctttggaaggccgtcagagctagacccgaggagggtcggaattctgatctccgatgacatggcaattgttctccctttgcggccttgttcggttaatccggagggattggaggggatttattccacacttattgtggtgtgaaattattccccctcaatctcctccaatcctcttcaatcctctctaaaccgaacaaagactacagctttctttcctcatagtggactccggattccatgccatcgctgccgcgcgcaccgacgtctgaccaaggtccggccgccatcagcggcgaagagatgctcgccgcgcgcacatgcctttcttaccaacgggtggccttactgttggttcatctggcatctcgatcaggcgccgtacgttcgttcgttcatgcggcacaagcattattacggcgattactgacgaattgccacaagtccggcgcgcggcatgtcagagatgcagtgtaaagtggttcgagatgtcacatgtgttcgatcgacgagtccgccgtggctctctctactcgatcggttcactgttcaatctgcgcaaacgcaagcgtgatcaaatggccgtcagagatcccaaaggagttcggagtttaaaactccgacccctcattgacatcatgttatggtatatttcagttagggctctgctgagatcagctaccatgcaaatccaagaaacactgcaacgtgatcagtaaggcagtaacctccttaattttggaggtttggagtcgttcatggccgcacatattatatatattgtttgacgcaacacaaaacattccagcaattgtactcaagaattcatcaccgccttggttagattaattatgttacctgactgcgggtttttgttatacgcatgcagtggaacaagcaaaccttgcatggcttaacatgttttcttgttttgaaaacatgcacatgacatgatactgaatcaggttatgctacagaaggttttgattgttgggttcttgtttatctgtttgttggcattcatctcccagacatcacaggagaacttcgaaaattcagcataacattctgcttcaaattttggcaaattttacgattaactactaactacagactacagtaaccagcaaggctagagctgctgtatgctggagtgctggtatatcgccagagacatgttagacagggttcggagaattaaactccgaccacgcccacgcgatggcccacatgttacctagtagcaaggccacgtggcctcctctttttgtgggccgtccggtccatttagtgcggcccattttcagtgggagcttgacctttcatgcgtgcgtcagaaaatggaataagttcaatttttctcccttaactagtgacagaatgttatctgtatccttcaaacgcaataccggatatctcgacccctaactattaaaaccggtgcaatttaactccctcggtggttttggagggtggtttcactaacatggcgtctacgagacaatattgactagtctatggcgttgacgtgacgcttaggtggcattagagttatatgtgggacccatttgtcattcgaaaaaaaatatggggcccactaatgtgtgggccccacatgtcatc

SEQ ID NO: 14327 - DNA, 3996 bp, Oryza sativa
gcccccatcttcctctctcctccttgccgggctccgcacgtgcctagccggatcggtggagcggaagacgcggtcgggtccgtaccacgggctgccagaggtggatggcttgcgcttcgcggcggacttacggatagtgatgcggacgccgcgtgaccatcactgcgaaggagagcgccatggcgagcgagtgagcgactaagtcgctccacagctccggggtctacgccagcggctgcggtggtgggtggccatggcaagttgttagggcctcgcctgcccaccgcgatcgtcgctccatcgccctcatgcccgccgccgtgcggccctcatcgccgtcgagccgctaccctcgtcgctgccagatgaaggtgaatagaaagaggagacagggagataaggaagagggaaagagaaggaagaagatatggagaaagatgatgacctacatgtcagtgggtcccataatattgtttatgtgaatgacaaatgagtcctacgtatacttttttaattctaatgccacgttagtgccatgtgggacggagaccagatcaaatatctaatccaaaatatttgcgcattttctaaatatggcatatcatcgtctgaatgtattttaagaaaagtataggatttcttagggggtgtttagattcaggggtgcaaagttttaacgtgtcatatcggatatacggacacacatttaaagtattaaacgcagtctaataataaaacaaattacagaatccgcttataaactgcgagatgaatttattaagcctaattaatccgtcattagccaatattcactgtagcaccatattgtcaaatcatggagcaattaggcttaaacgtctcgcaaattagacgcaatctacgtagttcgatatttttttagcctttatttaataattcatgcaggtgttgaaatgttcgatgtgatagagtgaaaaattttagtgtaggatttaagggagtgtggtgaagcagaatttatagggaaatttaactatttgtcacttttgcgttcgacaattaaccaaatacccttcttaggtttgcacttaagaatttgccactagagagaagcttttgtaattttttgccacttcctgcactgtgcagcgccacacatgcatgccagggtggaccaggcacgtgaaatgaccaatctacccctgctagcaattggctgtattttataggctgaatctggatggatgttgttcactgttatgaggtggtcattgatgatccgaggacaacctgctcgtccttgtataaaagatcgagtaccgccaagtcgaataacgaaccaatatttgaagaaatatatccaccggatgttatgggtaaggatgatgattacccaacaccgagtaccctaattttatccctctcttttacggtaccaatagcaattaacaaattaactttctgaacttgccaggcagcgtgaggtcaccaacgatctgaatcagcagctaataaaaatcacaactccagtaattaatctcaacactgatggattaaccagacttgcatatatagataaaattcagcagcaaacaaaccaaataatcaagagctcggcgtataacagttgaagaccaaaccctagataaaataatcctctacccgtgctttctacacgatcagaagaaagggcactaacatgtaccaagtagcaagaccaggaaaataatctccagacctagcttcttctccaaccttcacagcggcagcaataatgtcaattcgcagatgggatcgccatcagctttcctggagaactctcaacagaacaacacaaaaattcctcccctgttacagggcagatagtaaaatgtactaattacttgggtaatccagccgctaatgaccctattaatgatagttggttaattagcctatcggtacaagaaccgaacctatatatatatattctttgaattgctcctgcacggccacttgtatttctccaacaaaaaatgcccgggtcttggacacatcaaaggacctgttcgatctctcagttgagagagaaatttccagcgcacatataacgagaaagctcattagcacatgattaattaaatattaattgttacaaaattaaaaattggattcatttgaatttttaaacaacttttacataacttttttttataaaaacacactatttaaccgtttgaaaaacgtgataatggaaaccgaggaagttgtaatttgtagttgaaaaaaaaaactgggcctaagattaaaaacggtatttaatttggctggcattgttgggatggtgccacccaaacttagctcgattaaacaagttgatgaactgatgtaaccggaatggtgccattgatcttgttgtcttgcaaatttaaaaaggatagattggacatgttgccgatttctcttgttatctctccagttaaaattatgactaagattcaatgtgttcaagcttatcaactcaggacagtaccaattgctagcaggggtagattagttattttttgcgtcagttccatgctggcatgcacaggtgacgctctacagtgcacaaagtggcaaaaaaaaatacaaaagcttctctttcccatggcaaattgttaagtacaaatctaaaaaaggtatttgactaattgccaaacgtaaaagtgacaaatagttaaatttcccgaatttataggcacacgaagatgtcctgcatgtgcaaacgtgtacgtatatatacgtcgttgttggtcagtataagtagtcttcagtataagttgcttgacttggagtcttggatttttggcagagtgcggagcttttctctgggcagcagctgtcagcccgatttttccaagctttttttctcacaggactggaagttctggaagggtttgattcccttgtgaaagggatgccacgcccttgctgtcggaaaatatatagacaaccagcctcatcatttacattagacatgcaggatcttaattttaaaattaattttagaatattatttctaaaccgctaagaacatgtatataagccactttagcttataatcagctcatagcaaccgattgatggggacaaactgaatgtgcagtgcagctggcttccagatttgtccaatcaggaggtatttgagttgagttgagtcgagtctcatgtcgtgtttaatttggtcctcaatatatacttgcttgttgcacactactcggtctgcaactgaacagagaacaccattttgttcccatgatctgcagttttgcatgcacgtcaccgtgcgtatatgcatttgagccacgatttgtgacttgatccagagtatctcgcatgaaaagtaccgtaatttgttagttcgagaaaaagaggctgagtgttcagaacttaacgttgttgcagttaaaatacagctattgagagttttgatcaccgcaagctagacgagagtaattttctcattaaaatataagtgctgatgttatattttccttctaatccatagattagatcaaaggagcatgcatgaaagatatacacaccatgctctctttttaacagatgctttactgttcttgagaagatattattttactgtatcacggttctagctagccttcatgttttactgtgtattttcaaagatgatttatgctaataaggttttaggttttgggtaagggccagggtgggaggggaggggagaggatggttttaagcttagaggaatagccttgggcaatgagatgatagggtgcaagggaggctgtggagttaggagatgacgaatcctgcggctcgctgctagagacggggatcgaagagaatggcgtagaggaatggtgctatcgccggtttaacccttgttcggttacacaagtattcaatccgggccgggaataacaagtataatatgaaatttatgatagatacaacgagaggtcgggatttattttgggccggaaactaatttgctcatgatagggacaataa

SEQ ID NO: 14328 - DNA, 7306 bp, Oryza sativa
gggaattaatccaccagttaagaggtgtggaactaatccggatattttgttggacctaatataagtaaattggttcctgatctggaataaatcccggtctcttgttatacctattataaatttcttgttatacctatcattcctggcccggaacgaatccttgtgtaaccgaacaatgccttagggctcctttggatgcagggggaggaaaccccagggaaaaagtcccgtacagggattttcccctgtaccaaccgatccccttccacctccagaggaatcactcctattaggggaattttctctactaccatttgggagtagggggagggggttgatgggggaagggggatttagagaggcaaactgctaaatagtgtttgaacaacaaaacatgtctttagaaatattatagaaatttcaggaaaaatagaaagaatatagaaaatccatataaataggaaacaacctaaaaaaattccagaaaaaaaaaataaaaacataaaaaaaatcaacaagtattagaaattcagaaaaaacaaagaaatatagattagtttatgtggaaaccaacttcgtgacatgacataagtcaaactttagaatcatccatatcatacaaaatttagaatctttggaatcatccttgcatccacaaatatagaactgtacatcatatttatatagggttacaatgtcttgatcaagaacacaatttaaatctttatctcttctatcttcttcatcatctcttctacaaatcttcatttgttctaataaatctgccaggatgaaaaagataatctgaaatttaagtaataaatataaaatagtgatacttcagcaatcaaatttgaaggacggccattgatactagcttaggaaaaaatgcatgcacatcaaccaacatattgcaattgtcagcttcatcagcgtaaacaaactcttggtataagcactttctttttagatcaaacaccctacatgcagatacacaccattatttttaaatcaaacaatttgaagtccatgtttttgtattgatagttttccaacaatactctatttcaagtccatatttgaaagtaagttgagcatgcaattcaaattgaatcctttgaatcctggcaagaggaagaatgcaagagcacaattatgaattatcattatggacatgataaggaaaaaaaagtagtagtagttgttgttgttttaattaatcagtactactaggtcactttgtttggccagtgtattgtgcagtgagtgagagagaggagattgaaatacctgtgtgtgcgtgtctttgtatataggttgctgccaaagcttgtgttttttgaatgcacaatgccaccttgctcattttctgctggtgatacatgacatgaaactaaagtttagactaatgtataagtatagagcataaaagacttcatttttgtagtaagtatgagttcctatcaaaaatatgattgttaccatttatttagtcccaacatgcatgctaaattgaccactaattctacagttccctgacagagactacaagaatggattagactaaaaaatgcctccagaaaaaaaaacttgatgctagcagctcaaccagtactaagatctacctctaggttaacagagctgacagcatccaactaaaagaactgcatctctaattaactgcaaaaaactgttactggtttgcagactaaaatttctcatatacctcaccagttgaatgatcctcactgcatgtgtgataattcctcatttcttgggactggtgcattgatctcacatatttagactgcactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatactacaatgtattagaaagaacaggagaacagattacaactctcccaaaccaaatcaagaaacataccatacatacaccaagaaaactgaagtactgaacgaacccccaagaatcaagcagcagctacaagggcatgcacaaacctagccgggcaaccgccggtgggtgtcgcgcagcgaggaggaggaggcggatctgcgcctcagcgcctcctctgccggtgagtcacgccgccttggatccccccctgtccccgcctgcttggagccgtgtgcccgcgctgccggcgcgtcgcctcgtcgtcgttgccccggctgccgtggtgccacgcgtcggtgcctgcgatgcaagcgctgagaccagagagcgagattgggagctaactagaggaagcggaaaccctagaggaggaggagaacggaaaccctaggaggaggagaggaggggaatgaggagaagggcttatccttctcgccggaggaggagtcccggcggtggcgcgtctcgccggagaaggaggcgcggcggcacccgctattgttcgcgcgagagagaagcgactccggttgtgcgagcgagaagcagcggcggatcgagagaggaaaaattcccgacctccggaggtcggggacctttccctagggtttccccgcggattgggccaggaaatccacaggcttccaaatggacatggaataaaacccgtgacaatttcccccacgggcctttctcccagggaatgggctgggatcccggtgggatcccgggctgcctttggatgcacggggagaaaacccctgggaaaaaaccccatacagggattttccctgtaccaagtgaatccccccaaaatatctagggaagcacttcccgctaggggagatttccctgctaccatttggaagcagctcacgggactgggggatgattagggtttttaatttttgagcctactctaccaaataatggctagttggagcacacacaacaagataaaaaaaatgtctaaataaacataactgagcacaaaaatagaataattaagttaaaaatgcaagaaaaaaaatctgaaaaatcatatgaactccaattagagcaataaattctaggtaaaatagagaacattatagatacaagcatcaacttaattcatgagatgatcaaattgagctaccatctacagtatttagccaagtattatatgagcatccaagaaatatcactttcagcaaatacaagatataatcatacaattatcatttacaaatatcttggatgtgttttcctcctgcattcataagcatcaactatctccatcgctgctccaaattgagaacaaggctgaatatacaagggcaaggcctgttgcctacatccaagaattaaaaacacaagtaagggtgcaacctgtagcgttggtagaaaaaaaatcattcaagtacttcttgtatagaaaatgcagactagagtatagctctgtgtgggacaatccttgtttatgccaatccagagattcaaattgaatcatggcaagaggaagagtgcaagaggacaattatcattatggacatgacaaggaaaagaagtgcatctcatatatataccccctatgtgagtcctcattaggtaaacttttgcaacattttcagctgaactgcagtgccattgagctgctgtttaggtgcaaactgattagacagattaaagcctcatgctactacagtttgagatgcaaattaatgcgcaatgcttcagacggaccgtggccatctccagctaactctgtctcttagttttatgcccccaagcaagcacacaaacactgtcattagtgtagatagttatggttagcacttagcagtactaattagtagtagtagttgttgttttaattaattagtactactaggtcactttgtttggccagcgaggtcctatcaaaaatctgttttttaccatttatttagtctcacatgcatgctaaattaatcactaattatacggttccctgacagagactacaataattaatcagaattaagctaagctaggaccatcaagaatagagaagaattaaaccagattaactgaatacaaagagttgtaaaatttacatctgctgaaattgaatcaagtatacaaatagcagagctttcaagttaaattgtagggccatcagacatacctatgcagcaatttggctcctcagaaaaaaaaatagtagtagcattagctggtctaatggatgagcgatatagtgttcagctttgaagggttgttgtcagtttaataatgaatttcatgaagatatcagaacatatactattgctaaacataaaatgttcctaataactccagcaaaaatgattctctgtccagtaaaaaaagattctctgttagatctaaaaatattcatttcacagaatcatggtaaaactagagctagagatgagaaaagggaaaccaaacggagcagagaaaaaaaactaaatagtaatcttgagtgaagaagttgaggtttacataccagtgcatgctaaagtacaataaccctttgcaaattgcgtattaaatttaaattaaattatggcaagagaggaagtacaaggaggcatacttgacaattcttgtagttgatctgtcgaagcagtgaacgcgtgtgttcccttcttaatcaatgttgtttaatttaccacgtagcttatgtgttaaagcatatgaacctgcacaattgtaaattgtcatcacacatgcacgataacctactgtccatcttgactgtaagctctaagcactgactaatgctatcctcttttggacatgtactagtgatggatagattcccaaaataagaataatatgttgtctgttaaaacttgcaatgatgagacctgggctctactgatggtcccaaatttcctgtgcaaagacattactaatcagtttttgcatgcaaatttcacactccagaagaaagcaaagcattggtttctcctgcggttcgttagatcaactcttttctgagcctgaacatgtctaccaaaaaacaagaacttaacaagtctttgcaaagatcattcacacaaaccgtggtttctctcattagttccacattcacaagatgcaaaaattaaatttccagtcaaaccaaactgaaccataaacaatcacagcacagatttgggataaaggacacgaaccagtcgaactgagtcacggtgctggcgatgcttagtgacggccactggagaaccgctcttggtggctatcgaggttgacctgggggatggggcactggcgcactgccactggagagagcgcgtcgtgttgcttcaggtgggagcaagattgacggtggctgttctagagaagctgttgggggaagatgagaagagaggattgagccactgagccaaagatctgaggggaaaccctagaggagaagagcagaaaccctaggaggaggaggagaggaggggaaagagaagaaggcttaccctagtacggtggcagtgctggtggtgtctcgccggaggagtcccggcggtggcgcgtctcgccggaggaggaggcgcggcggcgcccaacattggttgcgcgcgagagaagagactccgcgcgagagagaagcggcggcggatcgcgcgaggaaaaattcccgatctccggaggtcggggtcctttccctagggcttccccgcggattgggctgggaaatccctgcctcgtgggcttccaaatggacaggaaataagcccgtgaaaattttcaccgcgggcctttctcccaggggaatgggcggggatcccaccgggatcccgggctgccaaaggaggccttagggagccgggaggaagagagggaaggaaaagagacgtgctagggcggggaagacaggtggctctcgacgacagggcattttcgatctgacgcttgtgccagtcagtgaggagagagggagaggaagagaaaaagattagttatgattactgtagcgcataaatcttgaggcaatctagaccgttgaaaaaggactaaaatttgcaagtatttttcatgtgattgaaaactagacagcgtccctttattctatcatccgtaagcaatacaataattgtgtaaactccatagctatgagttacaacaatctatatcaatcaatgatggtaatctcttgtcttattcattctctgcgtcgatcgatcatcagtttccatacttggccttgtaatcctgccacagctgctgcacggtcttcccggtgatctgcacgaagtagtcgacgttgtacccattcttcagcttagcgttcaggtcggcaacgaaccctggcttgacgctgtcgcagtagtcgaagaacctcgccgtcacggagtagctgtcctcccagctgttcccttgccccggctgcacccaaccagccgctgggtagccggcgcgcagccgcacaaagtcggcgatcccctcgtacacccacgaatgcgccccgtaatcctgcagcccccactgccacacgtgcaccacctcatggtacaacactccggtcacctatgagaaaaaataacttgattatttggaaaaactagagattgtcgtaaaagttgtggttgattagatttaattttgtttggggacatcgatcggggttggaattctagtcatctatggtcacatttattaaagtgggtgtgtttaagatgatgggaaagagaaaaattgagaagatatataaaacaagatgagcaattagtgtatgatttaattaagcattaattattttaaattaaaaaacgaattgatatatttttaaaaataacttttctagaactttttaaaaataaacacaatgtttgggacgtgcgtgcagaaaacgaaatagttttactctctttaatttagccattgccgaacgaagtcttagtaggaacaccgtaaatattatcgttgattgtcaccatgtttagatccgaagtttttcttcaaacttccaatttttccatcacattaaaacttttctacacacataaactttaaactttttcatcacatcgttctaattttaaccaaacttttaattttgacgtaaactaaacacagtctaaacacagtctaggtgtatagtttggatggtcaaaattttagtcagtcaacatggatgagccggagtctattaattacctgcgtcttgaagtcgttgccggtgacgccggcgacgtacccgcgccgagcgtgatggtgttgccgctggtggaggcgatgccgtcgacgtcgcggacggcgaggacgacggcgtcgacgggcctccggtcggcggcgctcg

SEQ ID NO: 14329 - DNA, 199 bp, Oryza sativa
ctcctccacctcagctcttccgcctcatccaccaccacctcgtcccccccaccacccgtagccacccttcgacgtcgtcgccgacgaggaccaccaccaccacgacggtggagtagccgcccgcgaacaccgaggcggcaggggatccatcatcccacgacaacgaccatggagctcgccctggcctccgcgaagccct

SEQ ID NO: 14330 - DNA, 1704 bp, Oryza sativa
  unsure (1)..(1704): unsure at all n locations
nnnnnnnnnnnnnnnnnnnnnnnnnnnnnnnnngaatcgtgtcaaatgagggagaggagaggggtatttatagtgtggagcttgcttgggagtgtggagaacctccatggcatccaatgagcatattcactctcctcatgccaagtgtccatttggatgatggttggagcgccgaaaacggtcataaccgtcattaggaagcagttatctaccgaactggacttgggccggggcgaacggcctctaccggggttcggccgaacccctgagttcggctgaacccgagatagctctgtttgctccagttttcgtcccggacactcattttgggcccctcaattcattggtatgaatgtttgtgtaacatactgctgtaggctctccggacctcccattatatttgagagatgaagtgaatagttcaagtccaaacaaacataacgaaacatgcgacgcctcgagagaagaatattgaagacattgctgggcctttatgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaataacgatctagcgatggcttcagctccactcccacaggcagctcaactggggtataagccaaacgtcttctccttctggatcctttatcttcaaaggaggtttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccaagtataacatccataattattgtgagaggtgtgagactaatcacgaaaaacattgctcaacccgcccataaccgcgggcacggctattcgaatagttttactctggccagaggtgtaccactgtacccacaagacacaaccccacatcatatcaccatgtgcctcaataccaccacggtacctcggaaaagagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataac

SEQ ID NO: 14331 - DNA, 71681 bp, Oryza sativa
atataggatcaacatgctcaaaggattgtgtttaggatctgtgtgacttggcttgcaataatcggtcttcaattaatcttctgaacacttctgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggactaagatggcgacctcgccggagattggatggtcggctgcgactttggaggacatgaacacgtagaggacgacgagacgaacccaacggtactcaccctcgaaccaaacgacgaacgacgacggccggcgacgaggtctgttggcggcgcggcttcggtcgacggcggtgacggggctccggtgaccggcggcttcgggggtcaggcggccgggattctccacacctcggcgcaccttacggcggtgacggcgaccggcggcgacgacggaagcggcggcgcgacgcggatggagctcggccggcgacgacggcggggtggagcacgtggcggcggcgctacgaggcacgggagaccacgggagagggggcaaacgaaagaggaggactagggggtcctatttatagccttgaagagatcggactcctcccgcaagaaatcgatccgggaaaatcaaaaactcggttttggagataaactcgaaaacgagttcgattcggataagatactcaacgatttgctccgatttttgggggtaaagatagaggaggataagaggaatatttcccctcagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttctaatgctcaaataatttcaagaaaaatcctgaaaatacttggacactcaaagtacttaacaaaattacaattagaccatttaatgattaatttaatatgtggttaattactgaaatgctctttgtatgattaaaaattaggaattgagctccgaaaaaatctgagaaaattccagagagttgacttaatcatggagaatttaataaaaaattaaatccatccatgctttatatttaggaaattttatttcccacatttaacttcacatgtaaattaatgaacatttaatataaattctattattaatttattaaataatttataaatcctgaaacgaaaatcaggatgtgacactttagcctgccagtcaacttcagcctgagatgtgcccatcaaaccactcgaaggcggcgaccagatgtgttacacattcaggagacttgacaaaaatggctaaagatctacaacatctcaaatattcttaactcatactcatgtgaagctagtttccaggatgtgcggatgtgcactagagtcacacattcatcttaagcatgattatacgtagcaaacacaaataagatgaaagctattatagactacatctactttagttacactggctgaccggccaaataaataatagaacagcggaagcttgtttacccaatccacaagcacaccgactaggggtttaccccattaagttcaaatcctagaagaagcagtcaaaacctgcatcactcaaagactaagtttaaaacctgcaagcaaaaggttaattcaacggcaagagtcagtacattatttgaaataatatactggcaagcaccaagacaagcctaacactctacttgtaaggaatattatcaaggaaggcataatatggttcgttttagcataaagcaagttttgtttgcataaaacacatttaaatctgatttgctttcaaatagttttcagcaagctagtacttagcatatgggcatcaaagtagacattaatcatgtatgaatatgcacctcattgccatccatggcagcaaggagatcattctcaaatctcatcacaatttgaaagtaaatttcagcatttagaagaataaacacaagtctatactcaacacatatccatatgccgctcataaccgcgagcacggctaatcgattaagttttagactctgcagaatttgtacagctttacctacatgatatgaacactctagtttgtttcgagtttgcaagactctaccacattctacacgttgaatataacatacccaagcctgtaaacctgagaactaaatttaatttaaatgcatcatgtggttttggagtgattttaattgtttttggatcttaatcatctcatcatcacatgcaatgataggcctagagtcacaaaaacaattaatctggaaattatatgcatccaaaaaaaattctacaaaaattctcaaaaataccttgatatgtcagaaatcaacccacaaattttcagaattttgtttagtaaggtttgctaactccttgatctactttaatatctccaaaatcctgaaaaactgcttagcagattcaaacttgctctccctgtaaaatttatttcaaaacctctttttgatgtttggtttcagccaaagtcttctactaactttcttctaacaccccgaggagtggcacaccctggatcactctctaaccctttcttctctccctccaaaaatccaatcagctgttaactgcactgtcaactgctgctaaccaacactgtcaacacatgttcattactccatcgaacctaaaccagagacttctaacccaacccacttcagcacatttactctccacatcacccccgaccaagaggatctctagcccaggtttcttgctgttgacagaaaacacgaggcctgggagatatgcttaactccagtgcaggtccaaaactcgcctttgggtatgctagcgtgccagttgatttgatcctgcaatcaacaagaaataacggcaaagaaaccgcggttaaacctataaacgctagccgatcagctaagtgccgatgacatatcatttatctttgagccgatgtcatctatgtatcgatcggcggtcataaataagtaagaaggaactagatctactcgatcggctgtagatattaacaatatatattccttatatcgatatatacttaaatcaagtgattgggataaatcggtcgccatgccgagacagtataaatcacttagatcgaaatatatattaataacgggattatatatgttcatagcatactcgatcaaatggatctaatatgtaccgactagtactctgataccactctatactaagatattaaaacaagtataatatatcaaacaaaaatctgatatacttaaatgcgacaagatcttaacataaatggcagatttaacatatccatgaagcatatagagcaaatatagttaaatcagataagatcggctgaaaccccgatactaccctaatcggcaaccagaaggcaggctagagattaatattctaagcacgacttaatagatcaaactcaactgatgcagcattaagtatgaaaagaagaacaatatctagacaatcaagccgctggaagtttcatagagtggtggatatcccatataatctaagtcaacatcgatgtttaacctaatcggctgccctctactgacagatgttagccgataacaggttaaatagtgatattgccaaagattatgtaagatatatgataactcgacgaattacataaacaagattagagtatcgtaaagatggaagcactaatcccgagaacgcaaaccatcataacaagttttacctcttgttgaagatcgaaaccaatgcagctcaacccaaaagcaagaactcatcgaaataaaactaaagcaaaagggtggcgatgcgccgaaattgtattgaacgtgtgtgtttttttattacatggggttcggggtctatttatacccgaaaattacaaactatgtccatatcggacacgactcttatctctaacaaactctaagataccataagtctttacggcagacttttgcccgaacatatctctaaggaaattacataaaacatcctaactaatagatacaattgccttatcaggactctatccatgcgtggcaatcatcttgaagcatatcaactcaacccgatatcacacaccaagttccattgctagaatcggctgtctcggctcacccagtctgactcggactcagccgatcctaatcgtagccgatctggactccagccgattctcactctgtttcaggaccgatttccgcccttgattctgcttcgatctaatcctctttttcgatgcagatattaccaaatttggtcgttaacacttgccccccaagtccggaatatttggtaatgtttcggatttgccctgtatcgactcctagctagtttcgcactctgccgttttccgaccattaccctcaacgctttaaatactaatcaccgccctgaaaaatcttcaccccgttacttccgttttcaccgccgaagccaacctcatcccctttctctccggcgatttccccgacgctcaaggcgaccccagacaatcccatctccggccagatctccgcccgtagtgatgtcgtcctcctccagcccatctaccacaccgtcggccgagtacgctgaggtaagttctcatcggctagatcccttttcttcgcatgaaatcgatttccctctgcctcatcttgttttcttcttctctatctttgttcgcatttgtagcatccctccaatctgatagcgattcccagcctatcgcacgaaaaccattactttattggtccaatcggcaatcttgaccccattgattttatcatcggtgaaactaacagaatcccctttctaggtcattggaagaatatttttaagtcttggccatctctcgagaaaaccacccctgagaagagttggaccacatggtacaagcgtgtatcggctagtaagaaagttcactgggatgagatcgggatcggccaagcgcttgcccttaccatagccaattccgctaaggacgaacctctgatggctgccgccacctatttctagtccaacaccatcaatgccttcttgttcaaccaagggctgatgactccaactttgatcgacattaccatgatcaccggattagatgtaacttcatcggctaattctatgagcatgaacaccaagaaccaatttgacttcaggaccaagagcataggtggttggtctggttatgtggcagcatatatgggccaaggatctgttactccttgagagcatgtggcctttttactcatgtggttgggaaagtttcttttctgtggatccagttgtggccctacaaccaattggcaatttgtagccgaaaccctaaaatcaaagaaacaacttcccttgggcaaaatcctcctcggctatctataccaaatattgaacaatgcatcggccaagatagtcgtcggctcagtagttggggcaggtggaccattgtggctgctgcaaacctagctaaatctgatagtcatgaaagttgtcaatcggccatccgtgacagaagctgaatttccaaggttggagccgattatagaagatgacggagaagaacgcacccatcgtaggtgcatgtcttatgaagaatatgcatccacaccaaccgttgccggagcaaaactatcggctgaactactcaaggattggttttgcagtttttatcagagctttcataaagatgcccgaatctggtttccctatgaggactcaatggacctagatctcccgtcagactttaggtttgaggacatcaatcatgaaaaataccaaatatccaaggaagttctcatagctgcaatcagcccatgcatccttcctgtcggcattcatcagggaataaacatccaagtctcttatgaattttaccacccaataagctcgactagacaacttggactgggtcaactcccaattggcttattctttaccgataagatccagtgccgaggagaaatctcatcatctttgatgatggatcggctgctaaacctccaaggaccccctctaggcagtattgataacattgaattggcaggattcaagagcagaaactttgacagatggtggggcgaatggaagctgcacctatttcatcaatcggcttcgatgtacatgatagatctattccctgatgtcataccccaggtaaaccttatcattattaacctgagtaattgtcagccgattcattacttgactaatctcttgttcttgttctgcagacaatcgactcttcccctccacgccaaagcaacagtggcagagacattgaatatgctccaggtctaattcccaatggaggtgggccatctccccctgtcatcggctatcatgcccccaggacttcaactctcctccaaggcctaatcagggaaccagccgatgcaggcaggaaaagaagaactaggtcattggctatggacgcattagctccagctccaaagaaaagggccaaatccaagaaaaccaagtcgactgatgacctgccttctttggatccatccatcgagcaagctctagatgaagaagaaattgacgaggctgttgaccaggctcccgctgatgtaagtgatactgaggaaacaccatcggcttcacccaagcaaactcctccgactccttctgcgccagttcatttttcaagataaagcagctctctttgatcccttttgtaatcacttcacttttcggccgatcactcacagagtttattgttgcagaagaagaaaactgctatgaaaaagaagccagcagcaacaattttcaaaccggctcaaccagtaagatattttaattcttttattagttgatatcagccaattttatctaacacttgtttcttttacagcatcctcctcctcctccttctcctcctggacaacaatcatcaagtgaccgaactccatcggctgtggggagtcatcatgttgaggaagaagtacaaccaactgctcctgctatcccagtaagttttcccttgatgcaagaaattagatcggctatatctacttagctctcaatcttcctaacattgtttctgcaggttttagccgatctcttctcttttgacattagagattatcttgatgaggcagaggaagatacttcgagcaaagctctagcccccttatccgatgatgtaaagaaaacacttgaagatatctcccatcggctagaggcctcctctttagatagcttagtggtcgactgtgggtcgattaggacacgactgcatgaagttcaagctctgattcccgaagaactggccgacgtccttactccagccgcttatctcgagcagcatcaattcaagctggaaaaatgtcacgcctagaaatttagcccaaatttctagactattttgtgtatttaatccctgtccaggaccagccagggtacacaaaatgacaagtaatatacagttccaaacgtaaataaagcgtaaaatacttacagcagaggcacttagtcctcacaccgaaagagaacgacagcagcggaaaaagcgatcctagcggggcttcagctcctctccacaggcaaagctcaattggggtctgagccttggtcttctaacttcgtcttcagctcagaagcactacacttctgaaaagggggaaataatagcaaggctgagtacaaccaccgtactcagcaagccacaccattgatgcagacgtacaaggggaacacaaggatggtttgtggctatttgtataaaggcggttgtaaaacattttattgagaaaaacagtaaaactgttgagtaattaaagtaacattaaatctccactgatcaacgctacaccacgttgaacaggcccaaccaacccacctgaactacagtgcattgagtcaatttattaaagtgggactaatcacggtgaatctggtcgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctgcgcataaccctcccctaaccatccacaccacgctaaggtttcacccccacccctcaaaaggcagtgggcggtctctcttgcgccgcagtgaatccggcagctggacaaccggacaccccggccgacccaactccatcacgcccaccctcgccaccggtggctaggaaagggtcaagctatacttcagatcaagcaattacccactcccgcttgtggtaagcacggtaagtctcccagggtttcccgtgaaccggtccttaactgcaatgggtgcgaccagcaaaaccatgcacccacagcccaccattcagtcgcattttagttggataaatacgaccatgaaacatggctagatgtctcgaacacgcagctcattctgatcctaaaaaggtctaatactgcagttatcccatcaaatgagctagtggtaattaagcatggctaagcatataattctagctaggtcacataagtaacatgagctagtcaatttatttgatgaaccctgagttcctctcgacactcaaggctgttgttggcccgatctttcggtgagttgtgacaactacgatttgggagaaacgttgacgatccgactacaaccgtacgagacgttgtgttgcgccttagcgatcgatacacctctccgttggttgttgatcttgccggtgcagatcaaccctattcctgcaagcaaatcgaagaaacaagcaagaacaagataaaagcaatctgatattgcaaataggaatttaatacaaatgataaattggggttccgaagaacaagcagacggacggtctagccgacacgcgcgctgcaagcaagtagcaatggctaaactttaatctaacaaaacccgagaaaccttgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgacgcaacacattgttcctgtgattctggccacacgagatggaatttagagaagaggctggatccgttagaaagagggctccgagagctttctatcaagtactcacaggccgaaaacggaggtcgtatgcagattcggtggccgtttgaagtcagcagtgtagtaggtggccgaatcggattccagcacttggagtacttgatctcgatatcttcttgttcatccatgatgtcagcaatgattgcatccgtggtagccatggtcacatcattattacccagggttgacaaaggacagatatcaagtaaacatggcacaagcgagcagataggtaatacccacatcccatgtaattagcaaaacatgcatatttatttgcaaacggtaaaacatttgtaaagtaggatcaaaacgctcaaggggaatgtgtgacttgcgttgcttcttcacttggatcttctgaacacttttcctcgcgaccgcgaacttccgaaacgacggaaactacatgttggcacgcaaaacgaggaaaaactctaataaacaccaaggaaacagtacataaaaagtaaacaaacatgtaaatctcaattttagatgaattttgcaagttgaatggtttgggcgattttatgtggtttgggcgcgagggcgcaggcgggagaggctggaatcgtgggcgacgtggggcggcatatgcgcggcatggcggcttcggctctggaggccgaaggtagaaggaagagctgacaagtggggtcttcgggcccacctgtcggcgaaagggggaggggagtcagggggttatttagactttacgcgaggggaaggtgaaatgggccgacggcttaagagaagagaggggaggccgactgaggaagggggaaggagaggggcgcggcccgcgggaggggaaggattcttgggccgaaaacggcccaaggaggaaggggattttttattttgttttctttttattttaattgataaaatgaactttgtgctattcaaattatttctcgagctccgaaaattcgcaggaaatttcagagagtttttttagggcacaaagaatattacagaatattcccggccaatgatttttaaaggaaaattttaattctcccattatttcacttaattaaattgaattaacttttatttaatttctagaaaatgcattatttaatgatttttagtcccgaacaaaaatcggggcgttacaaaaaaaccaagctaagactagccgaacgttggaagcgcaaggagattgaagccacaatccaagtcaatcgacagcttgtgcatgaagaaaaggtcaaacttgatcaactatttgagggtccgattaggtccaatattgaccggctcgaagctcgcaagatcgagctcttggcacaacttgaagaatgcaatgctgagctggacatagaacataaaaaaatagccgatctcccaaagtctgtcgaagagcagaaagcaaaactcaagaatgttgttgatctgaccaagtccctaaaggttatttctggaactgatgctcaagatgctcaagccattgaagaagtagaacaaattaggcaaagggctatttcagctatccagcaatacttgtcttggtgactttctgtgtaatagaccttagaaattttttgtaatcggctaagatactctagtactttactgtcttgacaatcctttgtgccgattaatacaacttctcaattcgcacaaaaattttcattttttgtatatatgtgcccccctaattctacaatgtcaaaagcgagaaaattataaaaacaactaagggcgatataacaatatcggccattgtacatcggcaaaccactaccgattacaatagaaaaacaactaagggcgatataacaatatcggccattgtacatcagcaaaccacaaccgattacaataaaaaaaaatctaagggcgatataatcatatcggccatctcaaggcgatgcaaacacatcggctatcgtgtattggcaatcatcagccgatcatgcattaacccaaacactagggtaatatttcttcaagtatttgccatttaatgctcttccataagacttcaccatcgagtccttccaacatgtaagcccctttagacactactttatgaatctggaacagtccatccctattcggcgaccacttgccaaatttgctatcccgagtcccaatcggcaaaatcaacttccatataagttcaccttccgaaaaatccttgggcaccactttcttgttatagtgtcgagcaattcactccttatccctagtaacctttgcaagggctcgcaaccgcgattgaaccagatcttccctcttatcggccataagattgtaatactcatcaactcttaaatccttttgtagttccgttctcctggagccgatccttgtctcccacggcagaacagcctcatggccataaacaagtttataaggagggacctagatcgatccatgacaagccatccgataagaccacaatgcttcggccaaccgagtatgccattgccgaggataatcagaaatcttccttttaatcaacttaatcaagcttttgttagatgcctcggctttcccattagcttgtgcataatatggtgaagaatttaacaatttgattcccatactatcggcaaattgaacaaactcatcggatacgaaaattgaaccttgatcagttgtaatagtttgaggaatactaaatcgtcatattatatgctcttgaacaaattgtatcgcatccccagaatcaaccttcttcaaaggaatcgcctctacccatttggtgaaataatcggtcgccaccaatataaacttatgtcctttactcgatggtggattaatcatgccgatcatatcaatgccccaacctctgaacggccatggtttaatgataggattcatagacgacgccggcgctcgctggattgctctaaatttctgacaatcttgacaccctttgtaatatctgaaacaatcttccagcattgtcggccaaaaatacccagcacgccgaagtaaccacttcatcttatgagccgattgatgagtaccacaaatcccttcatgaacttcaccgattgcaaccttagcctgatcggcactcaaacacttaagcaacaccccatcaatcgtccgataatagagctcatcatccaataaagtgtacttcaacgccttatatcttaatttccgagaagccgattgagatggattctgtaaatattgatgcacatcatacctccaatcatcggctgttattgctgcgacttcgaccttaacatctttgatcattgacttataccccgatgccccttgggccaaatcattagcttcaatattttgttctcgagatacatgcttcaaagtaaccagccgaaactccttcattaattcttagcacttctcattataaaccattaatgtatcattcttacactcttattcccctgccaattgactgattaccagcaaagaatcccccatgatttcaatagtatcggcttcaacttctttgagtaattgcaatcctttgagcactgcctcatactcagcttgattattagtttcataaggtttgatagtataagcaaactcgaaacatgcccccctaggggaaattataactaagccgataccacaaccatgagtatacaccgatccatcaaaaaataaagtccatggcacaatctcgaccgagccgattgaatcatcacggtgttccacgataaaatcggctatagcttgtcctttaatcgccttcggcgattcataccgaagatcaaactcagttaaggaaaatatccactttccaatccttcctttcaaaatcgaagccgataacatgtacttaacgacatcggctttgcagatgacggtgcattcattggacaacagataatgccccaaccttgtacatgaaaaatataagcacaagcataacttctccaaaggggaatatctagtttttgcatccaagagtcgacgactgaggtagaatacaactctttcttttccttcaagctcctgaatcaagactgagccgattaacttctcaccagctgatagatataatataaaaggtattcctttctgcggaggaatcaaaattggaggagagctaaggtattccttaatactatccaaagctttctgctgctctgccccccaagtaaactgctgaccggctttcaatctcaacaatggtgtaaaaggctctaaccgtccaaacaaattagaaataaaccttctaacaaaatttatcttgccgatcatctcttgtagttctgtcttgttctctggaggctaaatcttcttgatcgcattaacactcctttgagtcaccttgatccccctctcatgaacaagaaatctcaaaaactggccagccgatatgccaaaagcacattttgtcgggctcatcttcaggccatattttctggttctctcaaaaaccttcctgaaataggctatgtggtcttctatctccttagacttaacaaccacatcatcaatataaacctcaaccaaccagccgattagatcatgatatatgtaattcatggctctttgatatgtagctccagcactcttcaagccgaaagtcatcacaacccattcaaataagccgattgcaccaggacacctaaaagctgtcttatggatatcttcttcggccataaagatttgattgtatcctgcattaccatccataaaactcaaaatcttatgccccgaagcagcatcaaccagctaatcagctactggcattgggtattcgtctttcggggtagccttatttaagtttcggaaatcaatgcacaccctgaccttgccgttcttcttgataacaagaactatactagaaacccactcagcatatcgacaaggacgaataaaaccagcatcatataatcgtttaatctcaaccttgacaagttcaagcatatcggctttgcatctcctcggaggttgttggtgtggcctaatccctgatttgataggtagccgatgttcaacaattgatcggctgagtccaggcatttcataatactcccacgcgaagcaatctctgaattctttcaacagctctatcaacttggttgtgaattccgaggacaaattcttactaataaatgtcggccttggccgatcacctggacctatatcaatttcttccaactcatcagccgacatgaaaccctgtccttgtttgtcatcgagatcatctactgtgtcctcggtgtagacgtttgaaccctccatgacgccctcaaaataatagtttgggttctccatcttcaattgttgtatatcagaatcggacacttttagaaaatctccatcccaaacttttccagataaacaatcaagaccatccatctcccaaagagctaaatcggcactggcaacattcactgacctgttggctggcacaatttcaatcttgtcgccttgccactaaatcaagcattgatgcatggttgaagaaatacaacaattggcatgaacccaatcccttccaagcaacaagctataagaacccttcccatcgatgacaaagaacgttgtagggatggttttcttgccgactgtcagctccacattcaaaactcctttggtttctgatggattgccgccaaagtctttgagcaccatgtttgtcttgatgagatcttcagcgtttctgcccaacttcctgaatgtagtgtaaggcatcaagtttactgcagccccaccatcaaccatcatcttggacatcggtttcccatttacataaccatttatatacaatggcttaagatgccaattctccgacccctctagtttctcgaaaactgcctgctctggtgacaaaattaatttagccgattcttcttcaacttcgtcgatatcggcttgcttgatcccaaactcggcaggcaacgtgaaaaccatgttgaccgaagcagttacaacactttttcccttagccaaccttcttgcttcatcggctgtggcttcatcggctacaggaacttgattcttaacacgccactcctgcctcggcttcgttttcatcagccgatggttgatttcctgctcgacttccaaaaagcgctccctattcctcaatctttgaacccttctcttttgattcttcgtaaagataccagaaggacaccattgagtttttatgttttcactgtcctcctggccacgatcttggtttactggacccaatctttgatgaacaggaactcttgtctgccttagccgactgcccctactaaacaattggcttgaactctccgcaatatcactgcacccaggacagtcctcaatagatggcaacctcataccttcattccaacaaaatataaagaactcgcaactccaatgaggatcaaagccatcatcatcttcttcataatgcctctcctgttgtttatcatactttccctgatatttgttaataatcttagccgaatttacctgaaatcctatggcacgacccccatcggctgttcggccagctgtatgcaccatattgacaggaaaaggattgccatcaactttcatcggcctcttagaatcatcaaatttgattttacctccttcaatagccgcttggatctactgcatgaagaccttgcaattattagtcgtatgaaacccagaattatgccacttgcaataccttttcttgctcaattcttcagccgatggaattgtgtgaccggcaggaagtggaatctgcttctctcggagtagcaagtcaaaaattttgtcagccttggtgatatcaaagtcatacctttcctctttccctgagttctttacccattggcatggtataacatttttacttcttacccatttggctgcagctatctcatcctcatcatccgatccacatacataaggacagacatgattaatctttctagaattatttctcgcctctgcaaacctttgttcatacaaggttaccttctgtgttagatgggacaagctttcaaagtcttcagatgagaatttctctctaatcggagcaatcataccctgaaaagctaaatcggctaattgggcatcagtcaaacttaagctgtagcacttattcctcatctctctgaacctctgaatatactcatgcataggctcatcatgtctttgcttaattgccgtcaaatcagacaatttcatctcatgtaccccactatagaaatagctgtgaaaatgcttctccaaatcggcccaactgttaattgacccatatggcaaagaagaaaaccaagtgaaagccgatccagacaaagacaaccgaaacaacctaaccttcaaggcatccacagccgatgcttcaccacattgagctaagaatcggctaacatgttcataagttgatgtgctatcttgccctgagaactttgaaaaatctggaaccttgaaccggttaggtagaggaactctctcaaaccattcaggatatggctgtcggtataaatttccagcatctttcggcctaagcccaaactgctccttcatgacatctgcgattagatcggcccatggttgttgttgaggcgttccttgaggctgctgtggcatgggctcaaattggttgtactaaggaacaaactggggttgagccgattctgcctgctggtattgaacttgaggtgatggcggctgatattgatagttcaaattgaccccttggtaattctgaagatccggctggatgttgcgcaccaaatgctcggaaataacctgaggtatcaccgtgccatctggttgtacgtgatgaactaagtgctctgggacagcttgatttgcagcatgctgcataggctgaccaccaagcgttgcaaaccaagacgatgcattcattgagccttgctgctgaatcggcagaacaacctgttgcctaaatggcgtctgctgaatcggctgcaaaacctgccgtctcggtggcgtctgcttgctgagttggttccacaacctattggattgggggtgtttgttgaatcggctgcacaacctgctgccttggcggtgtttgctgaatcggctgctgctgggttggatcaatggtgtgttgagggggtaagaacatagatgcaacatggtcctatgttagccgattcacattccgttcagcatactgtggtgtttctctcaccaacaatcggggattaattaattagcctggagccgaaggtggtgcagcagatgcaggagctggtaatggtgccgtcggctgagccgatggcgcattaagtgggatcgactggacaactggttgattatcggtgattaatggccgataattcgggaatactccccctggtaagtaaactggtcctgtagcttggtattcggccattgaaccatcaaccattgatttcaccatgtttgccaaagtattggtcaatattccagattgattgatctaagcatggtgtacagcataatcaacctgatcttggaagttgttgaactgcaactgtgctgtattgccatcttgattagggccttcaccttgaactccctgagtaccatcaccttgaactccctatactccttgagagttatcaccttgatttccttgagaaccatctgaagcacctttgtcactcggttgagccgagccatctggagcttgtttcacctctccgtctttggaagaaccagtcccaggaatatcagcaactacctttaccttatacttctacaccatcgttcccttgcgggtttgcataaatgagctcaagaactggttgcgtgcctgctgcatcatcgcttcaaaatccttcttttgatcgggtgtcaacttgtctggagcgatgttcacgatgttgccttcattaacctcagataggcccaactgctgtatcttatctttaatagaactggggctagctgaggacggtgataatggcggcttgtcatccatgagagaaacctttgacttctaatcggtcccactaggcatgccaaaagcgtgttgacggaagacatgaggcctgggagatctgcttaactccagtgcaggtccaaaactcgccttcgggtatgctagcgtgccagctgatttgatcctgcaatcaacaagaaataatggcaaagaaaccacagttaaacctataaacgatagccgatcggctaagtgccgatgacatatcatttatctttgagccgatgtcatctatatatcgatcggcgggcataaataagtaagaaggaactagatctactcgatcggctgtagatattaacaatatatattccttatatcgatatatacttaaatcaagtgattgggatagatcggtcgccatgctgagacagtatgaatcacttagatcgaaatatatattaataatgggattatatatgttcatagcatagccgatcaaacggatctagtatgtaccggctaatactccaataccactctatactaagatattaaaacaagtataatatatcaaacaaaagtctgatatacttaaatgcgacaagatcttaacataaagggcagatttaacatatcatgaagcatatagggcaaatatagttaaatcagataagatcggctaaaaccccgatactaccctaatcggcaaccagaaggcaggctagagattaatattctaagcacgacttaatagatcaaactcaactgatgcagcattaagtatgaaaagaagaacaatatctagacaatcaagccgctggaagtttcatagagtggtggatatcccatataatctaagtcaacattgatatttaacctaatcggctgccctctactgacagatgttagccgataacaggttaaatagcgatattgccaaagattatgtaagatatatgataactcaacgaattacataaacaagattagagtatcgtaaagatggaagcgctaatcctgagaacgcaaaccatcgtaacaagttttacctcttgttgaagatcgaaaccgatgcagctcaactcgaaagcaagaactatgtccatatcggacacgactcttatctctaacaaactctaagataccataagtctttacggcagacttttgcccgaacatatctctaaggaaattacataaaacatcctaactaatagatacaattgccttctcaggactctatcaatgcgtggcaatcatcttgaagcatatcaactcaaaatgtcacacaccaagttccattgctagaatcggctgtcttggctcacccagtctgactcggactcagccgatcctaatcgtagccgatctggactctagccgattctcactctgtttcaggaccgatttccgcctttgattctgcttcgatctaatcctcttttccaatgcagatattaccaaatttggtcattaacacttgctgcacaaaatcgaccatgaatcccctccaaagatcgttggcaggcaaccctctttgacttagcctccaaggctattttcgaatttctttcactgacagtgggccccacaccccctgggacccacatgacagcctcccactctcccctcgcagcatccaccgtcccccatgcccgatggatgcccaaggaacacaatgagtgcaccagccacctctctctctctcaatcccccactccactcttccttatttcccaagccaaagcaccggaagcaacagcacactccccacactcgcgttccaagtccaagaaaacaaaccccacgcacagaatgcccagagctcggccatcttccccggctccggagacttagccgtcgtcgtcgtgcatccccggtgagtccctctctcttccctcctatggaacgtgacctacgcatcacgccgagctcacccgtaccccttttgccctaggaccaatctgtcgagcacgtggtgggcaccgtcctcgccgccggccacctgaaccgccgacgccgctccggccgccgttcctcaccaccgaagcaacaccaagatccggtgagtttctgtcggattcctcgcgcatgcaccctctgtggctcatccctaacacccccatactctcgaagttgcagttcgcgccttgagtcgacccggcgacgtcgatgccggagttttgccgccgttggccaacaaccaccgtctccgccactccctggacctcgctgcctctgtttctctgcttggtgagcaccctggtaccatatgagagcacatgcactaaccctttgcactaaccaagcctctgcatgcacatgcatgggcataccgagacacaccgccgctgtagctcatgttccatgggctacagaccaccattgccctcaccaccaccactggcggatgcgcaagaacgttctttacattttctcttttgtgctcgaaccgattcgatccgtcgattgccgccggtgaggcgtagaccgagctcagccatggctgctcctgatgtgagctagctgggaacttcatttcttgaatttgatcgactcgatctagggtccaatctgaaaactgccatgactcatattactatagcaggaccttgatggaaataaacaaaatcatagggactcttaataaagtttgctgtccaggtggcagaagaagtgcgggttgattcccccaacttccgagggcctctctgcaaatctcctttcactgtcctgtggacccggctggaattcaatttcgaaaattgatttctattttggtttaaagcagagaacgagcagaacttctaatatttgtagaaaattcattttaacttcaaaaattgtgaaaccacttctgttaaccttctaaaatcattctcagtaactttgtaaaaggaattttgttcatttctgtacaaaaatgttgcttaataaaacttagccctttttaaacctttttaattgtaaaatgcatatctctgtaaataaaaaagtgacaaaataaaaattccttcaccagaaaccacctaagaccagcacacactcactgcataagtttcatgcattttggtttttatgcatttttgtatttatcgtatacgcgtattttgtatagaggaagaatacgtcgaagaagaagagggtgagtttgttgacgaccaggttcaggagtttgcagacgaaggcaagtttgcccctcctttgaccacattgatcctatgttttattgggctaaatgattctattgcaaacatgcatacgttagctagtattaattttggtaaaaaaaattatataaatgtgggaatggtagatatgacctaattgctgcataatccaccttgaaatattgaatccatgctggttgtaaccatagagtgcttttgaatacaattattgtgttctttgggattatactatgcttatattgccgctataaccttatattcggttaccgccttgcaaattactcgttttgataaatgttatatgtgaaaatggttattttgatgttgctggacagaaatttaaatgtgtgagtattgtgaactgaaaatggagataacttgttttttagacttgggcggcgagtggtgtacatatggtggtagttgtacaccgatagggggagcgtttgcctggatcgattaaggaccccactctatgtcaccaactaatgaaaacagtacaaaccacatatgctaagtatgggctggcctcaacctattaagttgtttagagtttagccttgcatcttggtaggccgaagggtatgggttaccgggttttggtaacttatcggaacttcctatggtttgtgatatgatgaaattgattaatgacatgtggtatgtgatgatttgagcgggtagtctgtccaatacaatggtgtcatgcctcgtgagggattccgggctgggttccttacggcgctaggttaaagcgtgggcccgctacctagtggcgctaccttgctagtagcgtgggtaaaacacacatcgtgctggtgcaaggctagacaataaacaatgtaacggtttcgttatgacctctagatcacactcaatgtgtagagtctggtgataccgacgggtatcggacaaactagagcgatccatatcatgtgggcttaaaagttgtacaaactctgcagagtctaaaactaatcgattagccatgctcacggtcatgagcggcatggtgaagtgtcatgagtatagttggtgattttgataaactcttgtgaacttggaaaatggttggaatgttttgtttatgaacttgggtaaagttcggtgaatggtgatgagatgatggcgagtggtgatgatctaccttgagggggtagatgtgtgttatttatccatttacattacaagttttacttactctatactattgttataaaattccgttgcgaaacatgttgtgaactaaaattggcatttatgcaaattaacctatacacagcttatccttgaatatggccaacatgtagtatgctaggattgtttctgacttgccagtacattaatttgattaatgtactgatttcttgctttcttttacttgtttttgctcaaaccccgctgcagttaatgactgtttcgatgaggagtttgatgcagcttgtgatgttgcagatttccaggatggttctaactagggatttaccctagtcggtttgcctatgggcttttgggtagcacgcttaccgcatgaaccaatatttatggcttgtcgccaagtactacttagaaccttattaagactatttatgcttattgcttagaaccacttattattttgatatcatgcttgagatgatttatgtgagactatgttgcattcctgggcgactagtcccacatgaggatgggtttgaaatggttgagataaccagggaatatgcctttgttgagatcgagtctctggggtacgcttttggtcgccaccatcgagtggttgacggccatatgacataaatgactggtgtggctattccaacggttgtcttctatttcatatccaatggcttagagcctatgtagtgcactcttcaagacatgtcggggtctgcgatgaggttggatggttatcgtatttatttgggctttatttgagaccccatccatccagatatttcgcgctgacatgcctcggagcgttgcaccacctaggctttgggacgtcctcacattgaatgtggtctagaggtcataacgaagcctttacattatttattatctaatccttgcatgagcacgatgagtgttgttccacactaagtctagaatcttaatgtcattatattggaggggtctttaccaatataacgccataggcaagccgatacagtcgcttcctatgtggcactcaacgttgtacgtgaggcggaacattacagtcgtcccctcacgcggaacagtatagtcgttccctaccaaaccataaataaaagtgaggcgaaacgttacagtcgtcccctgataaacatcatacacataaaaggcggatcggtacagtcgtcccctttgcataaacacaaatagccctacagttcactcgtagacactatcgctactacaacggcctccctaatgcaaggatagataataaacaacttaatgagctaaggccatcccatactagcacatgtggttgcacggtatacataatgaacatacattgagtgaaaaccttaggtcggtttgggcgcacactccccctatcggtacacaactaatcaccatatgtgcaccacttgaggcccaaacctaaaattcaagttttccatcattttatttgtcaaatacttcatttattcatctatgtccagaatctaaataaaatcatttttcatgttaatatgagcccaagtgataagtaaaatcattctaagcatggctaagaatatagtaaactagtgacaatgtaactcatattccaagtagtaataggatataattactaaggttaggaatgagtgatatggatatatgtggggttaaagtgataatgcaagtaataagagtttgtctaacaagttttacaaaattttaatgtattagtgtacaatcgatatgcaagatttgcaaacattttcaataacctccaaaaacataggatcaacttgatcaaagagagagggaggtgggactttccttgaaactggaaaaaatcagcacctaaatcacttcttcaccgtttaagcaatcatctaaataaagtacacattatgcaattaaacaccgaattatgcgaaaaatccaaaatgctctaaaatgcatgatttgtgcacagtggataggtactggtctaaaatgaatttaggtgaaataatttctattttatctctttttatttgggagttatgaattttagaagtttgcttcggtataggatattatttgccaaggtagtgttataaaatattaaaatatttttacaaagtgattcttattaacttttactccacagagatgtagggaagtattttctaagactaacacatttggtttcacaatttttggagttataatgattttcttatgaattttacaagttataacgtgttgtatgcatataatgttttacatgcatatgtcttgagagctttatatccagaacataatacttcttgattgagttgagtaaaaggaataatttggttaactaatccatttttagttcataagcttatggtcttattatcgtggtttagttcataagcttatggtcttattatcgtggttcatatttttatagactaggggagatctagtctatgctagtacctagaaattactatatgagctaagttcttctaagttttggtggatggggatagaactatggctccactggtcctaataagttttatttggatttatttggagctaccatgcatatatatacttattcatatgtattgtttaaccactattatgtgtttagtacctatactaccaaattaaggtttagagctatggtctgaacagaggttgccatatttcactctactaggttgaagtatattacttgctggttctatagaaatttggttcacttcatttagactaaagatgaattttctacaaaatttacaatttaaggtatgctctatgttggttatcacttacataaatatttagaggcttttattacacagtaagtatataattttatattataacttggaagtatatgttttggtaattctacagaacttgggtttactcaaaaaggatctaacatgaattttatataaacttctaaatttcagcccacagaaaactaattattttgtttatactagttttagagacattaggtacaaagtaagtatattatcttatttcactttacagtggagaataagttggtgattctgtcgaatgtgaatttaccctaaaatgagttgagatgaattttgtatacattttataagtttatgtatactttatgtatgatttatcttatatgaattttagaggctaaatttgtactgttagtggaagtttttattccataacattaaattacataacttggtgagttcatagaaatttgtttcatctaaaaatgagctatatttaattttatatggattttacaagttttaggtacttttcttttataatctcggatttttgtttccaaagggtccactgtcagtgatttgcgaatatgcagaaagacccttcaggttttctaagaataaacccgcagtcctaggcccatatgccattgagtggaaaagttacatattgaatcttggaaaaagtacaaattacccctccgaactatcacggtcgtccgaattaccccctaccataaaaccggacattcttcacccccaactatgcaaaccggacgaattacccccctcgacccaatccgcggtggttttggtctacgtggcatacgcgtggcagtccagtcagcaacttatttattaaaaaataggtggccccacctgtcagttttttttctctctctcctatccccctctctctcttctatccctctctctctcttctccttcagagttcagacgcggcggaggcagcaagcgcgggcaggggcgaggtgaggtgaggcggcagccgctgggaggctgcgtgctgcggccgcatcgacctcgggggcctcccggtggatggcggcggcgcgagacgagggagcggcggacgagcggatggcagcgcgcggggctgggcgatgggcaggcggcggtgcgagacgagtgggcgggcgctggacgatggacgactgcatgcagcggcggaggcgtcggtgcatggcgacggcgcgagacgagggagcggcggacgggcggacggcggcatgcggggcagggcagtgggcagcggcgagggacgaggaggcggcgcgagacgagggggcgggcgcgggcggtcaacggcgcgcgatggcggagcccgacctgggacacagagctggcgggcgcgcgaaatgaggaggcggcggcgacatgggacacagagccagcgtggcgtgggatgcggcagcgacggcggacaggggcgagggcggtggctcgcttgggcggacgagggcggagggaggggaggggtcgcgacgaggagggagatcgtaatggggaggaacatgcacacgacaacgttcgcggtgaaggagctcgacacggacgacgaggagaccgaggagcgggaggccgccatggctagcatcctcgagctctaccgccgcaacctcatcgagcgccaacctcatctaccgccgctaacagccgcctccgcgcccacccgcctccggcctcgtctccttgtctaccgcacgcagccatccttgccgccatccgcccgccgccagcagccatccccaccgccggccgcccgtcggcgtcggctcctcgctagcccgccgcccgcagctatccggcccatccccgccgccatccggcctatccccgccgccggccgcccgtcggcgtcgactcctcgcccgcccacagccatccatgccgccggccgcccatcggcgtcggctcctcgcccgcccaccgcccgccgccggccacccgtcggcagtcggctcctcgcccgcccgccgcctgctttgttcaccgagagagagggggagagaggagtgaaaaagtaatgctgacaggtgggccccacctgttttatttgttttttttttgctgactgtaccgccacgtgtgtgccatgtaggctgaaaaccgctttgaatcgagatcgggttgtaatttatccggttttaagtgtttggggtgtcaaatgtccagtattatagtttatgggggtaaatcatactactgcaatagttcggggggtaattcatcatttttccttgaatcttatagttgtttaaattctcgaaatgaggtccctgtctcagtacagaggcagagcaaccatggctgagctcgatctcgggctcgccggcggcgtttggtggcttggtggggttgaggtcaaaagataaaatgaatagaacgttctcgcgattttattcctcttcgggtggcagtgcatgtgcgcctacagctatgtagtgttcaaatgggtgcatgcatgtgtggctacgaggttcctggagactcactgaaggacacactagggtcggcgatggctggacagtgacgatgacccgagaagagttccggcggcggcagagaatggcatggcgacggcgtcagcttctcctggccttcgggctgtcaaggagaggaggggaatagcttagagagaacctaggatgctttagatgcgaggaattgcgccgaagctctcccaggtttgaggaattgacgacgatggccggcgaccggagttggagaagacggcgatgatctccctcgtcggtgcacgattcttggggattcttgtgggctttagcagaggagttcatggtggtgtttgtggggcagaagctcggcttgagatccaccggattgacaggaacggcgacgcgatccacggcggcgctccaggcttgctccagatcagcgatggcgaggtccgcgttcccgaacgtccactgcatgaaatcgactgaacttaaggggaacggaacctgcactgagaggagacaagggaacggacaagagatcgagacaaccgcggctcaataggcgatgcgacggtcgtcatccttgcggccggcgatggagttatgggcggcggagaagcagggctctctctctcggtttcatcggctcaagagcgagagtgaatgagaggtgacgcggctttgagttttggaggagaagctttcacgctgccacgatagtgaacacgcatcgagcacccttcttgccatcgatctctctctctcgcctgtgcttgccagttgaagcggtggaggaggtaatggacagggttgagctagccttaggcactgtcgagtgggcccagatcgatggaaccaaggctacggagagtgagatgggtagaagtctgagtgaacttgatttttagtttaattttcggaattattttctcctctaactttgtaactccataatttaatgtgtggaccagattaattagtgtagataattagtgtagattttactgatggtagatgtttatatctagattccattttctttggttacacccaagaataatgggtagactgctcacagaaattagacaaagatgggctattcaaaagttagatcaaatttttaggagacctaaacagaagataaaaattctaaaaaatatatatttattcatgataagtaatctagtatttaaataaattatttaccatattcacttatgtgcagttaaatgtacttttggatgaagtatggctttagtcgattaaagtttaatttgatttcttatagttgtctgctttgactgattaatttgacgcatcaaacttagttattaatttgtaccaatattacagtgaatttcttatgctaaacatagtttacataaattttccatgattttatcttgcatagattattttaaagaattagaatgacctttctttgtatatgtgttcctacttcataaatgcatctaatattattatagggttttttattaaacttcttttaagctgagaagatgatatttgagtttaaccttaagtccacatgttatcttctcaaagttagctatagatatgcttagtgaaataattcttttaggttatgctcatgaatcctaacatgagatgcaaaccaaaatccaaatacttaaggacctaagtcaagtcatcctttatgcatatgcgtgcacacatgtatgattgcatttatgctcaggttaggaatgaaaaggctttatttgtttctcaaattttatttatgcaatagcttaggttggtctcaccacctaagttaaaacggaaatttttggctcttaaaattgtagaagttagcttataactattttgccaagaaattttaagtcctaaaatttcaggtatgtgacacataccaggattttcatctaggaaaaattttgaggaaaatttaaaactttttgaaagctaatgcaattgagaatatattagttggtaatagagttaaaatcctgtaaatagaattaaaacacaaagttttgttggaacaagattagagctaagccaaaatttgattttataaaatcttgagttaacaaatctcaattcaaataagttggtttaaccataaaataggaatttaattctttaggttctgcatttctaacctaagcaaaatatttgtgctaaatagaaacaaatggagatataagatttaaaataagcaaaacttaaaatggaaataaatagacttggttgtatgtgcattttattattttaggttttttttggatattcttggtgcatctcataataggtttcatatgcatgtcatttctaaagaaaactcctaaaaataaatcaagcaacaataaattgcaccaaaattctcataaatactaaacaacatcctaagtctacagtaattttagttttaatttatcacatcaattggtacctcaaatagttccaacaactcacctagaaatatggaaaaacagcatatcatttagcctactttacaccttcaccaaaatttaaccataacttatctagctaaaccacttggtcagaatgttaactgtagtatactctaccacctggtgaatgacttaattaaattcaaaatgtaaccatatgaaataagaaccacaagttgcttaaacaatatttagactgcagtcaacatagtaactttactaaattaccatggtaactcaaaaagtaattaaatcttgaaacttggcacattgaaccatcaaatccttgtccactttgcagcaaccttgtctccccaaaattctaaattaaatggaagagagaagagggattaaaaccacatattagaataaattcaacactttgaaaatttaaagcttctaggcctcttgttctatttctctctcttacaagtgggaccaagccattgtgggacccatgtgagatcctcatcacagccaactcatcatctacatacttctcatttaatttatttttcatttctcaaaaggtgagagaagagttaaaatacaattttcaccaaattcataccctacctcactaattcttctaggaagcatctacatggacccacttatcattcacacatcagctatacaccttagttaaaaacactccattgatctttcttttgtttaaatcaaagacaaagaaagagagagggagtataaatcaattttcaccctagaacctaaccatacctcacatcttctcctaggaaatcactaaatgagaccacatgacagtcattataactacattgggtaaggtataagtggtagcacagcctaaaccatgccaactcactcaaaatcgtgtcaacaccacatatggacacctagctttcaccatgccacctcaatcttcaccattaactaaaccgactagccacagcaatattcgtcacaccctcatcgtgttccactaggcaaaacactacgaaacctcggagaagcctagaacatctcattcttctctcaatccgaaggtgtttgatccaatcttagagacctctggtgagcttcgccgcacaataatcatggaaaaatgatctgtaaataatgcctaactcgttcatgtcctttgttttgcctgttgcatggatcgaacatcttgtgtcgagctcgtcggtgtcctcggtgtccagagcgccgccgctcgttgcgccgccgttcccgtcgatctcgtccatctcagagcaaaccgctgcaccatcatcttctccaaggttccaggaggaggccatccaagcgaatcgcgctgaagagccgccgacaaagagatccttactttcttcctcaactccggccaatcgccgccgtcgtcgattccttcttctccggtgagctcaaaacaaattcctcgcatatggagtatccctatgacctagctaacaccgagcaatcgcatgcatggcagctcgttgcgggaattaagctagcgtcgtcttcccggagtttttgctgccaccgccatgtctctacgttgtcaggacctccctagccctgtgcacggtttggtgagcttcttggacacccttaaacacacatgcatgcatcgatttgtccagggcaagctcataacttcatatgtatcgtagccttgaagccactgccgctcgcgctgcctccggcatcaatcccggccatcttcggcgacaaggcgaacatcgtcgggtgcgcaagagcctggcgcacttttctcattttgggtgcgacgtcggcctcgccgccgttcgccgccgacatcgacgtcaagccgccggccggtgaagctctgatgctgctgctgtttcctcctctgccgagcctatgacaggttgaccccacttcattaagcaccaataactgtaattagaaaatagtttaaatcggcggccggtcacatttagcggcggccggtccggtactaaccttctccggtcgtgtgtgttggcgctgtcggtgtgtgggtggtggtttttattttcctttttcctgattacgaccctctagggttgtaatcttgcaattttttccttctctatagaaattcgcaccgtcttgtgcgagccgttaaaaaaaagaaaatagtttaaatcatgtagggttctatttgtaaataactagagcatgacatgtgggacctgaatctaattataaatatacaaaaacttgagcactcttaatgaaaatagaattagacatgtgctagggacgtcgggacctaatcctagaaactccagggactattctgcacattttcctcactgaccggtggacccaatccttttaaaatctggaaaacagtaagaaaaatactcaaaccaataattgttcaacagaaaaatgaccaaacttgtaagatgcatataaaatccattttagcccattttgtgatgaatcaaatttctgtgaactcacaaacttatgaactttaatttagaaacataaaacttggcacttacagtagaagaaatagctctaataattcacataacaattaatgaacatagagcaatctctaacttagaaattcatataaaattcatcttaacttaatttggagtgaaccaagttccagtgtgctcacaaaatcatacgcttgatttacatgaactaaaacttgatacgttctgtattaaaatcatcaccaactatttaattggtaaaataactaggatggtgtaaattagaaactatcaaatccataagtaattcattttaactccaaatgggcaaaactaaaatttttttagtttcatggaggcatgtacattagttctgtaaacaaatcttagaagaaaacatatctagaaacatcactaaaacttgaataatgagttaatattaaagaacggtttagaaacttctgaaattcatatcaaaatgaatacaactgcaaatgaagtgattccagttctgttagattggcaaaatcatgtacttagtttttataaattaaaatatggcacttacagtacccaaaacttgtataaaatttgaaatagttaacaactactataataaatcacttagcttgtaaaattcataataaaatcatgctaactttaaaaattatgaaaccaattttgttgaactcctgtgagcattcccttcactgcagcaagctagaatttcacaaaacttgaccctaaaatgcacctaaggactactagagcttaattgatctagtgctagtattaaactttgaaaatttataactccctaatgcaaagtaataaaatataaattctttcacctaaattcatcttagaccagtacctaaccacactagtaaactcatgcattttagagcattttgaatttttatatgttttggcatttatcgttaccgttatttcttttagatggtgaattcgttatcagtgaggtgattggatttatagctaggaaggtctcatatcaaccaaggcaagtgttgccattcttttgaacatattgaatcctatatttttgggctaaatattttgattgtaaagttgcacgcgtaattctgattaacggtactttcaaaactatagattgtagttctacctttaaaagatgcatgaatcccctttttaaaatcaccccttgctgttttgaaccttaggattaattagattactttaattgtgctcatatgagtatgctatgcttttataaagtgtaaatgcttagccttgcctagtaataaataaaaacatggttatggatcacttattatacttttgaaaacccttttgaacattatggacagaggtgattctctgattatttgtgaaataaaatgagataaaatgtaattttagacttgggcggcaagtggtatgcatatggtagtagttgcataccgatagggggagtgttcgcctgagtcgattaaggaccaaacatgatatcatccattgtgtttaccgtacatccacatgtgtctttatggggggatcttggcctattaagttaagcacttgtctaaccttttattcgggaggccgttgtagtataggtaggggccacgagtgtactgtgggctacctagaggaactacccatgtgtgtgttgaaccttaggacgagtgtactgttcctaagtgtgtgatcgtaggatgataaattccctacgtgtgtgatttccatgaggggatgagtgtactgttccgcctcatggcatgggcgtctaagtctgtccaatacaacgatactgtgccacgttggtgggttcccgttgtgtccactaccacggcgttaagtttaaggcgtgggctcgccacttaatggttctcagtcatataacgtgtatggcctaggatggaggaacacgtatcgtgctcatgcaaggttagaaaatacttaatgtaaaagcctcgttgtgacctctagactagagatgaaaacggtcggaaatggtcggaaacggtacattattttattttttttttgaaaacgaacggaaacggtcgggaaatctccatatttatgaattcatctatttagtgccaacttcaatgccacattgacataaattaaaaaactaaattttgaaaacggtaacatcggtaaaaatattattattatattagttttgccgaaacggtattggtacggtcgggaacttttcataccgttttcacccttactctagaccgtactcaatgtgtagagtatagtggtaccgacgggtaccggacaaactagaccgattcacatcatgtgggtaaagctgtacaaactctgcagagttctaaaaactaatcgattagccgtgctcacggtcataagcgacatgatgatgtgttatgtgtataattttgtgctttctaaatgtttttaaaactaaatgatttgagatgatgataagattgatatatgtgatgtgattgccttacttcccgttatgttgtaagggaatgatgtctatctatgttgatatcatgccatgattaatatgctttacatattgcttaaatgatttgcttaaattgcgttacaaatggtttgccaactaaaattggctttatgctgaaaatagagaccacaaatagccttcctttgacttagagctttcatgtatgtaggttcgatagtgcccttgcaagtaatgtactgagtcttgccatgttttgtctaatttatgttttgcaggaataggcttagtttaagttgagtgatgcgggtttcgactgcttcttctaggatttgaacttaatggggtaaacccctagtcggtgtgcttgaggattgggtagtcaagcttccgctgttctctgatatagttatatttggctggtcggcctattgttggtatttcttaacgacatcactagaaatataatttccagcaatggcgcagaaatacttctggtatattatggttacagagttcatccgcaagcgcacggatataccattgtagcatttcacccgagagtattccaagggtatcgtatttattttatcctgtgggaagatcatgtagagagagcttgactaataatttatatattacttgtgataatcatattctaaacaggggttaagataatccaagggtagagtgacacaccagcattaactactcattctcataataaatcatctaagctaagtggaaagaaaagaggaagaaaatctattcctatacttctaatatacatagtatacatacattctagttaattgatatactagctaataccctttatccgatgctctcctggtacttcgagaagccatccctgactaccgagttccttacgacagcccgttatgaccatacaaccgaggctaaatacggaggaataccctccccagggaattaacttaggattatataccggcgcggaggaatacccgtactgagctgtcaccatcagcggcccacctctcacccacaatatataaccccaaataatgatatcccgtaatctagacaccacgtctaaactaccagatactactctaatatcatcgtcatgacatagagtaattgcataagcaaacaatatacccgcaccaaagcatctcccagataagctagccgtatatttagtataacatgaacataatataaagtaggcattcatatactcggaaagtatttcaataccataaatatatttagaagagtattctaataaaagtacaaagcttacaaaagagaagagaaaagctactagagccatacctgaactcttccgaaggcttccggactcctgatttctactctattcctattccaccagctagatactactaaactaaacttgagagaaatgagagagctattgcttgaggtgtgtgagtgaagtgagaatgagaactccttttatagcctcccaataacggttgtgacggttggaatggtcggaaataccctccaaccgccattgggggctaatccacaccgtccaggcgaagccctggatcggatggcgctggttcggtcgaacctggggccgacccaatccagtccaatttcggctggtagcctcctccgttgttcttctatgcagacttgtgaattttggcccagtttgtcacgtcaattctgagttcttggcccattcatacataagtctggttctcaacatcatccgattgatttatcatttctcctccactttattatcattctctacaaaaggttagtatacctaatactagtggaatattattattctaacaaacatatgcattgcaagcatcactagttctcgtctattttggtaatattgacggtcgaaactgaaagataacgaccgtcaacacctatgtatctatttagtagttgtaatctaaattttatttgctttagatgtattttgctatgtatattcatgcttgagatgaaagtgtgaatctagtgcacatcctgggaactagattcacatgagtatgagttaggaatatttgagatgttgtagatcttttgccatttttgtcaaatctcctgaatgtgtaacacatctggtcgccacctttgagtggtttgacgggcatatctcaggctgaagttgaccggcaggctaaaggcccagcaatgtctccaatattcctctctcgaggcgtcggatatttcattatgcttgtttgatgacttgaattattcatttcatctctcaattataatggaaggtccggagagcctacgacagtttggcccatttggaggtttttaattgggtttatgggtccaaaactccttaagttcggatacgagtttgattctcatcctccttcatgtatatttcctctcaaccttggtagtttatcacctgcatacgaatatacaccaacactcatgaaaatcgttagaaataaaccccaccactatgttggatgttttatatttattgtttatgcagatattgacggcgttaatttggtacttaacagccgtcaacaaacccccacacttagctctttactcgtcccgagtaaaggttacggattaatgtggaataaaattgtccaagatataatacaagtacaccaatcattctaagccatacctgtacctgtgaacttttgaagtgtctaacttaccatattgggcaattgatgaatggaacggtcgtgactcaagtcctccttattcctcctgtcaatcttttagggttttcatatattttcgcaaagtagctatactcctcaaatgaccttctctcaaatcactcatgtggttttatttgttgatcctcaccaaggcatgtttgccgaattgtccctattctaaaggctgtataggtggagctcggtagggatcaatcagggcatacatgcatcacatatattgcaaagccaaaataccggatccaaggagatagcaagtcatactctctgatcaagaatgtgcatgtgtgtgatatgtgtatggttgttttgtgggtagaaaaaggaaaataaaagatgacaactcctttgatatacctcctctaattttctctctttggaaacttgagagagtgcatggctatctcttttttttttctttttctttcttctttttatcatgcctcgtactttgtatgagcaatattttttttcttctctcatttttatcaatgctccatatttgtatgagcaagactttatttttttccctatttttcataaccatgcctttctctctctctttttttttctttgaaagaatttcggaggaagaggcataaatgacatggagtatttattttatggataatggataaaataaatgatagatgagagatgctaacttccagtgtagaagtttagcataatgtgtgtatgtggagtgtgcgtgcgatcttgatcatgaaagtatgaaaagcatctcacacggatcacaataatttgacaaagctcaatgtaatgacatgcagcctaaacatatacaaggtttttgcaatgataatcatatatggccttggaaggtaataatatagtcactgaggagtattgctcgaaaaagttttaattttcacaaaacaaaatcctaagaatcatgacagttggacaggaatttcttttatcataaccatatcacatatatcaattacttagattagcaaggttccctatgatagatggttgttcacaagtgacaagtgttagcaaagaataaaaagtatacatgatcaatcataggaaaattctatttgttgagagttaatgttttgaatttttatttggagtcaaactaaattgtattcaaattttctgccaagttaactcacaaacatgagaggataagggaggagatgcgcaaacatgaccacacgacagaagggtgacagagccgggccatgcaagggtacggtgaacacttagttcagccgacccaaccaggacctggttctgagtgctaaactttgtgcgcggccgtgggctggtgttcatcatattatcatgttgagtcgatgttgttgcgtgtcgggagttcgaaaaagactcccccacacttgttttgtaccttgtctttattcaaaaacatcgaaaagaaaaataggcttccaccggggtaaagtaccggtgagccaaattttattcaagtaactctaggcgtatgaagtgcctaaatttattttattttattccacttttatttttttatttttttattattttttatggcaacaatgagcatggtggattccctagcagggcggatatatgacgcaatgatacacagggtgtttgatatttttaccagatcggacttactaagctttgaaccgaatcgactgtaacaaagtattgcatttgctctgcttggttccctgtgcatctctctcataaaccaaggagcatggtatgggtgttagagttattgtatattgctccttagttgtctctttttatttcctgcaaaaagttagtggatagcaaatacccgagggactacaaatatttgaaaagattttatcatagcctcaagattagttgttcacatccatgctaaaaaggaattggattcaaaacttaataagcatggatcccataaaattgccataattttattttttttgttattatttttttctttttactcgagagacattttttttctttttctttgaaaacaaaattttctttttttttcttttttttaatttcttttttttgttgttcaccaaattttcatttaagcaaaactcatacagggctaaggtaaatttacataacatagcaaaggagcatttggcaatatacataccgtgcaccttgagaggtgatatgtttctcctttgtctgttttggcaattgatttgttcctggcccttggcatacctccagtgtgactcgtgcttgagaactcacccatcaaattgaaaaatttcctgcaggggttagtccacgaaggatatacatctgaagtccgtgaaagtactggctctagggttcatttaagcaaacttgacaccacgtcaaatttgattaaagcaggctatttatcctaagcatcatgcttaatttaaaaagcctatgaatgtcgacgaccacccaaaccatagcatacgaaaatagagtaaggacgcataaccatgtatgatcaagctagactcaattacagataagtatgagtaaaagaaatggtgaatcttttgctgtatacctgagtgtacttaccgccagtatgatgtatatgttgaaatcccttggagcgctggcatggtcacatgtgattgtcgatctctcctccgtcttgatgcggggtgtggaggaggaaggcactttgaccatgccaattcaagcgagtggttcggttatgcacacatctcgggtgcaaaaaccttgtgccttgaaggcgtgttccgttggcacaatgttgtagagatgtaggatgcatctcttcttggcaaaatatgcaagtgccaactggagtgtagcagcaaacacctaggaaagaagaggacatctcctctggcttaaatgcgtgtaggtgctgcgggagcgagacgttgtgcacagttaggagtggatgaagggtaaaccaaaccggcacatgagctcaagagaggggctgggtgcagtcaggcagcatgatcgctactagcgaggagtatagccatattttaaagactcgcacataatgcggtctttgatctagatgtagcccaacacccctcttgctctcttcctcttcttccatgtttcatttctttttttctcccgtctctcttttcttcttagcaaggtagaactaacaccaactacaaagcaagatggccttggttgatggaactcgtcatgcaagctcattggcctccccttacacttggacttttgtgtcgcaaaacattaaaaaccaagtgtgtgatgttagagtcttcataaagtgtgtttcaacaccaaggatcaccaaaatgtacagttgacgtagctcccgagttcttaggcatcatacatccctcgttcttaatgtcaacctgaaatggttattgaccaagaatacccgaaggtgcataatatcctaaaaactggttcttccttttattggaaagaaaacttaccaagataatccaaggtatctcccggcagtgctttgtttatggtcacaagctcaacctttgagacatctcactgcaagattagtgccacaaacacatacgagatttgcaatatttatgataaataaaagtatccacaaccacacttctaatcatgttagaaatgaggaccataaggtggttatggttctcgcacaaggaagtgatactattcggacagaactctgaggattctttatgtgagcatgattcctgaggaaatttgaaagagaaactttcatgctcaaaagtgtcgttctcatcctccagagttgatgtctcaaggttgtccatggcctgcagtttctccttctcaagagatgcatcgtgcaagaatgaggttgtttcttgacaactgtcgagaacaacatcttgatggcaagagggacaaggttcaggctcgataggaggttgtgatggtggttctttggagtgcaattcaagagtctcgccataatctttttgaatgaaatgaagatcatcttgttctagaatagattcaggggactcataaagcagaaccgccattacttcctctatcggcgtattattaggaagatgaccgtcaagattttctcataataggtatgaggatcatccctgaatttagaagcacaacccggagcttgaatttctttggaatccagtgatagctccagggaggactctttagtcagacccgaagctgttgaaggctcgggttcaggctttgcaaaagaaggttcctcccttcctggcacaaatgcctctagatggagttcaacacactgcccgacaaaggatgtattttccgctatgcgatcaagaatttctttgctttcgacgggagttttatgcatgaatgaccctccagccgttatgtcaaggtagaatgcagactccctatctaaacccgtatgaaaatgctgcaatagcatgtaatcgagtatagacagggttgggccagactgaactaaattagtgaatctggactaggctgcaccaattgattctttatttatctgctggaaactcaggatttctacacgaagagtagtaatacgggttactaggaagaaggcaagacagaatctgtctcgcaacttttcccaactaccgtttacacatccaacggtagaggtgtaccattgctttgctctctcttgaagggagaatggaaaaaatttccaccgcacattttcttgtctcatgccacgaatcttaaggcacgagctgacttgctcaaagtctcgtagatgatggtagggattttctagatcaaagccggaaaatggattttccctcaccatactaattagttcgggacgaatttcatagccagtggtataaatgggctccgatgaagaaggtggctcatagaattcgtcccgaggaacagacaactgttggtatttcttatgatcacagatagaatccgcaagtggacggatataccgatgtagcacttcccctacggagtattataagggtatcgaatccaagggaacatgtgtgctcagagcttcctccggttcatccaaggacaccaagcaaatgataggccaggatagagaggattcactagtgagaaacagtgtctagggaaagcttaattttaatcctaacgcaatacttcaggcactggcaacccgctgttccgagatgtcgctctactacatacccggacagggaggacttcagtgatctcgagggctatcaccacctctacacccacctcaacgtactgtgggatacgcaacaattactggataacaattacctacacaccacgtctaagcaattactatctactttagtgtttataactcaccaaagcaatcactatattttagttgattatagtgaacaataatcccgtatgctaattaggaactaaccaagaggttattcactgatgttttgatgaagttcacaacccctccttgtatggatgcaaaattctcctcactttagtctgattttcctcccaacaccaaggtttatcatctgcatacaaatatacaccaacacttgtggaatatgtgagattaagcacctatcactatgttggatgttttattatctgatctttatgcagatgttggcgggccaacacgcggggagcggatcacccggcggcggcgtatgcgatcagctccggaggtgcaagccttcggtcggcaacgtagtagccatcctacgcggggagcggatcacccggcggcggtgtatgcgatcggctcgaaggtgcgagccttcagtcggcaacgcagtagctgtcctgcgcggggagcggatcacccggtgtcggcgagtagtacccaggcaacgaggggtgtcaatgttggtatttcttaacaacattactagaaatataattcccagcaatggcgcagaaatacttctggtatattatggttacagagttcatccgcaagcgcacggatataccattgtagcatttcacccgagagtattccaagggtatcgtatttattttatcccgtgggaagatcatgtagagagagcttgactaataatttatatattacttgtgataatcatattctaaacagggcttaagataatccaagggtagagtgacacacaagcatgaactactcattctcataataaatcatctaagctaagtggaaagaaaagagaaataaaatatatttctatacttctattatacatagtatacatacattctagttaactgatatactagctaataccctctatccgatgccctcctggtacttcgagaagccacccctgactaccgagttccttacgacagcccgtcatgaccatacaaccagggttaaatacggaggaataccctccctaggaaattaacttaggattatatatcggcgcggaggaatacccgtactgagctgtcactatcagcagcccacctctcattcacaatatataaccccaaataatgatatcctgtaatccggacaccacgtctaaactaccagatactactcaaatatcatcgtcatgacatcgagtaattgcataagcaaacattatacccgcaccaaagcatatcccagataagctagccatatattcagtataacataaacataatgtaaagtaggtactcatatactcggaaagtatttcaataccataaatgtataaagaagagtattctaataaaagtacaaagcttacaaaagagaagagaagagctactagagccatactcgaactcttccgaaggcttccggactcctgatttctactctgttcctattccaccagctagatactactaaactaaacttgagagaaatgagaaagctattgcttgaagtgtgtgagtgaagtgagaatggcaacttcttatatagcctcccaatgaaggttgtgacggttagaatggtcggaaataccctccaaccgtcattgggggctaatccacaccatccaggcgaagccctagatcggatggcgccgaggagggttcggccgaacctggggccggcccaatccaacccaatttcagctggcggccgcctctgttgcttctatttgcagacttgtgaattttggcccaattcttcatatcaattctgagtgcatggcccatttatacataattctggttctcgacatcgtccgattgatttgtcatctgtgttgatgtcgattctcctccactttattgtcattctctgcaaaagattagtatacctagtactagtggaagtttattattctaacaaatatatgcattgcaagcatcacttgttctcctctattttagtaatattgacggtcgaaactgatcgataacgaccgtcaacagtcaagcccccgagccagtggcgaagtcggcgaagaccacccggacgatgaatgaggcgaagcccccgagtccgtggcgaggtcggcaaagggcacccggacgatgagggaggcgaagcccccgagtccgtggcgaggtcggcgtagagcacccggacgacgggggaggcgaagctcccgagcctgtggcggtgtcggtgcagagcgcccggacaacgagggaggcgaagcccccaagtccgtggcgggtcggcaaagaacacccggacatcgagggaggcaaaatccctgagtccgtggtgaggtcggtgtagaacgcctgggcagcaagggaggcgaagcccccgaatccgttggtgggtcggcgtagagcgcctggacaacaagggaggcaaagcccccaagtccgtggcgggtcggcgaagaacacccggatgtcgagggaggcgaaatccttgagtccgtggtgaggtcggtgtagagcgcccagagaacgtaggcgtgcaccagacgaagtcgagccgcgttagtcacgcgagggccgaagcccccaggtgtgctgcgtcgtttcccgggtgtagtcgcgtgcgcccggcttccgcagacggactggactttgtgcaggacacgctcgattagcggcacggccaaagcccactgtgctgcggtgaatggcttgatctcgatctccctttgtacatgcgtacaataggataaacataagactgaattagtcatagtaataatcaatctgattagaaatcaatttaattagcagcaaggagattagatgcatatgtcgtatcctggctccctgcttgtcccttggcatgccaggcatgcagatcgatctgacgcattggctgtgcatgctagggccagtgcatggctgtttcatgcgctgacaggtttgcatggctgtcgtggtgatgcaatcttccagggcagcagcaggtccatcccggccagtgcaagcgcgacggcggctcagtcagtgatcacgccgacgaccagcatgcaccatagctccgctcgcgaaagtagccatcgatgcccatgcataattatagatcaatctacgttagttacttaaaaaaacaagatcaatctaatatacaagaattcagaatgtcaaacccggcgaataagggatcatgcgacgaatgccgcatagccaaatccatgtgagctggccggggcaaagcccccggatatgcggtggaggcagtgtagccgaatccatgcgagccgcaccaaccacacgagggtagaagccccgggcatagaggatcgtagatgccgccagcgacatgcatgtcgcttatcttgtgcatggcagatcctccaagcatgcgctcatctcgcgcacgtcgctcgtctcgtgcatgggcatcatgcgtggctgtgcagggcagcgcagtgcggcgcacggggacgaggcggcagtcgacgggctgcgccacacactgtgatttcctgcatcgccttgcgctgcgcacgtcatcaacgatctcatcgaccgtggcacctggtaacgtcgatgattgaagccatctcctccttgaagaacacgatctagcgcccccctacctggtgcgccaactgtcgatttctatgatcggcaatatattttacggggtgcgcaagatcaaggagagatggtgatgcaggtgtttatcctggttcaggccctcgagaagaggtaataccctacgtccagtgtgtttttctctgtatttgggtggaaaaatgaactcagaagccaagagagaagaaggtagaagtctcggaaatcctccggcctagggaccccttccccctcttatataggatgaggggggagggttacaaggaaagtatctagttgattgcaactagatcctcctattccatctataaagatatgcatgatacccgagatttatatcttatcccggaaatctctctttctttatttacaagtatgccgcaggggcctagcacacttggcccaccccatgcgatgcggcccaaggtttgttgttgggtacctgggtatcgtgtaccccacagctgccacggcacacgcgatgggttgctgcttgtctgtgctgagagttctgtagttcggaaaaacacccccaggcagaaaaactgggccctgagtttgatgctcagctatcgtgccgtcaaccatagatttgatcatgtaggtcaaaggtattgaccagcattcccgattggttgaccaaagcatgatgaacggtgtaatcaacctggtcctgcaaaagcttgagtgcctcgagttcttcctcccgattgtcgcctttggccttgtcatcattggcggcacttgtttctgtgtcatccttgtttgacagaactaccttgtatttatgaaccatagtgccggagcgagttggtgcgaatgaatgcagaaatcggtttgcaagtcatctttcatcttctcaaattctgccttctgctccggggtcaacttgtccatcattatcgggatgacattttctggatcgagctctcctttcttgaggtttgccaacagttcacgaaagtcggtcccaccaagcgtgccaagaaagcgtgttgacatgaaaaacatgcactggcctaagagatctgcttaactctagtacaggtccaaagaaattgcctttgggctctgagcgtgccagctggtttgatcctgcaaccaaaaagatagaaaaagaggcaaagagttaaatccatcaacaatagctaatcggctggattgccgataacgtatcgtccgaggccatgcggatgtaacttgcaggtcccaagaaattgccttcgggttctgagcgtgccagctggtttgatcctacaaccaacaagatagaaaaagaagcaaagagttaaatccatcaacgatagccgatcggctggattgccgatgacgtatcgtccgaggccatgccgatgtaacttgcgtcagatcggcagaggcagataaaaacttggagattgttgggtctactcgatcggctgtagatgtcaacgatacgtaatccatccaatggaacatgcttagatagagtgattgggagatcggtcactgcaccaagacaagacagtataaatcacttaatatctaaatgcattccaaagtagggattatgtatgctcacagcatagccgatggggtaaacctaacgtgtatcggctaatactccgataccaccttataccaagataccagcgcagatgaaatatacaacactgaaaccaatctaacgagcaaagtaagctagcaaactgataagaagcttaacatactttaaacggatgagatctcgatataaggggcagatttagatgatccagaaccaaataaggaaacaagaagactaaatcaggtaagatcagctgaaactccgatgctatctctattagtaatcaaagaaagagctagatagaacgtttcaagacagtacttaacagatcgaacctaactgatgcaacattaagcatgaaaagaaacataagatctaatcaaattgatgaaaactcatccaagatggtagatacactgcatagtctaacttgatatcgaagccaaaacctatcgaccgttttcgatgatagaggctagccgataaagcttagatgacgagatcaatctagattgtgtggtatatatgataactcggcggtttgcatagacaggattagagtgtcatgaagatgtaagcactaatcccaagaacgcaagccgccatgacaagatttacctcttcgtcggagatcgaacccgatgcagcccaactcgaaagcaaaaactcgtcgaaacaacaaaaatagaaaagggtggcgatgcaccgaagtaaactcgtcgaaacaacaaaaatagaaaagggtggcgatgcaccgaagtattattgaacagtcgtcacttgatttcatggtatcggatcatatttatacccgaagtacataacatgtccttgctggatacgactcttatctctgacacaacttaaaatacgaatgagtcctttaggtggactcttaccaaaatatctctaaggaaactgaaaaatgtcctaattaatagatacaattgcccaattgcccttttaggactccaatccttcctaagactggttgcatcagcttggctccgctggatctgatgtttagccgatatgtagcagccgattcatgcggtagccaatgctgcttgtaagcgatgcgtgttctgctttctcgaactgaacttccccaaatcggctttgactctagcttcgaatccgtcccatggcattaccaaatttggtcgttaacatagacttcgaaagatcatattttgatcacacgaactctgaatcgacccgttcaagtctcttaatttttgttataacctaaagaaccatgtgcctttcttttatgtactgttattgcttctttataggcttgtagctttgcttgtgtgcttcgcgtagctcctgtcgttccgcaggttcctaaagcgtggttcgtggttgtcgccgaaggttcggaaggccgttctctctaagcaaggcaagtcgcatcatccttgagcatattgaatcccagtttataaaattattttattttaatttattgcattaccgctttatttaaattcccgcgttctcactcttttatttagcattacctattaatccttgttatagcctcatgattgatattgttagtatcaccttgtttaccttaggaaaataaaaccctaactagtgggaacactattcatggttccactagtataaacttaggtagatgcttggctggttaatcaggcaacactaggtggttttataactttagactttgggaattctcatatcatttggacattatggaatggttggcttatgtggaattggacacacacctcccactctattcaaaacccccaaaatggttctaggctgggctatagtagcacctcagccatcataaggaccggtcttcgggcctctgttgcaaagcactaccgtactaaccacatgtctaatgggtaaggcttaactcggtgctcagtctaatcctgaacaaaaaagacacagatggagatggctgaagtcgttgcgatggatatctctgaggcaaatgaaggctacatgggcgggtgttcggtagtcaagatgtcgtggcacaggtcacacccggtggatgtcctgctgctaggggctcaaccataacttacctgtccaaggggttccggccgtaggcgggtgttgggtcggtgcttttgtttacagctaagatgggtaaagggttatgtcacatttttatgacgggttccaaggccatggaatgcggcgtaaagatgtgtcttatgggtaaagttgtacacctctgatcagagtataatctattcgaatagccgcgccctcggttatgggcaggcctagcaatgtatccaagttagtggtttaattcttaaaacttacttaacaactaaaatgaatgtttggtctgggttggtttgggacaagctaggacctgggtttggttgtcagttcggtctaaatcatcgtaggccttgggctaaggcaggttcgtgtgggttcacggacttaattaataacactgtgtagctctaggattgtgtttataaaacagctttgagcaactaagtgacttttaaatgctgtttactgtaaaacctaattactcattgtaccctttgcattaatcatgcatcttccgggtgacttgctgagtaatgtggttgtacttattcttgctctatctttttcccttcagtaagataagctctggagaagaagtcctgggtggagtcctggcttataccccagttaagtgtctgtaaagataaagccgtaggcccactaatctgctgttgtttattttcgttgtcacggggtattttctagttatctgaacatgttatccctctcctgaaccccagccccctcgcgccgggaccttatccctctcctaaacccccaccccctcccccgaccctttcccgttcctccttcctccggccggtgcggcgcccctcccctctccaacaatggattcttgcgctctcttcctctctaccccgcgaccacctcctcctctcgtccccgcgcaccgccgccgacccctcgcgagccgctcaggcctccgccgccgggagggttgcccctgcagctgcgcctcctcctcttcctcctccggtcgtgccggttctcaggaccgcccgcccaggccttggcagcagaagcagcggacgcagcgtcccggccgcggcgaggccatcgacccagtcggcttcctcgccaagcacggcatctccgaccgcgcgttcgcgcagttcctccgtgaccggtacgttctccgagcgtctcgtatggcagggtgcaacctccggtttcccctctgctaaattcgttctaactggtcgactgatgccttgactgggtgtttgtacacatctccttccatatattgctgacagatttgcctgattttccaaaatggttgggatttttgtacgcattgactagctaattccccctaccgtcagaaacaggaggtggaagtggttgtgattttgtcaagaaatcgttgaattgcttccttggtagggtgggcttgatttgcgtgactagttagttatccatcagaaaaagaggtggtacttttttttttcccaaatgagcacagcctgtttgcatgcggtgagggaaagtgggcaacagctgacagccattccagcttcttggtggtgctggcgaagtggcaaaaaaacccagcttcttagcaccagaatcaggctgatggaagttccatagtttcaaattaggtgttgaactgtagatagaattatggaaggaggggcaaggtatggagatgaaccagaaggttgatgaagtacagccagaaaaacaaggagctctgatgaagtaacactgcgagaagggagacaaggaagccaggaaggagagttgctgctaagcatgcaacagaccagcctaaatatagcagtttgtgcattgattccatgatagaacccagcgtgtgcatcataaaagcatcgtatcagtaagatcatatgtgaacagattctctcatcttatctcgctttttattattaggtacaaagctttgaaagaccgtcgatgggagctgcactctcgtctaattgatctgaaagaggcatcttctgggtaattatcctaccatcttggcatctggttttgttgtcattcttgggttctttggtagtgtgatgtgcccattggcctgttcgtgcttcttcttcttttttttttctgtttttctttttgctgatataggtttgagttaatgggcatgcatcgacatcggcagcaccgtgtggatttcatggagtgggcaccaggtatagattatcttggagacaggtctgcattgctagtctgttatacggccataattaatactctctccagtcacaaaagaatgtcatcttaggatgcatgctctcaacacaactttgacaatatgtactgtttaaaatgtaggttttgggcacatgaaaatgatataaccaagtttgtgataacaaaagcttttattacattacaactgtcacttctttttagatttatgcaaaagaactaaatatttaagattctcattgacctttaaaagtccaaggcaacatccttttttggctggatggagtaaccttaaatcttgatatatgtgtatgaagataaataacagaaagcatgtttaactaaatttacaagatgatgtgaaaattgtcatggagctatttacaactcttgtgcgataatattcttaatcctttgctcttctgaacaaaatgatgattgcattttgctgctatgtccccagcagaaccagctttaacacacaaaggctgtcatgatcatctgtatttacaattgtaacacatcaacatgtaatctgttatggccctgtttcaaaggtcggaggataaaaaataggcagctcgtccttggttcgctggccagagcttctccctccactttgtctctaagattctgctgatctagactggactgggtcaatggtctaaccgatgggtcaacagtcggatctcatgagccatactgtacttttaaacagattttagagaatattagcctagttggttatccaatgcagtgtgaagcgacaggtcttggatttgaactgagcctcacacgtaatttttagatgctccacatgctgcatctgatattgtgggtcggcagaaatgacctctctgtttgcttgggtgaaaaaaaagccattggttgaaccgggattttcctgggtcaactgtacaaatggtcctgattactggactggtctaatccaggccatcatgttggtgtggctcttataactatgcctattagagcaggtataatagggccgtaccagtaggccacgtcgattttgatggtggctggaggggagagagagcacaagccggtgactaattagtcactggctgctcgcgcgctcctatttagacgcattaaattttcgcccagtgcagcccatgctgatgctgcaatccgtgtgggttccagccttccaggcagccgacgatgccaagtccgcggtgtcactaccttggactggtcctcgacgttggcaagcaacaagtgaatggaatctcattatctaaaaaacaagagaatggaatcttgaggaggaactgaagaagttgaccagtaaaagagaagatgcgctggatctgagataggaaggacaccacaggttgagggagctgggcaatccagagctttggagctccgcggctcacacccaagcactgtggcagcgtgctcgtcccacttgttaccgagctcggtgactgcggatggcccatgtcccacggaatctccagctcaatggtgctgggctcggaccctgagctagtctgtggcgttcttgtcccctgtctatcaagatccgtgctccaaaactgctccgatgagcctgtaacaatggaggtagaaaaagagaaatggaaggaaagatggagaacgtggtgaatgtgggcccataaagtatatgttggatttgtgctagagctagctgttggagtagttggctgtatgaatatctgtagctgacatggaagtatcacactgccacacagactattacagtaagcagcgggctatattattagacttgctcttagagaagtgggaaatactataggatttacattattcttttcttgctcaatgaaaaaagaaagcatcctgcatactatgcgatgcttgaccttactaagagatagaaatactagagggcataaagtttatgcaaaaagacgacagcatcctaaagaactattagataacttaatgatgtaaacgtcatagttttctttatacactagaaagcttgaaatgctcatttaagcaatacctactattttgggtttctttcaattgtcttatcctccccaaattaggttttccctttgtatctacattactaacaactgctcccttcgtcccttatacactctaattttagcctaagaatttctcccacaaaggctttattaatagagtgggttccactagaactctttaatgctacttcatccttttcttctcgttttagtcatcataccagtaaaactccttcctcttcattctctctgcactaatgaagggcatagtagtcttttaacctcctacttaatctgtctttgactagccgaaagtacaatcttttagtgatggagggagtatctcttctttcatgcaccgtttttatcaacacgaacatatctgccactttaagatataatcttattcgacaatcaagatgctactatgtgatttataattgatatagttctgggtattatgtcctgtttgtgattcttttttgttttaacattaactgagtatgtgttacatttatttacagaaaattgtaatgtcatgtaggtgctcgttattgttctgtagtgggtgattttaatcagtggtcaactactgaaaattgtgcacgcgaaggtcatttgggacatgatgattttggatattggactatcatacttgaagataaacttagggaagggcaagaaccagatgaatattatttccaagagtacaactacgcagatgattatgacaaaggtgataatggtgttgatgtggaagaattgatccacagaatgaacgaagagtattgggaacctggagaaattaagtcacagaagtctcggttagaggtggttgctaagctatatgagcaaatgtttggtccaaatggtccacaaacagaggaggaactaggtgacatacctgatgctgaaacaagatataatgagtggaaagccttgcagaaggatgattcagcaagttcgttgccttgctatgatatcattgataatgggcaggagtttgacattttcaatgttgcaaccgatcgagtgtcatttgaaaaatttcaaggaaaatcaccacctcttgcttactgggttgaaatgaggaaagggcgaaaagcttggttggagaaatatgttccagcaatttctcataaagacaagtaccgtgtttattttaacactcctgatggtggtttggaacgcattcctgcttgggctacttatgttcttccaggttctcccaacttatcattgtaatgatattcttctattattatagattggcttgcaatacatgtattgtcattgttactgtaagtactgcagtttgtctcagtacaatgctgacttaattgaaaaggtagtaaatgacgatacagatttagtaaaagatgttgtcacatttttttttattgctagatcttcataaatggctacaggtttattaatgattattatcattggtaattataaggtttgttgtgataagctgacatgattacacaagttgcatgttgttttcttgcaaagatttttctttagtttgtaatattaatagttctactttaaatagctcttgcactttgcacatacattattagattattttgttaaatgttaatgccatctttacttgtcgagctcacagctctcgtgttcaattttccaatccaggttaaataataattcaaaattctagtttttgtgtagatgctgaagggaagcagtcctatgcagtacactgggatcctcctccagaagaaatttataaatggagatttgaacggccgaaggtcaaaggttcacttaggatatacgaatgtcatgttggaataagtggatcggagcaaaaaatatcgtcatttcaggagttcacatcaaatgtatttcctaacacctgcctttcggtgttttgtggttactcttaacttcattatcaacttttgtttcttccattaggtcctccctcatataaaagatgctggctataatgctattcaattgattggaattgtggaacacaaggattactcttctgttggctataaggtgagaatttactgatttaaacagcatattgtaataatatacaatatttctctgtggtctttttctgtagcaaagattggagttcaaccactcggtagcaataatatcacagaatataaccccataatggattctatcaaaccttgctctcgaacccatcatgcttgtaatcatgtagattcacttatacttgggtggaatcttgttaaaccatccttttccttgttgccatgtaattgtttacccattcttggtaccattttctctgcaatgtgaggtaaccttgttcctgctgtcaggtaaacactttactgctttgagtaagctatcacaaacttcaagtcaactccactggagttccaacaagactataaagggctacccttgcccaaatggaagttaaattcaatgaaccattaaaatgctggctatgctgatcgctgataaaatcaaacgaaatgtggtgtaaccttgattctacaattggaaacatacttatggtttacacctttacacttaaccacactgagcagagtgatgtactttgtagtccaaaacttcaaatatatctaagtgtctgggaatatatacagtgtaaaatgagatttttgaaatatattctgctataccatacagtcagacaataataatgaacatcgtaaacttttacaaactaatatacatgggatctaatgatgcttcagataactttctagctttcaggaggtttcgggagttatggaggaaaaaaactattcgttgtaatcagagaatttatgttgttaaaataactgccacaatgatttttctccgatgtagaattacatccagaagctacactgtaaatgattactgcatttataaacaatagaaatcttccactgtattcaactctttttagaatattccatttctgtatagttgtcttagaaaaaatgtgttgtatttgcaggtcaccaattatttttcagtcagtagcagatttggctcgccagatgacttcaaaaaactagtggatgaggcacacggtttgcttctcaaatataattattttgagcaacaatggaaattcacacagtaatttaaaaactcatgcttattcatgtggtagtcctgagcttactgcacgcgttatatttgaggcaggccttgcacaaaacgttctttgcattaaaatattttctgttttcttgcttttggcaaagttgaatttccaggtcatagtaaaaagagtatcgcattttggtatgtctaactgtgctactaggtagtgcaaagtgcaatttactctaaaaataacaatgaagtctttgtgtttgatatcttcttggtgcttttcatgcattctgttatgcatgcaagtttgaaatatcacaagtggcatatctgtagcaaattgtcctataatttggtagcactatattatgaagtgaaacagtcacaagaattaacatctgtgccttttcacacccttgtggtttgctcaggccttggattagtggtgcttcttgatattgtccactcctatgcatcagcagatgaattggttggcttatccctctttgatggttctaatgattgttacttccacagcggtacgtaacattatatctactgctttttgttccttattgtaaactttgttttactgaggattatatgtagaattatatgtaaactctttttctgcttttttattgtattgtttcaatttgtaaataataagttttcattcaccatgtttgctctatggcaaatgtcttaccacgactaaatgagttcaacttaataaactcaagaaggaccatcatccttgctcataggagccaaatttacagttttgtttacaaacatttataggtgggttgaactgcttaatatgaggaaagcatcctgttcttgtagaccaagattaacttgataaataattgggtaaattggatccatgcaattgtaaatttgcctattcagataaatggcattaccatcgtctatttgtagctgtgccactgaaattttacaaaattaagaccgtgttactgccatcacattttccatgcttctccttttttttttttagttttcttcctttctcccgtcgtcttccctctcctgtcctctcttccttactcgcgccaaacaacgctcggtgtagcgagggccaaggaggcgacggcgatggccaagggcgcggtgacaacgtcctcccggatctggggtggccggggactaggaaggtggcgctcgcagaggcctggcccgcccgagcgtggggtggtgtccagctcaggttgctagaggcggcggcttcaaggcgctcgtgctaggtgccggtgacctcgaaatccaagagcgacaaggtggtctcctccgcttttgtgctcgttggcgggtgactacctctgcttccatgctcgttggcgggcgacctattgtagcgtcgacaaggaaggggacgttccggacctcatgccgcggccgctcgtcttcgatcttatcccgctggccggagaggacggggttcgctgtctggatctgccggtacaaatgggagtgagtcgacgacaacgatgacgatgatggctcttgagccctcgcgcccccagcctactcaagcacaagctcgccgccacctgccccgagctccttccgccggccgaagaggatggaatttgcaagatctagctcggtggagacgccgacgccgcaggagcagagactaagggcaatgatccccggccccatcaaccgccatccttcttgctctaccccttccccttcaacagtcattgctgatgccgtggagctcctccccgagggagccagagcttgccagccagcgtggtcaacgcaagaagatgggaagagagaaggaagaagatggaaaaaggagatggaggaaaacgtgatggcagtggcacggtccgtcttatttgaaaaattttgaaaaaaattaaaaacaaaagtcacgagtaaattactattcatattttatcatctcataacaacaaaaatactaattataaaaaatttacaaataagacggacgatcaaaggtaggcgtggaaactcatggttgcacttataatgggacggaggtagtaatattctagtggcacggctacgaatagatgaattgtaatgacatttatctaaataggcacatttgcaatggcatggatccaatttaccctaaataatttggtccaacagcagtagtaaaagttaaaacaatagcagtcaacatctagcataatatatgataggttacgttggccatacacaggaaaaaaatcgtgcaatttcctctcaacttgatattcatattgtatatattgcatgaatttaatgattagttggtagctgtttgacctgatttgtgccctgtgtacttgcctgttcatatggacaactgattggtagaagtaacatactgatactattaagtaaaaggcccatgaaatttgtactgacatgcctagcattaatgtttgttgtcgaatggacaactatgccacgtcgaaaggcgtggttctctcaacagcagttggaatgtaaaagcaattgtattgattcgtgaaatatttttggggatccccccattacatggccctagaggtttatttatagccttagcacaagcttgcaccttctagtgtttagggttacaggggattttacatggttgcccttatgaaagggacatttacatgggtatgcagtgtcatttgcacatatgggcctttaatgggctgataggctgggcctggtctatggcaaacgggcctaaaaggccgggggcagcctgttgggcctccttgatgccgaactcgtcatggcgaagtctttgtagtttgcccgagatgcctttactttcggaataccgacgcggctttccagccttcgccatcttcgcttatggctttcgccatagggcttcgcctgaatggccttgacgtctttggcttgaatccttgatggtactatagtttcggcaggtccggccgaagggcttcatggcatgcctccaacaagcccctcacgggcaagagtgagtaaggagctttggccgagaccgtgcaaactatacggtatggcatgaggcgtcccctttcggccgatgttcctgccgaaacctctttttagactcctgcagaaaaaatatgaacactggcgttcgcctttcgagaatggcgaagctgtattatgacactgggtgattatattttgccaagtttgtctgctttgcgcgattcttgacttgtatttttttctttccccttttccctattgttttagcggggatttcgccgaaactcatgcgttcggcccccttttggggattggcgaaaagatttgttgacttttcagctttcgacttccgttttcgactcgtagcattttgcgttgggaaaaacgcttgtgttttgcgtaagttgaatgtaacggcgttcggtatctttattccgaaacaagctgtcgcggtttcaacgttcggcgagcgatgcttcggccgattcgtttcgcccccctggcgttttcgtcgatcaagcgttcgccttttatgtagctatgtggttgtcaaaatggcgaattggaggcgaagacatcctggtcgaaccttagaggattacgaccggtgccacatccagcgccacgatgccattgccttactttggttagacttcgaaatgactaatcatcaagttgttatcgcttgacgtcggtgtgtatttcgcttccttccccccttagagtcgtgtatagtatagatgaagaaccgtgttcgcgggacttagtaggggcgaggcaaaaatgttctgaaacggatgatgtaattttttgctcctttgtataacacgtatgtgcttttgcccgacggagcttgtgcgtgtttttatgtttcttttcgctatcattgcattttgtaacttgtacgttcggaagggcaaggcctgtcggcccccttgcgtgttagcgaaaggaattcacattgacttttcagccctcatcattcgctctcgacttttggcatgtgcgtccagaaacgcttaagtatttgcataagtcgagtgtagcgacgatcggtatgttttccgaaaacgagctgtcgcggtttcaacgttcggcgagctgtgcttcggccgattcgtatcggccccctggcgttttcatcgatcaaatgtttgccttggggtttttccacgaaatatcatacacaaaaatggcgaagacacccatgaattttatatgactaagcgtcagtttgccattgcccagcgtcgacgcagcattatccccgtttttccttcttcaccgctaaatttttttttgtgttgatctaacaactagcgatgaagaagatgctcaagggggtagtccttcgccatttgaggactgcttttgttaatgaatcggatgtaaagtccaaatgccttttggcgggcaatggaatttatctgtaactttgctttttggcaaataaatggggtgtggtgcgtgttacggctgttcggctcgtactttcccctttttgccttttggcaaaggtatttttaggtactatgatcgttttgaccgttgccggctttcggtctttttagcacttcgacctttttaattgttaccggcttacggtcatttctttagtgctgctagggttttgtcgttcgtcccttttggctgccccgtttgtctgcgggtgtgcaaccgatgcgaactcgatttcaagttttagcccctcgcacatttccttggacttctcggagtcaaaccgcttgttattgccggtaatgaactctttcggcataccgaatcggcagaaaatgctttttcgaacggatttttacactagtgccgaaggtactgccttagcccatcgaaggcggcttgacactcaggtgtccaattgagtttgccggccccttggagcatcttgaaaaatgataaatctctttcggttgctcttgggagcaactccttaactcattttcgcccctagcccttgtcgccgtacctcgctggtactgtggcgaaaggcgtgggtgtggcgaaacctgtttgcccgcagcccttggcgccgtaccttattggtactatggcgaagggcatggcgtgtggcaaaagctgttcgcccgcagctcttgacgccataccttaatggtattgtggtgaagggtatgggtatggcgaaaggctccagaggctagggtggcctcatagcccctgagcttggaagcaactcattttcgtccccagcccttgtcgccgtaccttgcgggtactgtggcgaagggtgtgggtgtggcgaaaggctccagaggctagggtagcctcgtagccccccagcttggaagcaacttattttcgcccccagcccttgacgccataccttattggtactatggcgaagggtgtggcgtgtggcaatacaccgtgcctcgtgtggcgaaacctcttcgtccgcagcccttgacgccgtgccatattggcactatggcgaagggcgtgggttggcgaaacctgttcgcccgcagcccttgacaccgtgcctcgtgtggcgaaacctcttcgtccgcagcccttgacgccgtgccatattggcactatggcgaagggcgtgggttggcgaaacctgttcgcccgcagcccttgacaccgtgcctcgtgtggcgaaacctcttcgcccgcagcccttgacgccgtgccatattggcactatggcgaagggcgtgggttggcgaaacctgttcgcccgcagcccttgacgccgtgccttattggcactaaggcgaagggcgtgggtggacaaaacctcttcgcccgcaacccttgacgccgtacctcattggtactatggcgaagggtatggcgtgtggcgaaacttcttcgcccgcagcccttgacgccgtgccatattggcactatggcgaagggcgtgggttggcgaaatttgttcgcccgcagcccttgacgccgttccttattggcactatggcgaagggcgtgggtgtggcgaaacctcttcgcccgcaagcccttgacgccgtaccttattggtactatggcgcaaggcgtgggtgtggcgaaacctgttcgcccgcagcccttgacgcagtacgttattggtactatggcgaagggcgtgggtgggcgaaacctgttcgcccgcaccccttgacgccgtacctcattggtactatggcgaagggtatggcgtggacaaaacctgttcgcccgcagcccttgacgccgtgccatattggcactatggcgaagggcgtgggtggacgaaacctcttgatgccgtacctcattggcactatggcgaagggcgtgggtggacgaaacctgttcgcccgcaaccaacctcttcgcccgcagcccttgacgccgtgccttattggcactatggcgaagggcgtgggttggcgaaacctgttcgcccgcagcccttgacgccgtgccttattggcactatggcgaagggcgtggcgtgtggcgaaaggtgtccagaggcttgggcggcttcgtagccccccagcttggacttaactcactttcgccccaagcccttgtcgccgtaccgcgcgggtactgtggcgaagggtgtgggtgtggtgaaaggggttccatttcgccttttcggtctgggttccccacggacggcgccagctgttgtcgaatggacaactatgccacgtcgaaaggcgtggttctcatgtaaaagcaattgtattgattcgtgaaatatttttggggatccccccattacatggccctagaggtttatttatagccttagcacaagcttgcaccttctaggatttagggttacaggggattttacatggttgcccttatgaaagggacatttacatgggtatgcaatgtcatttgaacatatgggcctttaatgggctgataggctgggcctggtctatggcaaacgggcctaaaaggccaggggcggcctgttgggcctccttgatgccgaactcgtcatggcgaagtctttgtagttcgcccgagatgccttcgcccgagatgcctttactttcggaataccgacgcggctttccagccttcgccatcttcgcttatggctttcgccatagggcttcgcctgaatggccttgacgtctttggcttgaatccttgctggtactatagtttcggcaggtccggccgaagggcttcatggcatgcctccaacaatgttgaatgctgcatgtggtttgacatgttgtattatttaaatttcatatgttctacacatcttaaatttcgtatttccctaagactgatttttttttatgcttctttgctactacaacatccttgttgtaattgatccttggcaggaaaacgagggcaccacaaatactggggtaccagaatgttcaaatatgatgatattgatgttctacacttcttattgtctaatttaaattggtaaaatctaagcatatgctttcatgctgctgtcttatgttccgaatactatcaaaatttgattcttttctgttctataatctaccagtaacttaaggacatctggctaattttactaggtgggtcactgaataccgtgttgatggattccagtttcactcactgccttctatgttatatactcataatggcttttctactttcactggtgccactgaagagtaagttctacgctttcactattttcctaaaacattagtcactacatttctgcagtatgttgatgttctacaattttccagaaccatatctgctctttataatcttaaattcttaattgtaggtattacaatcaatacgtcgatgaggatgcgctgatatatttaattatagcaaatgagatgttgcatgagcttcatccagatattataacaatagctgaggatgtaagttgttgttatacttggtttcttttcctgtaaatttatgttcacgtcacataattatcagttttagatatgcagtttggtattgagatatagttatcaccaatgtgcaacttggtactgcccttcggttgcaactattgtaacactgagatgcctgtctaacagagtcataggcatacatgctttctatttagtgactgtaggtcgctatctctacctattaaaatggatactagttgcaatttccaaactaatattgtgttagtttggcatgtgttggtccttcagttttttttacagtgttttgtttatacaggcaacattttatcctgggctatgtgagccaaccactcaaggcggattaggatttgattactgggtcaatctttcaattcctgaaatgtggttgtggcatcttgaaaatgttcctgaagcaagaatggagcatgaataaggtctgcatgctatctaaatatttttgcatgccatcgtttgtgtggcaagatgtcttgggaattcagggtttcagtttatgcattattttccttatggaattccatcttgatgattatatgccaggacaatggttttccaaatctccaattatagtttccctgcatttgttattgttgaagtatcatatttcttatccaatgactatcttggactatgctgtcacagattatgagagtactagtaaacaacaacagtaatatgctatcttacgtcgaaaatcacaaccaggtgatactatttgtctaattttgtctgttgctactaattatatcatgttattattactgtaatctcttcttactgaaagaaacagcacagatcctgcacatggttgagaaaacatataatgttaatatgtattatatcatgcttagaaacagcaaacttctatttcaccatagtgtaatattcttttaccaagtcactttctgagaaacttgaccaatttgattaactgtgtatagtgcattttgctactagcatatggtagccatttttatcctggcatattgggcttaatcgcaataaaagtctcaattatttcactagtgataattcttgtatattgacactgtacctcatttccttaaatttagagatttgttcaattatctctctagggcatggttttttccctgaacgtaccttataatgacatatgttggtgctcttttcttaagatgcatattttggtgctctctgcttagacattgctgaatagctggctgtatcataatattgtgagattggtttgaacaagggcatgggcagatgtgtaaaactcatgcttcattgtcttttgtactgatactatgcttgcgtaatgcatatatgtccatgaatttcagaatcctagttatgttttctggaatcctaatcaaatatttttggaatccttatggagggacactctacgtggttttctgcatgctgcttctttactttataggaatctttagatgtgtattcatgaaagcccaaacttgggaaaaaaaaccccaaatttttttttgagaatatattcattatttattttctcaccaaactttgggattaggttctcacatctaatattttggtacagtcaatatcagggcggaaatcttttgctgaaataattctttatgaaggaaagtgttcaaatagttctgttgacaatgatttgattttcagggcttcctcattgctcaatgtatgactatccctaacttgtaattttaatattgtatactttgattcattattgcacctcttaatttctttggtatagcccctgtaggaaatgatgaaaaatatttagtttacatcgtcagttctttgcatttggtcagttctttgcatttggttatggtagtgtcatgaacttagttcatgacagggaaaacattagttggaggtaggtcggatggcaagaacatgatcaggtggcttctcatagctgcccctaacatgtgatactaatagatatgctaacaaacaagagataagcatttgatctgaactaattttaagatgaggaaatatctagatgagaagcattcttgccttgctgcgtggctggcccagtaactagggatacacataggtcgactcgaggtctgacccatggtacccaaggtgataaattacaggccgggtcaagctgacccacgtatctttgcttgacccattgactcatggaacctcatgcattgacccattgaccctgaccccttgtgcattcaggcgcagcttgcaaatcaacgcacaaaccagcagatcccatgcatgcgagcaaaccaattgatgcggcacagagaaatgcttctgaaaatctgagcagacaaacacaatccgagcatataaactcatacatagcaaaccaattgctctgaattttttcactcaagaatggatctgaatacaatcagatgaaaatcccacacttgacctatagcagatggagaacaatctgcgcgcctagcagtgccaaatcgatccatctgagccaaccctttcttcagtggtagccaggaacaatggcgcagggccgagaacagcgcagggacgaggtggtaggacaaagcactgggaggtgatgcagatggcggcgacggctgagcatctgtgcatactcagtaggaggcaggtgggtcgacccacctctatatggccatggtgggtcgacccatgctgacccatgaaggccctgtttagtacccaaacaaaaatttttcaccctgtcacatcgaatttttagacacatgcatggagtattaaatatggacaaaaaaaaaactcattacacatattgcatgtaaattgcgagacaaatcttttaagcctaattgcgccatgatttgacaatatggtgctaaacatttgctaatgacggattaattaggcttaataaatctgtctctcagtttacaggcggaatctgtaatttgttttgttattagtctacgtttaatacttaaaatgtgtgtccgtatatccgatgtgacatgccaaaaattttcattcgcgaactaaacaggcctgaaatttgatgggtaaacccatgtgagtttgaccccatattcccacgtgcatccctactagtgacctgctacacatagagcccatgctccaagcctatgacagtagcgcactgctgtgtgtcagtgcagatggtgaacattattggccacatgctggtcaggtaaggttgcctgaattattttggccaactttaatcttcatagcctcaaatccaacctagctcatcctctaagcaagctgtagctcagctggactggtatgagataagggacctctgtgtttataggctttctgtatttattttattttatgacattccttatcataggaattgatgagcaataaattttacgttctgccaaaaataatcttctttcacatgtttcagataatcaaactaattacttttacaacaagtggtggtgcatatctcaacttcattggaaatgaatttgcacatccaaaggtgaggtacctacattacattcagaatttgatagccttacttcaatttcaattttgtgagcttgatctctcattttttgcagtagaccttctaagcattttttgttattatttcagagaattgagtttcctatgtcaagcaatgactattccttctgcctagctaatcggcaatgggacctgctggacaagggtgtccataaacatatattcaactttgacaaggtatgtaattacaagttaggaggcaaggaaaacagtctttgctgaaaacatgtgacatctgttaacatgtaatctctgaatcagtactattagtagttcttccttagctagtaagcatagtataggtcagtagaactttttctttctccaataagctagacctgctagtaagtcacgtatgttttccttggtcagcaagtcaagtagtcttacacagtaagctttcttagccaacaaggtggtgtttgaatctcctgaagatgaagattaagtgtttcacgcaaaatgaggtggtaataacgtgtgattaattgagttttaattattacaaacttgaaaaatagattaatgtcatattttagaacaactttaatatagaaagttttcgcccaaaacgcaccgtttagcagttcgaaaagcgtgccacttttatccaaaagtttatctagtttttgttggagaaaagtctagtagctgctgcctccacatgtactatatgtatgccaatatgcaatgcaagctaagcttttcagcagcacataatcaggttttcagctagactttaggttaccaaacatccagttttatcagcgggtcctaaaatatttggatttgtatagagaatcaacaccctttattacagaaaatgagctatacatgttgaccatagagacatttttgtgtttttgttgcattttccccaataaaacaagttctgagttgaaaacttttgaacaaaatggtctgatttatttgtcacaagcgtcaagggtgaccccccacaccccccccccctaaaaatgcactgtagatagtagatattgtacgactcatagggcataggaaaaacaagtcctggatgtcctttctggttcttgataccgaaaataagtttttaatgaatctgatgtttcttcagaatttgttttctattacaataacaaaagaatctcttttatatttcaactattgatggctggctcaaaacattgttgtgctatgaatgtgaatgatttgaactaacacgtaccaatttcatcccaggatatcatgagcttagatggcaaagagaggctaatttctgggggttcacccattgttcatcactgtgatgacactagcatggtatgtacatcttttgttaacagaagatcaaacctattttacaaactaataaaggtgatgctttttttgttcttttattttggtaactttatcattttaatcatagtattaattataaacatgcataatgttggattagggatagagaaagcaaatgtgtgaacaattgtaccttttagccccaaaaatacagtatgttgtcataccagtttaaaagtaggcaatatcagtagaagagaagcagaaaggtggggaaactctccctatacttaggccttgtttagtttgcgaaaagaaaatttttgggtgtcacatcgaaccggatatcggacatgaatgaaaaaactaatttcataactcacctggaaaccgcgagacgaatttattaagcctaattaatccgtcattagaacatgtgggttactgtagcacttatagctaatcatggactaattaggctcaaaagatttgtctcgcaatttccatgcaaattatgcaattagtttttcattttatctatatttaatgctccatgcatgtgtttaaagattcgatgtgacgtttttgggaaaaaaattttggaactaaacaaggccttaaaatgccctttaacaactatcatccctctaaaatgcgtagcatattgcaataccattgcatttgatagggtttccaatcaacataaacaatccgtagtccaaatcttgaaaaattgaaattgttgttgttgtgtgcaactcttagaaaaatttcatgtagatcttttccacttcaaagattattgcagaaacaaacttggtgttatcctagtccatagatcataataaggtgttttacacactgatttactgaggagagtgtttaacatatgctctgctttctttaaagcttccatccataaattatctgctaaactagagtgggttagtatactccgtaccaagtccataaggttataaagttatacctttcagctgctccatattattgagatttgtcaggaatggaatattaaaccactattccattttcttcaagatacttagtcaaagagccaggaattgttcgtaaggtgcattttccaatgacacaataaaaaacatcaaggcctgaaacgggaactgaagctaaattccttctcatggatgggacatagagaacattatttagatgaaggatgaagccgctttccaaactcaatgaaagttatcca

SEQ ID NO: 14332 - DNA, 39918 bp, Oryza sativa
  unsure (1)..(39918): unsure at all n locations
caatataccgagtaaattgcatcgttggtacacgaacttgttaggtgggtttaatctagtacacggacttgtaaaatgctcattttggtgcataaacctgtctggtgcgtgcggaggaaggcgaaaatgacactacattgctaatcttattgatttagggcatatatctgagaaggttgctattagatatacacctcttcaataaaaaatagaatatgatatagtgatactagaaaatgattaaaaaaacgagcaatggtataaaggttagaaatatatgaaattcatcatttccatggtgaagaataaagtagagaccaaatttataaatattgaatgtcctatgcatactcactacacgtgtgtatgccacatcctaatcaacatcacttcataaaattaacattatcaagttattttggttatcattcgcacgaactagacaagttcgtgtactgaaacgagcattttacaagtttatgtactaaattgtacctacctaataagtttgtgtaccaccaatacaatttactcgcaatataccattacccttcttggggagccactgatggaagccagcgcaatccttattgcagaagcgacaggtcatgacagttaggtgtggcgggagacaggtcatgacagttaggtgtgacagttagctaatatgtgtttttagccatatgattttgtggcatttctttgcatgggtggctggcaggtcagcaaagtggctgccctacttgcacctatagcatcaagtgggatgcccacgaccctgcaggtgtgcagccgtgtatgtatgaacttgaacatgtcggattgttgaagcgactagttagcatgcacgtgcaaggcacgttttgacatatactttactaacgattacaaaagtagagcaatgagtgtggccattttctatgcagtaccctccatatgaattctccgtaataacagagtttcatttctacgcttccaagtaaattcttcatgataaagagagtttcgtagtcactccattctaaactccaacaagatataaaatttttctcgatttccgttagtatgttctttaaactgctaaacagtgtgtttcgtgcgaaaactttctacataaaagttgttataaaaaaataaataaatccattttttaaattttttataattaaattttaattaatcatatgctaatgacttgtcttgttttggttgcgcatttaatcttcatccttgttgaagaatcgaatgggacctaaggtttcatacaaagatgcatccacgccaaagaatcacatcatcatggttaagaatgcatcccccacatcatcatatcttatggttaagaatgtaaactgttcaggggaaacgggtgttgtcagtgtgttggtaaacatgaaaatcaggaagcatagagcataaaggtttgagtttcaacaaagttagctcaataattttgctataacagtgagcgtaagcttcaatttttcatgtgaacttatacagtcaattggatgataggcagttaaacaaattatccatgccgggattagattaaaaaaatcaccatatactgctctgtctcactgcaatgattagtcatacaatatatgatagatgcatttttcacacataagtaccagcaaatattacagtggaactggccgaagtgctaaacatatcgtgcatgtcagattatgatgcattctaatatgataggaagtgaacatatgagtagtaaacttgcttgcatatgcctacaatgttgccactgagttcagggaaaaataaacgtttcagttaggatgaaatgatcagaaaaaaaaaaccctaaacaaaggaaagatcaacaaacattgaatgttggaacggtgttgcccactgtaggttgttatgctttctcgacctcaccaaatagacctagaacgtaacaatgctttgctccctatccaggaaagccagagaagtaatataatccaacatctctaattgtgccaagagattgccttggacctggcacacatggaaggatagtaaatggagtattaatccctacagatataggttgtttgcagcaattgaagcctcacatcatactacatttgaagtcccaccgacctacatatgtaatcacagccagagaaagataaaaaggctaaaataataataagcaacacttgcttaatagaccgcagacactggagtttccaaacatggtagcttccttacttgaaacaacatctacatgaactaaaattgaaagttctaacaaagagaattgttcaagacttgaattgtatacctgtagaatgattgagtgctcacaagtcataggagagtcactatacaatttaattaatacctgcaggatatagtactatagtagatcatatgctttcgagacaattacttctaaaagcagagagaagatatcgatactttctgaacattatgagatatataagatatgtttcttaacatagatagatttctccaagtgagccaccatttaaccttgagtatcaatcaatctacacaacgcattgtataagtcagcctaagaacttaggagattaacatgccctaaaattaatggagagataactaccgtagcattacttttttctacaaaagaataacaaatatgaccttcttttctcagcatcagcactacacagaacaaaaatagtttgaagaaaataggtaaaacaataaatctgatctcctgttctataagctgaattcacccaaaattactgcaaaagatgaacatcatcatcatctagtgcattcagtataagtttcattattcaaaaaaaagagagataaagatgtaaatatttgtacaatatacaatttaaatgataatcgtactgaaattcaaaagaccacaatttcatcatttatgttcccacacctaaaaaaacaaattatcagatttttcaaatctgctagctcatattatgcttaaagtgatacaatattgaacaaagatccaatgaaatgagttgtgcatgcccaatatgttgtggcaacacactgctacattcaagcagtaatattttatttagaagagcaaagaacaggggagactgggaaattttcatagcatgaaactttgtaacacttgagatgcaccctaaattttttctcactaaaaaaagtttcagtgtatcatctcagctctgaaattaaccaatacttgatgttaaattaacatacctgtgtaagcatcagaaagcataaaagctatggtagttattcattcatgtatttctagagcatttatttagagcaggaaaagtgcccatatgttatttaattagcatttcacattttcaaaattcaaatttttagtatcgaattacaaaatataagcacataatcttactgtcatcaccaaagtgttcctctccacttaactttttgtatataccagtatagtgtggtgcaattgcagtaaatagttttattgttagcaagctaaagcagaggatgcaacagcaattattttattatagagccagaagccacaatataattctaaaacctaatttggacacaatgtatttttgctctagcataaagaggatgaacaattcacctcattgtcgatattgttgtagtccactcatttccattagacaaaccaattgaatggcattcattcggttcctgtgacaccacaatcagaatgtgggcatgtatgtggttttagtttaattcagcagagaggaaaatcatatgtatacattaccagaagttagcaattgaagaccttccaaaatctaagatgaaaaccaatgggtacatctgagatgcaatccaatgggtaaatctgagattaaaaaatgaaagttaatcagagcccattatccatatcaaaaccattctggactttggtgaagttataaaggaaaatataatttcagctggaatccagcaatatattataaggaatgacatgcatcttttttattatgattgacagagggagaaatcagtgtacgatattgtatacttaactaaaaatcaaaggtcagctaattaaaaaatataaccaaaacattcatgcagatttataccgttggactcaatacttcagcattttggtaatcagaatctgggtatgtatactggctaaatgaaatctgagggatcaagcggactgtaaacctccacatgaaatctgccattggcttacaacaaattcagatagaaatgaaatcagaataatatttgtgcttaccttccaaatccatcttgaaatcagcataatatttgtgcttaccttccaaatccatctcttctaacatcagtgctttcagaatgtgtctggtaggagagctcttttgatattaatgtagaaattgataatatcccagaagagaattggtagcccaaactgagtctgctaacattgattcgtagcccaaactgagtctcctaccagtgagaatcaatagcccacacctttcagaaacccgctgcatatgaaagtctaaatctcacaacaaatgagcaagttctgacatcgatgcccaatcaacatcgaaggtatacacaaaattgcagctaactcatggggaatagctcaggaccagtaggcatggggactggggagtctcgtgaatcccttcgacaccaggcacccctccacagcgccacccctcatccacttcgtcagcgctagagggttttgtcacatcatgagacagcagtggcagcggaaaagcggaacagcgattcggccgagggcgaccggcgcgacatcttcacatggtggcggcggagagcaacctaggatgtggcagagttggatgcggtgatgagggggcgcaacggggtggacgcctcatgacgatggtggcgcagtggaggcggtgatgggtccgacgtcccagcattagggaaggtccctcacaaggcaccatcgtgagacaacggcggcggcagcggcggcaagggaagagtgaggacgacagtgggggatcggcggaggcgacggaggtgggaaaggagctccgtgtcgcagcgtggcacacgggatttggaggatgcggggcagcggtaggagtcatcaaggagcgagcgcgcagagttatcgtgcgggggcgagggtgtgggcggaaagtgtggtggagaggataaggtcgccgaggatggaatcggattgatggatgagattatttggcttaacggatggatggtagggattgatctagttgatttggcctgtaggattggaggggtacaactcctcctttttatattagtatagatgtggggtgctcacgcgatgtgggagcctcatgaactctgtttgtgctgtcatgaaggacaaagagttcccctagttcaacatgggtgttggtagaagctgctatcctgcaaatagtgacacactgctggtagcggctgatttttctccctgatttttctcccttgatattgagttgacggggttaaattggactattttccttatctgaaccggtctttgtacttgaaggggtagaatactgtctcacaggggattaagtagactatttcctcgtttaacaaagtatcaatattctgatccacgtaggcacctgaactgaccggctgatggggcttatcacataagggttaagtacacatgttgcagagggaacaaaagggaaaaatattgtactcttgagttaaatcatgttatgtctgcattcagttccttttttttacttcggtgttaattatagtactcatattgcagatcatatattttactagaggacctttcctttttgttttcaatttcaatcctgacgcctcctatcagctctattctgttggtgtggatgaagctggtgaatatcaggtaactaatgctgtttgtatgaacttattcttttgtaaatatgcaagtggcaggcacatataaaaatgttggagcacctgacactttgataaataaaatgaatatgtaaaaatgtaaaaactactcgtagtgatatttttaccaaaatactctctttttttttaccaaaatactgcaggtgaatttctacttttgtttctcctcactagttttcggtttaaaaatgtattttttttcctcgaaaaagcaggagagctgcatttcatttcactaaggggaagaaaaaaacaatacaaaaacacaacacaaagaaaagcaaaaaaaaaaaaaaaaattacaaagtaggagtacccgagccctcctaccgagacccacacatactagactacccggggaacttagttgcctaggttagccgtcccactcaggagcttttgaaggcaagaagctccagcaacaccccaaagatggccctcgttttctatcacttgcaagactgttgctactctaggattggcgtcgttgaaaatgcagtcgttgcggtgcttccaaatctcccaagctagtaaggttaccaaggacttgatccctttcctcacctccttcagccggttcttggttgcttggctccaccacctcagaaagcggtcggtagagggctgaggcgcagcctcggctaaccctagtctcaagaagattgccatccaaacttggcgagaaaaaacacaagagatcaaaatgtgttggatggattcttcactttgatcacaaaggggacagatcactgagtgttgcagcccatttcaaaaatgtaattacatagggtgacaagagaaactctatcaactcttaattttctacttcttgtacttcttggttttgtgcttcatattttttgttatttgcacccaaatgataatttgctgtttacatttgtcagttgaaactaattgacatgggatagaagtgtgtgaaaggactaaatgcttataatctaggcttgatgcatacatcagaaaactttgccatgatagttaatgacttgatgctttaaatcctgaacagtttgtttcatgcctcgagaaaatcttgaaatttttattagctcattactaatgctgagaataagaacaactattagattcttgaagtacttgagtctgaatttattgaacaattgcgggtgtggattttcagaaccagcaatggcatgtattttatatctgtttgctctttagagttgtgttcccagcactgaagttattgtgcttctatcatttggccagcttatattgaacacagatgaaactaaatatggtggacgtggggagctgacgagcaatcaatatatgaaaagaaccagtgacaataggtgctgtttttcagttttcatatgatatacattgtgagtttattattttatctggaggtatccatattttgcaatcaaataagcattgttactttcatatagggttggtggttgccgcaactccttggaattgacattaccatctaggagtgctcaggtgggtgggtgtaaagatatgtgatgccagaactccttggagttggttgttgccacagctccattacaacagatatgcttctcttttaaaagaatacacacgcttgcaggtattcaagttggtccgaattttgagaatttagattctcaaggatgagcattgttgatagaccaagcaattcgggtcctcagaagacggaacttctctgttaatatctgaactcttgcaaacttaaagattcgcatggcaaaaactgaggtaatgggtacttgcggtcttttccccatgtaattatgatctgcattgataggtttattaacaatgcattttactgcaaacctcatcccagtgacatggaaactcacttatgttttcatatgccctttttgactgaatgcaattctgaccttagctttgtcttaaagagaataaaagaaagtaaaacatttttttttcatattcgagcatatttatcctatcgtccacagactggagatgctttgcacagtgcaatggtaggtatgtcaaaaaattttgcacatgcagactcctagacagacaaaaaaaatacaactagaacagttcacgtcagttacacacttaactacatgactgctacctccgtctcaaaataagtgcactcgtgggaatacgtgtccaacatttgaccgtccgtcttatttgaaaaaaattataaagaaattttaaaaaattagtcgcacataaagtaatattcatgttttatcatctaataacaataaaaatactaatcataaaagaaaatcaaataagacgaacgatcaaacgttggacatgaatagtgcaaaaccgcacttattttgggacggagggagtatagtcccgttcttttctctaacatgagttggagattaagattttcgtggcacgcgtttcaaactgctaaatggtgtgtttcgtgcgaaaactttctatatgaaagttgccctaaaatatcatattaatctatttttcaagtttgtaataattaaaactcaattaattatacgctaataccaccccgttatacgtaataaacataatcttcatcttaatcttcaggggaaaagaacaccaccgtagtgagaggatccttcaggtatgaatgtccatgcagatgcagattgttgggttgatgttcgacgtctctgatttgaccttctgttgtggtacaatatgaagtattgcagtatttatttagacctcaaattgcctgttctgctcactcgtgtaccttgattccatgcctagtgtgggcgtggcaccgtggctagtttaatcaaggatgctatagagtatatagactcatagctccacagtgaaacgctcataaggagtgctattgaaactaataaggctttgtttgttccagctgggaacctcgtaaggagtgctattgaaactaataaggcttcgtttattccagctggttcccagctcctttgccctcattttctctgtgcacgttttccaaactgctaaatggtgtttttttttgcaaaagtttatatatgaaagttgcttaaaaaaatcatattggtccaattttttttaaaaaataactaatacttaattaatcatgcgctaatggatcgttccgttttcggtgcgtactgttcgtgttgggtacacaggctaacgaacgtagcgtaaatataggccaacttgtcatccacaccagaatagatagcgctgtccaaagaaacctgttagagcatcttcaatagattggctattttagactctccaaatgcccatttagccaattggccaaaaatttagagtcatatttgccttttactctaacagtctctccatcccactctccaatctttcagtgggtcccacatgttagtctcttacttttttttccttccctctatcttccccttttcgtgagccgccggcgtgcggacgaggcgtccgtgggaggtggtcgacggagggggccgccgtgcagggacgaggagtcagacggcgctagagatgcgagagacgtggcggcggacacgatgatgtcggcggacgcggtgacgttggcggcatcgctggccgggccttctctagcgcgcacgagcgagcacctccggaggccggatatgccgcccacggcgcctcccaccaccagcgcgcttctctccgtcgccgtgcacgcgggcccgctcggcaccggacctgccacgcgcggccctcccggcgccagatccgccgtcgttgtcatcgagccgccgccaccactcctcctcgtcgtcgatgaactaccccttctcgtcgccgagccgccgctgccactcatcttcctcctcgtcgttgacgagccgccgccgccgccgccgccgccgctgccgctcatcttcctcgtcatcggcgagccgccgtcgccgctcccgcttcctgcatcctccgctcgggctgagacgaggccggcaatggatgccaccaccgctgcatgcgctcggcaatggaggatgtgcgtggagagagagggaaaccggcgtgggtcccctggatagctagccggcttggctggccaagtttggccagtgagggaggcagtttagctagtcaaatggcttagccattcaaatagctagtctgttggagtacaatttttgttcaaaattaccaaattttaacttgtaaagtgagatagcaatgctcttggagatgctcttagtggaggaaggcctcctatggataagaggtatagagctaaagaatactacaactctggtacaagcagacaatgataagttcgaaagtaagctgtggtacaaaaagtttttgttttggtaagaacatataactttaacagcatatggcatgaatatctaattcaaaacttctttgacctgccaagtttctccttttgtgatcttcagattatgtacaaatacagcgaattttgactgtttgagtcctacaatagcgttaacaagttgtacttaagttcagcttgtttcaccatctccggtttgcggtgcctttttaagcttcatatgttgcagctgcgatgtagaatgttttctcatatgtgctaccattaattttgacattttccgcaggcccaattttgttgcattgccttcttgacattatttcagttttgtgcaatggtacttttgcattgattttggtgctacatttctacccaatgttgttttatggtactacctataaatgtgccgtcagctgtaagaaacttctccactaagtaaaagaaaagacgcgaatattagggaagaacctaatataaaaaaaaattagaagggctcagctgtaaaaaacttctccactaagtaaaagaaaagacacgaatattagggaagaacctaatataaaacaaaatagaaggggtaaggcttcgaacccaggtcgtctagcctaccatcttgtggagctagccggaagacccctgggtgtttcgagtaaaagaaaagaaaaaactcacaactgttaatatactctcctctctctctctactttgttcttttgaactccataatttagagaaattctatgccgaagtttctatcagcaagatttatgtttcctttgaactatgttcaatttcctttatcaccatgctctttgatatttatggttgctcttctgggagtgggattaaattcatatggaaatggaacattcatattgtaccatattgttagattaatcctaccaactcctgcgagctggcctccccctatgtatgtataaaaggaggaccagtgtctctaagaagaaggttctaagttacattcaagccacatccaagggtgagtgcaccccttggcgttcaaaacatctaagaacacattgtaaacttcatcatttaacatttaatgaaaaacacaggagtagagcatgctctcaagcggcctgaacctatatatacatttcaacattctctcgcgtgaccctaacacaagctttggggatggggggggggtgggggtttgggggtggggttataggtggtggtggtgctgttaaaaatgtgaaatatgtccggccaagcagcgccgcaaccccatcgcctgtctcatctcgttctgtgacttccatccagacgcacgcacgccccatcctctccttgcttgatccgtgcacctcaaggaacaagcgctgctgttgccccacacgctggcccctcggaggacagcaattcccatgattacaatggcattagctctgttacagcgagcgcctcccctggttggaagtgagggttgttttggcttgtaaccatatcaaaagtttggtagtgctgtattgttgcaactcatttaaattggcaaggtttggtctcgattcaaatagctagcaagtactatttagaactacttcctctgttttacaatataagtcattctaacattttccacattcttagtgatgttaatgaatctaaattgatatatatgtctagattcattaacatcaatatgaatgtggaaaatgctagaatgacttacattatgaaatggagggagtacctaataattggtagggcaagaatcggccttaatggcttaatccaatcaggccatgaacctctcttttctgaaaatggcatggcactgtttatttggccttcaatatgatcagagtttatcacacgcactgtttccgatttgttccagtgcttgcacttcagcggtgtttgtctcagattctttgtttatgggaaagcagaaagatggtgaacttagctatcaatgcaaacggaacacatattagaacatgatgaagggaattgtgaagcagcgtctctctccagcacgatacaaaacacctgatcatgctttccacgcaatgcaaaaaccaaaatttcactactacagatgttggcccccgttttataacaccggaaaccacatatattggtacacacattcatagccagtacaaaacaaatatcaaaatgaatttagtcaaagaattaggacacgcctagggatcgggcgctcgatccggaggacaaaaaatcgggcgcccgtcccagccatcccatccagagagaacatcagagtcctcacagctctgaattaggacaacatgcacgcacgaaaatattatttgtagtacttgcatgcacaaaacaaattaccttttctctcaaattttttaaatgtgtcaagttttttaaacaaactttaaactacatgttctctcaaattacttatccaattcatgatccaattgcaccactaaattcattgtaattaaatctttaaaacaagactaaacatggctataatctgatgaaaaaaatgtttagctttattaatgaattgtttttaatgttgcacctatatcatttaaatgtttcatgtagtattcatatgatgtttcactttttaatttgtaataatttgtaaatgttgcacatgttcttctaggaatgttttagcatgtactttataatattttaataattataactccaccaagtagatcggaatcgtttcactaagtagatcgaaaatgtttcagtcttgtaaaaaaagctgaaacccaaccaaatcacctcataaaacattttactataacgtagtgaaacaacagtttccgaaagaaccagacgatgtttcaccctatataaaaataatgtttcagcaaatagtgaatagatgtttcaattattaaagacagtgaaacgtggtcagatcgctagatgaaacaatttggttcaatgtaatccattgcaacacttaaaccccgtgtacatcaacaaaacattttcagcttttcaaacgattgaaacattttcgatctacttagtgaaatagttctgatctacttggtggaactgcgtgcaacatttaaaaataattcaataataagctaaatatttttttcatcggattatatccatgtgtggtcttgttttaaagatttaattgcaacggatttaatggtgtaatcggatcagggtttggataaataatttaagagaaaaaatagtttaaagttcgcttagtaagtttgcatgacgtcatcatgatgctaggggcagaggttgcatggcataggaggcaccagggctgcggcgtgcagcgtgatagcagtgctgggaggggagcccgatttttctatggctggatcggacgcccgggcgccatcattttcgaaagaattagtacctttacaaggatcaatatggtcttgtcctactcccttgtcctcctccctccgtttcaggttacaagacgtattgactttagtcaaagttaaactgttttaagtttgactaagtttgtagaaaaaggttgtaacattttcaacccaatataaatttattatgaaaatatattcaattatcgatttgatgaaactaaattagtattataaatattactatatttgtctataaaattagtcaaacttaaaacagtttaacttagaccaaaatcaaaacgtcttataacctggaacggagggagtattagataaacaacaacgcaaaccaaaatagtagtaggcctaagtgacatgcccataggcacttgactagacctagttttcgataagcacttcgatcatctgctaagtatgccagcaagctagcagagtcttcctcttctcctgctttcatgtctaaaacaggagaaaatagcaacggtgagtacatagagtactcacaagccaccacaacaacatgattaatgcaaatagggttaaaggaagtccaaggttcatttgcacaaagctaattttcgtaaatatttttacaatcctatgacctagccatctattatttctataaagctaatgcccactaaacaactaaagctcaacatacaaatatagtatttattagaactcctaaaacctacatataagcatgccacatcaactcattaagcacataaagctccacgtgcaagcatatagtaattatatctacaatttatttcataaaaaactaaacatacacatgctaaatcatcattctcaaatcattttcataatatttcaatcaaaatcgtttcattatttctccaatatgtaacatatatcctgtagcaaagcatgggtcatcatctagttttaacttaaaaacaacatcaagttttcttgtttaaccattcattgagtgcacttctttgattactcgcatagcgaatgggcttggggttatacctaatgatcaaattgcttacatttccaccccccgttgatgaaacttatttagtgcaaggtcacatacttaagcatggggcagataactctcttatattcttttttcttggctgtacgaatgaaattccgttacctaacccggggtatcatttgtacaactgtcatgatttaaccattctcctacagacgataaaagaatttcgtgtaggtacattacaccgggatacccgcaacatggcaagagatgaacatgaaggttcaacatcctcaccaacagtgcggatgtatgaggctgactaggatccgaccggagatgctcccagatggacccaagcaccacactatgagttgccaaccatcccgatctagcaaaatgccaaatcaagatgggttttgtagaaagaaaagctaaaacggctatcagaaccgatttagagatcaaaatcagcctctaggctgattcagatcgatataaggataaagtacccatctcgtgggcaaagggaaagtttacgggacaaacctacaaaggtgtaatcgcactctcgcagcgacggcagacgatttacggcgcaaatcaacaaagatggacaaaagctaggataaagtagaaaacatggctagaaagtaaaagtaagagaataattcgattgattgtgtagattgtgtggtaaattgtttgaaccggctttgtcccttatataggggttggtcttgccctctacaggccctcctccacgtccaactcagagtagaaaccaaaggaaacccgaaacatagcctctcgagtaaggaatcccaaggcccgacaaaaacagactctggctcggactctgacagtatgaccggccacatacctgcaatcagactggccctactagccggtcagactgtccctgtgaaggaaatccggtactttccaacctttggcaattttcccctatttcgtccataggtgccaaatttgggtgtaaacaaatagaaccctggcggaaagacaattccattttcgtaggtcccgatgacaacaaagacacagcggcggtgacgacagtggtagtagacgtgacaaaaactcgaaactctaaacgtaccaaacgataagaccagcaacacgactcgacaatgcaacgcaaaattcaacaaagaaaaacataatagaacaatgcaagggcacaaatatggctaggtattggatgcaactttttttatagctatttctggttatgggtagataaaaactcactgagcaacgaaagctctgataccacttgataaaccctgagttccacttgacactcaagattgttgttggcccgatcttttggtgagttcagataactacgatttgggagaaaagttgacgacccgattacaaccgtacaagatgttgtgttgcgcctttgcgatcgatacacctctccatgggttgttgagctagacggtgtagatcaaccttattcctgtaagcaaatcaaaaatccaagcaagaacaagataaaagcaatttaaattgcaaatagaaatgaataaacgagataagttggggatccgaagaacaaggagacggacggttcggctggcacacgcactacaagcaagtagcaatggctaaaatttaatctaacaaaacccgagataccctcaaggggtacctagctatttaaggaggtgggaggacaacctagtggtccctagggtcgtgctccaccagattggggcgcaccccacatgggcgccacttgggctggggtcccagacaaagttacaagcccataggccccgcaacaccttgtttcctcaattgtgaccaactgagatggaattcggtgatgaggctggatccgttggtgctcttcgcatagtccacttaaaagaacctggttcttccaatcaaaacaagacaaactcgagataatatgattagcaataacacgtatctctagcttgcatgttttatccacatgtacaaccgttgctcacatcatggatgaacaagaagatatcaaggtcatgttctccaagtgctggaatccaatttggccacttgctacactactaacatcaaacggccgctgaatctgcatacgacctcggttttcgacctgtgagtacttgatggaaagctctcggagtcctctttccaacggatccatcctaatcgccaaattctacaccagtcatctgaaactgaggaaacaaggtgttgcactagtcatgggcctttgggattgtaacttcatttgggaccccggctgtgggcacccgaaaattataccgtccagtgcaatttgtgatcaccacataattttggatgagtggaatctatacacctataatcgcagatgttggaggcataccacaaggaccttcggccgggcctaccgaaaccagagacgatcaaaggcgcgaattggaagcaagcggcaaagatctgagagacggcatgggcgaaagccatatggcgaaagccgtggcgtgaagtctacaagcctcgccgaagacagacctcgccatgaggggacaagtcgaaggtctaaggcgaatgccttgccacgaagggcacaagtttcgctaggcatcggatctcactagaaggaggcccagcaggccgacacaccctccgaaggcttcgccaaaggctgggccgaaacatttggcccattaagagcccatataagtaaaagacattgtatacccacaaagatgtccgtatcatgagggtaaccatgtaaaatcccctgtaaaccctagaccctaaaagggagagtctgtaatggggctataagtagccccctaggacaatgtaacaggggatccaaaaaattttttttactaagcaatacaattgtctttacttacaactactattgagaaaaccacgcctctcgacgtgacgcggttgtccattcgacaacagctggcgccgtccgtgggtacctccgagcgaaaccactgatgccaccaaagaaggtcgttaaggagagagttaccaagcgaaaggaaggtggcagcgaaggggacatggtagccgaagtgggagcagagccttcggcccccgaaggcgaagctacagcgtcgcctcctcctgtggcgtcgccatctctcccgccttcggcgcccgcgtcttcgatagaggcggagacggcgaaagcggcggcagcggcgaaggccctctggaccagagacgtgatcctatcatctcaagcaccgggggtgcctccagccaccgcctttgcccaaccagccacgacgtcgacagcaatcatcgtctcgcaagccaacgccaatctcgatgctcaaggagaagctgacataggggctatgcatcagaatatggctaaacttcaagacacgcttcgccagatgcaagagcaacagcaagcgtatgaagcagcaagacaaaccaagacccatactcagcagctttacgctcagccccaagtctttcccccacatgctgtaccagcaccagtgtacttcgccaagcccgccacagccgttgccgtgcgagcgaccccacaagtggtctcggcactggttcgcctggtggcacctcaaggccagtacctgaagcctactcacacgccacaaaaaatgatggaagcagctacgaccctacaagcacagtttcaagccttcttgcaacaactcaatcgaccccacaacaatgtaccaagagcttcgcctccggcccaagccaagggaagcccaagtcagggtgcaccagctcgatagttgctgggccagttcgccatgccaagccaagctcaaggggtttcttctcaaagccaactgctacaattcaacccaagcaccgcggcacaagcacccatgactttcgtgcaagccgtgccctgtgggttcggagcggccccaccaccaaatcaagcctggaatcaagccatgttcaacccagctgtggcgatgcaagctacctcgacagaccagcaaaaccaagcgatgatgttcggcacggggcattaatcgacacctgcagctcaacctcatgtgcaagctgtagcttcgccattcgcgcttccatacccacaatttaactggccctctcagttaaacgattatatgatgctggttttattcgtccttgtcgatatgctgagtgggtttctagtatagttcctgttatcaagaagaacggcaaggtcagggtgtgtattgatttccgaaacttaaataaggctaccccgaaagacgaatacccaatgccagtagccgatcagctggttgatgctgcttcggggcataagattttgagttttatggatggtaatgcaggatacaatcaaatctttatggccgaagaagatatccataagacagcttttaggtgtcctggtgcaatcggcttatttgaatgggttgtgatgactttcggctatggtcaaaccgggtggcaaaaagggtctgcccctcagctggggaattaaaagtcaccccatccctccccagttcaagtaccctcccgtcccaaggtattcgggagagacggatccgaaagagttctgtccatctacgaatccgtaattgcagttgctcacggcgatgagaataccaaggcgaaggtaatccacctcgtgctcgacggcataggggaatcgacaagggagtacatgcgccgattctcgcaagcacggtgccaagtacaagacataaccaaagcatccatcgtcaacgcaggttcggccggcttgcttgagggtgaactcacaaggaagatcggacgcaaggagccaaggacgatcgaacacctctttcgcataattgatggatatgctcgaggtgaggaagacaccaagcgaaggcaagagatacaagctgaatatgacaaggcggctgcagccgcaacagccaccgtgcaagctaacgctcaaactcaggttcaagcccaagttgtcagttcggcgcccgttctggttcaccctacccctccggcgaacccagcgcagcattcaaggccaaaccaagccccgatgacatggaaaaaattcaggaccgatcgaggtggcaaggccgtgatggtagtcgaagaagtgcacgtcctctgcaaggagttcgacgcccagcaagcgggcggacatcagcaaccttttcgcaaaatgatcaagaaagacctgtactgcgcctttcacggatgctcttcacacacaacagaacaatgctgaaatattcggcaacaaggcagcactcaagcgccgaggcagcagcaagctagggccgaagaggcgccgtgcgaagcggtcctcaaccaagcacctcaggccgaatagcgccaagacgcacaatgaagagtgatgcaggtcatcacaagatccgatcccccctcgcaagtgtcgaaacgacagcagaagatgcaactttgagcagtgcatagcattgttttggtaggagaaggggtcccaagatacttgacgaagcagatatccttcggaccggaggatgccgaaggagtccttttcccgcactaggaactgttggtggtatcggcagagatggctggttttgaagttcggcgtattttgatcgacagggggcagttcggctgatgtcatctttgccagaacatatgccaagatgggtttgctaacattggcattatctcaagcgccaacttcactcagggggttcaggggcgaagcagtgcatcttttgggttaggccctcctcaatgtcgccttcggcacacaaggaaacaagagagaagaagagatactcttcgacattgttgacatcccatacaattataatgccatcttcggccgaggcactttgaccaagttcgaagcaatttatcatcataactacctcaagctcaagatgcttggcctagtcgatgtgatagttgtcaagggttcccagccttcggctaccacggtagcctccttcgacagggaagttcataccctagaagtcgaagggcaagaaagagccaggccaatgctgagacccgccccccacggcaggttgtccgtttgcagatagatgattctgaccccgccaaagtcatatcactcggcgaagaccttcatcacgcccttcggcaccttttgccatctcagaatgtctttcggcctaaggaatgcaggcgctacattcgctaggctggtgtacaaagtcttgggatcgcaattggggcgaaatgttgaagcctatgtcgatgacattgttgtgaaaagacgcaaggcattcgaccatgcgtcagatctgcaagagactttcgacaatcttcacgcagccggcatgaagttaaactggagaagtgtgtgttcggtgttcgcacgggtaagttattggggttccttgtgtctgaaaggggaattgaagctaaccctgaaaaaatcaatgccattcagcaaatgaagccaccatcgagcgtacgacaagtacaaaagctcacggggcgaattgcagcactcagctgattcctatcaaaggcagccgaaagaggattacctttcttcaagacccttcggggggcaaattcaaatggacgcctgagtgccaagcagccttcgaggagctaaagcagtatctgcaaagcccaccagctctggttagcccagcagcaagaagcgaactattgctctgtcacgccctgaaaattgcctaatttagtaattcattctttaatgcatttttagaaactattttaaaagcttacaagttaaactctaataatctaggaaaaatttcaacataaaattgagctagataaaatttcattaaatactttgcttatttatctattttctagatttttctgggaattatttgagcaaggaaagtatttttaataaatgaaacatcatttcacgaattattttaattgagaaagtaaaaaaaaaccctcttctaagccgttgggttgttcccagcccaacccttttccctccccttgcgcagccgtgcggcccaagccgagccgccgcccctccctcctctcagccgccgacatgtggggcccacatgtcgggcctttcttcaacctccggccggccacagccgagaccgagccgcagccgtcccccaccaaatgcgccccaaccggccatcctcgagtccgattggttgaggtgtttttatccctttattgtcctctatcttttcccccaagaatcagagctaatttctttgtattttatccgaatcaaactcgttttcgagtttatctctccaaactaacccttagagaacctcacccatgatgatttcataagggctgttcaagaacaaatgatgggattcatcaacgagcagattctcgatcccacaggagaattctattacgatggaaagcctattcatcaagccggtccttcttcttccgatgtcacgaagttgtactatacgacataaacaaagattgcaaagtcttaaggaattgtaatacatgtatatatttatataagcacacatgcatttacttttgcgtacttatgttggtaatatatgtgtatatttacttaggtgcaaactcatattttgttaatatatgcatatggcctctaattacttaagtgcatatatttgtatatttcttatatgtatttctacatacgtatgcacattgcatatatatatatatgtgtgtgtgtaaaaacatatagtacacatatatatgcacttaagtaaatataggccatactttacttaagtgcatatacatatatgtgcacactatatgtatctgcatatatatgtatagatacatatagtgtgctcgtatatgtatatgtgtaatatatacatttctatattatgcatatatatatatatatatgtatttaaacatatatatgcataatatatatatatgtatgtatgtatgtatgtatgtatgtacaggcagcacacaacacaaccaaatttttttaaaaaaaatctttagtcccggttggtaacaccaaccaggactaaaaatggctctgtcggccacgtggctgagccaccaactgggactaaagatggagctttactcccgggtatttgaatcgggactaaagaccgccatctttagtcccggattctccctcccgattcgctacctgggagtaaaggggcttgcgaaccgggagagacgagcacttctccagtagtggatatatcattttccagtcttctccaattgaaatgcaatcaagagaacctcaaagaccatatatgtgttcaattgtcgaggtatttccgtatgttcggcacaatcactaaaagataaccagagttaattggtgagcagctaattatgtttcacataaacaatctcatgttatcatccaaataacatttggttgaccatgtgtggtatcagatatctacacagggacatgtacgttttcctttttggagatctttacagatggacatctatcaatctatgggtaccttcgtaagaggttcggtggttattcgaggatctggtatgtcataggctcatagcagaacattcaactaaagatgggactacttgtatgagaatttatcagttaccaacttgtccatcaaacatcagctgacttcagacgtccagaagcttctgcattgtggagtgtggaccattcaatggcgtaagctagaatatcatcaactggactccttgctatggagtaggtttaccttgagatcatgtcatccttaagtattcttcttgccatcagaacgtgacaccgtgaggtctgctgactccagttggtcatggagatgcttattgtcctccactaggtggttatattcaatcattagaccttcagattgcttttgggcagctagggctttagcctctgcatccttggcctcatttgccttttcttttagctgacgtttcatcttcttaatctcctcattcaatgaagctatgtctttctggtatgtcttgctctcatcagagcttccaataagctttgcttcgtctagtgtcttgttcagctttgacgcagcctccagatttcttttgagccctcgtacttctctgatatagttatggagccggtcaatgaccagagcaaggaataaggagtatcctgaaacaatgtagtgctattatgatatgtccgaaaatccattatggaactagaaattgcatgacagtatgatactggcatactaagactgaaaggtgaactgctacagagaggtctgttgcatttggaggtaattactactaccacctctgttcaattttgtaaggcgtattttgatttcaaaagtcatactaaaagattttgaccgataattaattaatatacaagtacaattagaccgtatagcttatgccattacatttagtactttcacacaatattggttttacagctatttgatatatcttttatgaaaagttaatggtcaatgatgaggacatcctccactattacctgctggcaaagacgcaaaagtcgggcggcgaccgtgtgagcctctgaataatcccaccttacttagcttgggaggaagaagccaccttaaaagggagagccactcttcccctattggactagtttttcagggagattgggcctttccccgagtgggtgtgcctatgaactgttgaagtctggacaaccttaagttattggacctcagccaaccccacctggatcggattgttatcatttggtatcagagctaggcccttgttaagggggtgggaatgatgagggcatcctctactattacccgctggcaaagacgcaaaagtcaggcggcgaccgtgtgagcctctgaataatcccaccttcgagctaggcccttgttaagggggtgtgaatgatgagggcatcctccactattacccgctggcaaaagtcgggcggcgaccgtttgttaagggggtgggaatgatgagggcatcctccactattacccactggcctggcaaagacgcaaaagttaggcggcgaccgtgtgagcctctgaataatcccaccttcgagctaggcccttgttaagggggtgcgaatgatgagggcatcctccactattacccgctggcaaaagtcgggcggcgaccgtgtgagtctctgaataatcccaccttcttaaaatggagattgggcctttccaccttcgagctaggcccttgttaagggggtgggaatgatgagggcatcctccactattacccgctggcaaaagtcaggcggcgactgtgtgagcctctgaataatcccaccttcttaaaatggagattgggcctttccactagccaccttaaaatattggactagtcatgcttagctttggaggagaaagccaccttaaaaggaagagccacccttcccctattggactagttttttagggagattgggcctttccccgagtggatgtgcctatgaactgttggggtccgaccccacctaggccggattgttatcatcatagttcagtcttaagactttttgaaattaaaatacacgtaaaataaatggagggagtatagtactccccatgagcatcagaaaatgatgcactaagatttttcatcatgatatatattgaagagaagaagtatttaatctgtaccaaaaaaattccatcaattacaccaaccgatcaatagaagttcgataaaaaaggaggacagcatagtgtacagcattgatgactaatctttttaatacttttctggagcaaagtttagttactgagaatgggaagtcctttcatatatttatttcttgaatacattaccttttattgttcccccgtacaggtttaagtacttcgcagatgtaagcaagttaaccagtttcagggctaatggaaataaaagaccaaaattctacagaaactaacagaaaagcttgttttcaaaataagattccccaagtaatgaatagtttaagaaaaattgggcatgacgtatgctgcattatgaacaaattgagatcattcactggttacttggttggattttgcacattcccgtctacttatttccaagtcagtctttacgatagttgataccattcaatataatttatcatgtaaatatattagtaattgtgatattttgtgtgctggatctgaagcaagtgtaatctacataaatctaaaacaaaacaaaaaaattaagaaaacaaatcaggagacctacatcacaagcatctgttttaaagttcaattggaccaaaatagcagtgttaatcaagaacacccaggacctccatccatcatcagaatggatgtaccaaaacaacatatattaagctcggaattgattcagctatatatattctatctgttgtggttaaaggacatgcagcagcagttgcacaaaagtgcataactgcaagacaaccaactagtcaacaggaggttttggaaaaaaaatcaatattagtagatcaagaaaaccactactcatgcctgtttaagaaaattcatgaattaacaaaaaatgatttgaactagaggagtaggaagtagtgacagtgtatgttaaattcatgtttgtttaagaaaattcagttgagtgcatctcatgttaagaaacttaaccgtgcatttcttacatgccaaaatcaaagtgttcatagctcacactcccagctacttatataaaagcatatgcattgcaatatttgagaatcaaacaagatggaatatttatctgctctattcactatctttcaacccctctagttccaatctatgcttagtaccttcaaatctcgtacacccacttcatgcctccaaagttgggttttccactatgtgatagttattccattgtgaaacaaagtccacatgaactctttgcacaattttttaaaataaacaaaaatggcgaagttccaaaaaatgagcaataaaaaaataatgcaaacatattacacataatagtagatgcatcacgcagaaatttgttatgtaacttttagtggagtaatcacaaagattcgagtcagaacagcaatcacagtttgcacaagcacgttattaaacttgagttacatgcaagcattggacacaaaataaaaatgttccaagcaatgtaaaaaatgttctacatattgttgtaaaattatacattgttgacttatagaagaatgagtaaaggaaatttattgctacagctaatgaatatatcaaactttcttcaatgcttatgccatactttttttaaaacagtaagcagtaagttcataaaaaaaatgcacaagccaaaggaccagaacaatcaagtggctttattaatactcaatttacaaatgcatttagcacgaatgggaaatttaacttggacaaaagaacctgggtgacgaaccacagaacgacagaaggccacaaaaacaattggatttctactacattttatttatgcaacagtgacaaagaaaaatatatctaagacattagcactgcacgatttccttttgtggggaggactctatcgcagtatggcaattaattatagcacactgtggatgcgcaacgaaacacaaagcaggatataatggaggatctaaagatataaccaggttatctctactgcaccgtcgccaaaattcagctcttagaaatcgccgaccccgacaccgaacacagaattatgattaaatcagatcgtggttataccctaaccgaaaatcagttcatccgttctcctccgattcaccgcgacatcaagatgatagagcgcagaagggaggggctaggtgcggtgcggacatacccatgagcgaggcctcgaggaggtggcgggcgaggaggacctggtcggtgggggtgagcgtccccgcccccgcgccgtcgagctcgccagcggcgcgtccgcggatcttgttcatgctgtggacgctggaggcgaggacgacgaggacggtggcggcgacggtgcgcaccatgacgggtccgcggccgcgcttgagacggtcgaggccgagcatcgccagcttccgcaccggcgtcttgaacagcagcgcgatcgccacggcggcctccgccgtgagcaccgtgaacatcagctggatcatcgcgctgccgtggtggtgctggggagagagagggagagggggggctgggatttcgggttttcggcggagggaggcagcgcgccttcacacttgtagcgggcacagtgcgttgcctcggtgtgggtcttggaatgtgtgagaaaggcgttgccgctgccgttggcgttggtgttatggatggcgtgttgcgggaggtattctttctttcttttttgagagaattgctttgttcacccgttttaaagcttaacaattaaactgatatattttttctagtttgcttgtttaaccaagcttttaaaaaagaacatcccatctgactatgtttccactacaccgtgaagtttttatttttttaaaaaatatatataattattattcgtaatgaccaaactgccctcaaaccctatccattcactcccatcccactcactcttatatccggttgaggcggcggcgcaccgggaggacgagccggcacgacagctcgtcgacggaggtaacggcggcggaagcagaggggcgtgaggggaccggacccgtggcggtgcgagcgcggagaaagtagcggccgcggcggctgctgcggcaagcgaaaggaggagcgggcgacagcggctcgacgacgatgaggaggagcaacggcggcggagctcaggttgtcaggatgcgtaggcggtggatccggtggtgactgggcgtgcgagccactgatacagcagcgctgaggcatgtgggctgtggatccggtggcggtgggtcgacgatggcggcgcggcggtggtctcagggactgcgggtcggcaacaacgcatgaccccgcgtcagcaagctctccgcgcgcgtgatgcctccgtcttcctccgtgcgagcaccgccactgggttggtaacgatgatgatgacgccatggctaagaggatggtggctcacgaatacaaaaattgttatactctatttatatttttgataaaatatagtcaaataagcaaagacagaaggggcatttttttctctaattaacaccgttacatgcccttaacataatagagtcagattgtatcttcaattttaaaaagaatggtcatacgaacaaagttgaaaaaaagataatcaaattgttagtaacagggtcaaccccttcatttttctggtcatgtttttgtagcggttgcctactaccggctagaataactgcgggtacacggtttggttgaaccgttgaaggacttgggaacctattcatttgatcaataatttgttggtaataataagggcttctttataacaaagaatatttgtaggatatttaaacgatttaaattaaatataaacttttttatttgtgtctttaaatcaagggaattatcatctcaaaatttttatgatagtaatccctatccttgtaataggaacactttgaatggtttggcctttatccgtcatagggcacctccaacggaggcgcttacataagaaaaccaggttcttttgccaagtaggatcagcgtgactcttaggcctcgtttatttcccaaaatttttttgggtgaatagttaatttagtcccttaagttttaccaaaagctcaatttgatccttcacgtttcattttgtccacatagctcctccaaatatttgttttggcttgaaatcatccttggaccctcttaatatgccatttggctatttctagtcaatatttctattaaaaactatcatttttgcccttaatttgtatacaactatatactagaaaagagaaagtaaacataaataaacaatattacagatgttcttcccattatttcaacatgtgcacatgaaacttaagcaattgctatcgtatacacttgctagtacataatttattttctttttacataatatactatgtattatctataaaacattcaagcatgcaatttttctcttatatatgtgaatgatgaggggtataagtatcatttatgaagagagttgttggttcaaggataagtttgaactaaaatgaaaacttgaaggactaatatggatagattgaaacatcaagaactaaactgagccttaggtgaaacttggaggatcactttagctattcacccaaatttttttcccaaaaatgtcatatcgaatctttgacacatacatggagattaaatatagataaaatgaaaaactaattacacagtttgcatagaaatggcgagacgaatcttttgagcctaattagtccatgattagccataagtgctacaataacccacatgtagtaatgacggattaattaggcttaataaattcataaagcggtttcgaggcgagttatgaaattagttttttctttcgtgtccgaaaactccttccgacatccggtcaaacgttcgatgtgacacccaaaatttttcttttcgcgaacggccttagcatatgaagccactgcttcgtgcggcgccgacgcttggtggcgctacaatcttgatcccaacaaatttttgaatgagcgcttgcatcgttgcaacggtccttgacaaaccaaaaaatttggaggcaaacaaataacccgacaaacccgcatccatattgcatcaaaaagcaatgtttctcaactactccgtccgtttcatactataagtcgttcgactattttcttagtcaaacttttttaagtttgaccaagattgtagaaaaatatagcaaaatttccaatacaaaacaaacatattatcaaaatgtactaaatgctaaattttatgaaactaatttggtgctataaatgttgctatatttttctataaatttggttaaactaaaaactttgactaagaaaaaagtcaaacgacttacaatatgaaacggatggagtattcaaaaaatgcgatccaatcaaccagatagtaccaagaaaatacaaatgagatcaaatcacccgtacacagagaactatgcggggcaatccaacaaactttccacataccaacgcctacaaaaggacccaccctcattgtgggtgaaatgggaactagggtaccctattcccctgatgaattagtaagtaactcataattaagataaatggcaggcataagccatccataaaaatagatggaagacttaggtttagtcacttagggacccgccctatatgtgggtcccgggctttcctaggtactttagcatccactcatcttaaagaaataaggtaaggggtagtccaggatcctcattgtttcggggcccggacacgcccttatccctactcaaagtgctaattccgccccatggagtgtagtgacatacaaaacctatgtattaagatcttaagcgaaagggatcatggatgatcaatctggggtccctgggtctcggtaaactggaacaggcccctctgggatatgtgaagcttacaagaaatatatcttaatagcaataggaagagatagatttagggtcggcctgttccagggccccgggcccactgctgtcgataggggaaccactcttcctaaagaggagtgttgaaacatataaaatctacaatgacccaaaactctgagcacaagggaacgcaacttccttatgtccccattagcaaaggtttgtcttggacccggtcctgccctgggtaccgaacttacctcaatccttgtaagtcctacgatccttaatgagaggagcgtggatgtcacatccagaatattttgtgtataaaatccgtgtctaggattcagccaggaaaaacaaaacgacaagtaaatatacagatcgaaacctaaataaagcgtaaaatactaatagaagaggcacttagtccccagaccgaaaagaaacaactgtgaaaaatagacgatcctagcggtgcttcagctccactccacaggcaaactcgactgggtataagccttggtcctctaacatcatctttagctcagaagcactacacttctgaaaagggggaataattagcaaggctaagtacaaccactgtactcagcaagccacacccatgatgcagacgtgcaaggggagacaaagaagggtttgtggctatttgcataaaggtggttgcaaacatattatagttgaaagcagaaaaactattgattaattaaggcaatattaaatctccactggacaatgctaccccacattgaacagacccaaccaaaccacctgaactacaccagttctttaagttaaattaattaatagaattgagtctaatcacgatggctagttgatcgcccataaccgcgggcatgactattcgaatagttttactctggccaaaggtgcacaactgtacacacaaggcacaacccaatggcatgttattgtgcccattcttgcttatggtaagcgcggtaagtcttctagggattcccgagaaccggtccttaattgccatgggttcaactagaaaaaccatgcacccacaaccctccattatgtcatattttagttgaataattacaaccagtgaaacatggccagatttctcgagctcacagctcatcaagataagtgtgaataatgtaattatcccattttgtgagctagtggtaattaagcatggctaagcatataatagttccagcaagatcaacataagtgaaacaatcacaggtgggcccggcgaccccacctgtcagtcccatccccaacctcagctccatcccaaccgccgccatggccgcccactccaccgccaaatccgccacctcccgtctcctgagcttgcattcaatagcgtggactcggtcccctccatgtcctccaccatttcctccactctccccatgaaaatcggtgccggttaacccgcccaccacccccacgtcggcgccctacttcgccggccgttttcgctcctcccagccacgatttccctccccaagcgctataaaatggccccctcaccttccctcatccctttttcccctttccccgtgctccccgcacatagaaaccatttccccgcatcgctccctctctccgccgtcgccggcaagctccggccgcctctagccaccgctctcgccatcgccaccactggcgtcaccgctccacaccgcaccccggccctcacctttcttcccctaaccgtcgctgaaatcccaccgccaccgccgacccgagctacatcaatgcctaccgcctccgaccgcctttcgccgccgctcccgtccacgccgacccatgccatcgcctccctcggctccgcaaggacgaggagatcctcggtcgccactcctcctccgcagatcatcgtcggagtcccattcaccatgcgaggtgaggtcgccggtttttcctcttgctttcggcaggcgattcacgccacctcgcatctcctctccccctcctaaccctttcatttccttccttaggtacctccgaccgtcggccgccgtttctcgctcgcagaacgccgccgaaccgccgtcaccattgcctccccgaggagcccgccgccggcttccccgttgccgtctcgctgtcgccgccttggtgagcatccctcctctcctccccgctcccttccgccgcttgccgtgccgccgctcgccgtcagtagccggtggccgtgcgctgccgccgccggtggccgtccggccaggccgccgtagccgcgctccgcgcccgcgctactgccggctgtatcggacagccgactgccgcctcccattggtcccagccgcggtcgatctgggccatcggatcggcctcggtctccatccgggctacccgtgtgtccgcatacgtggccgccacgtcggtgctccgtcggagccacgtgtgcgccacgtggtgcactagcccgtgcctccgtggacttggtccacggtaggccgaagcccttgagtcaccgatgggtgggtcctgcttgtgcaccgcccgttccctctcggtgatgtcataaatcgagtttaattgcacaataattcgttaataattctagaaattcatttaaatggcttaaaacttctaaatttcatatctaattcattcgaactctgaattgagccattcaacttgcaaaattcatctaaaattgagatctacatgtttgtttacttttcatgtactgtttccttggtttttattagagtttttcctcgtttagcgtgctagcgtgtagttcccgtcgtttcggaagatcgctttcgcgaggatcagagttcggaaggttgttgtgaagaagtaaggcaagtcacacattctccttgagcattttgatcataatttacaaatgttttatcgtttgcaaataaaattgcatgtcttgctaattacatgggatccgggtattacctatctgtttggttgtgccatgtttacttgatatctggtcctttgtcaacattgggtaataaatcgactagctcatgttacttatgtgacctagctagaactttatgcttagccatgcttaataccactagctcagttgatgggataattacagtattagacctttttagtatcagaatgagctgcgtgctcgagacatctggccatgcttcatggctgtaattatccaactaaaacgcgactgaatggtgggctgtgggtgcatggttttgctagtcgcaccatggcaattaacgaccggttcacgggaaaccctgaaagaatttaccgtgcttaccacaagccagcgtgggcaacgactgggcttgtagtgtatctttcctctagccgacgtacccaggcgagggtgggtgtgatggagttgggtcagccggggtgtccggttgatcggcttccggattcaccgcggcacgagagggggactgcccgttgccagctagggacgggggcgaactctgaggtgtggtgcgatgtcacgccctgaagttcccctcctttgcgttaaattcataaaataaatcgtccaaagaaatggttcaaattaacctagagatgagttccttaattaatcaatgcaattaataatcggaaatggcgtggtggaatatttcttgagttccccatgttgcaatatattaacaggatttttattggaattttcagagccttggaaataattttaaccaattcaaaatgagcaactgcaatatttaaatctcagggaaattcctttttccttttctttttctttcccttcttttttctttgttgggccgtaggcccaacctccctcccgcacgccctctttgctaggccagcccgctcccccttccccgtcccaaagtcctccctctctccctctctccttcgggcaccgacaggtggggcccacctgtcggtcgtccctaacctcccgccgcccacttcgccccaaagccggcaaccgccgcaaccaccccacctcctccgctcctcccgtgcccacgccgcgccgttcccgcgtcctccccacgtcaccgcccatgccccgtcactcccgcccgcgcgcgcgcgctcgagagggcgggattcgatttcggatcccaccccactctctctctctctccaccccacgtcgccggtgaaatcagaggctttcccggccacgtccgcctccccctccacctataaattgctcccccgagcctcctcttccctttttcgctctcgccgccctctcctgtgcctcctaccgagcccgcgccgctcgccgctagcgccgccgcttgccgccatctctggccacgcgccgctagagccgtcgccgtgccgcgcaatcgccgccgtcgcgctcactgagcccgcccgcacctcggccgcctcttggttgccaccaatcacccccgatgccccgtttccctcgctcgctagtgagctctccattttcatccatctctggccggccactttggtcgtcgcggtcgtcctctccatccctaactcctctcctccccttctttaggtgttgttgccgcccgtccgccgtccgttcgccggccgtcgccgccgcttccatcctctgctccggtcgccgccacccctccgatgaggagcccctctcctccctacttccctctttcccccgcgcgccaccgctttccgcgcgctcgccattgcctccggccgccgccgcggggctgtgcgccatccgccaccgccgcttgccgtcgccggtggccgcgcgccccaccgctgccgcaccatggccggccggccggcttgagccgtgccgagccgccagccgccaactccctccccattgagccactacccgtggggcccacgtgctagcctcccccttgtgccgctgacatgcggggcccacctgtcggcgccgcccctcccccttgctgacgtcagccctgggcaatattgcgcaataaattgattaaggactttttctttattagtaaaaacacagtttctcttctaaaattcatatctaattcatccgagctccgtttaagtccattcaagtctcagtaaattcataaaaatccctagaatccattaaaaatggtttggtttcatgtttcagtagtcttatagcatgttttgcttgtgtgctttgtttgtcgcgtagatttcggccgtttcgtcgatccgcggttcctcgaagacgttgctgtggtctcatcagtgcgagagcaaggcaagtcatgcattacaattgatcatgttgtacccaatttacaaatatcccgcatttctattaaatgttgcattcttttacaatgtcatgtgggatgggtcctattactcagccatttattgttcaccctgtgccattgataacttgggtatcaaaatgattagatgttggtttaggaaatgcttagccatgcctagttcaactagtacacaaatggggatcacattattacatagacttattagcatagctttggattggtgccaccgcaatggtgttagttaattaaaatacactgaatggtgggctgtgggtgcatggttttgatggtcgcacccatggcaattaaggaccggttcacgggaaaccctgggagacttaccgtgcttaccacaagcgagagtgggtaactgcttgatctgaggtatagctcgaccctttcctaggcaccggtggcgagggtgggcgtgatggagttgggtcggctgtggtgtccggttgtccagctgtcggattcaccgcggtgcaagaggggaccgcccactgccttttgaggggtaggggtgaaacccatggtgtggatggttaggggagggttatgcggagggtcttgtcacggtttccccctttgcagtatcatggtgatacttcggggcatggcgacatgtgtggaatcgtgtcttgggggtacagttgtacacctctggccagagtaaaactattcgaatagccgtgcccgcggttatgggcgatcaaccagattcaccgtgattagtctcacccctagtttaacttaatgaactggtgtagttcaggtggttggttgggcctgttgcaacgtggtgtagcgttggacagtgattggttaatattgcttaattactacaattgttttactgctttcaacttctgcttttaaatgcctgctttatgcaaaagaacatttagcctcctttggatatatcctgcatcatacctcctctttcggtatgacttgctgagtacagtgggtaatactcagtcttgctctcttttcccccaccccagagctgaagatcttcctagtgggagctattttgtcgatgttggtttcatcgctgccgtcaaggattgcctgtggagtggaatcgcccgctgcaggagtcaagcttccaagtctagctcgttttatcttttccgctgcatttgtaatcttttatattttcgtaagacgtggatctatatgtcaacaattgtcgtttgtgtaccctggctggtcctagacaggggtttaatgcacatccagcttagaaattctggttcgagaatttctgggcttgacatgcaatcggttatagggggttatgcgaagggtcctgtcacggcctttttccggtatgtcgtggtggcatgtcagcgcgcggaaacgtgtcgtggggctgtgtcttgtgggtacagttgtacacctctggccagagtaaaactattcgaatagtcgtgctcgcggttatgggcggtcgaccagattcatcgtgattagtcccaccttaataaatcaactcaatgcactgtagttcaggtgggttggttgggcctgttcaatgtggtgtagcgttgatcagtggagatttaatgttactttaattactcaactgttttactgttttgctcaataaaatgctttacaaccgcctttatataaatagccacaagccatccttgtatccccttgcacgtctgcatcattggtgtgttttgctgagtacggtggttgtactcacccttgctattattcccccttttcataagtgtagtgcttctgagctgaagacgaagttagaagaccaaggctcaaacccctagtttagttttgcctgtggagtggagctgaagccccgctaggatcgcctttttccgctgctgctgttttcgtttcagtgtgaagactaagtgcctcttctgtaagtattttacgctttatttacgtttggaactgtttattacttgtcgttttgtgtaccctggctggtcttggacaatgatttaatacacaaaatagtctggaaatttgggctaaatttctgggcgtgacagcacccccttgctgacgtcatcacgtgggctttattgcgcaataaaattaagtaaggcttttctctttatagtaaaaacacatataatcttctaaaaatcataactaattcatccgagctccgtttaagtccattcaagtctcagtaaattcataaaaatccctagaatccaattaaaatggtttctcttcctatttcagtagacttatagcatgttttgtttgtgtgctttgtttgtcgtgtagtttttggccgtttcgtcgctccgtggcgatttgaagtcattgcaaagatcccatcagcgcgagagcaaggaaagtcatgcttgtcaattgatcatattgcaaatgctctacatttcctttaaattctgcattgttttataatgccactgtatgggatatttacctactgttctcagccatattctttgtatgccattttcctttgttaaccggggatttaatatacttagatgttggtttaggaattgcttggccctgcttagttgaactagtacacaaagggggaatctcattaatactagacattggttattaacatagctttagattggtgctaccgcaatggtgttagttaattaaaatacactacacggtaggctgtgtgtcggcacccgggattgaattcccgaatacctggagcgtacagtgtactagtcccatgatcagtggctagcacacgcatccacaacattgttatcacatccatacaacatatttgacatataaatagataagtggtcctcataacttaacggtgcataggtcttacatagtagttaggccgaccggccaaataaaagagtttaaacgtagcagaaaagataaagtacataagttcttcagtatgcccatctaccaaaagacacaggcaaccgactaggaataaccctagaaagaaccatcctcgaaaactccggtacccggtgcaaagtaatcgtcactaggcacctcacatcctgcatccaagtctaaaaacaacaacaagaggtgggtcaatacactaggtattggcaagtcctacccaaaccttgggaaacataggactattgcaagctgagatcaaggatggctatatttgtggctattaatgaccaaatttggtaattcaagtatcggagatgaagataaaatcgaagcagaatccaagagatagatcgttctgaaaacagaataagaatcggctgcgatcagaatcagtagagttcgagtcggacaaggtagccgattgggccaattccgacaatgtgactcggtaaacgtcgtcgggttgagttaatgtgcttcatatggattgccacgcacggattgggtcctgaaaaggcaattgtatctattaagtaggatattttatgtaatttcattagagataagtttgggcaaaagtctgtcgcaaagacttatggtatcttagagtttgttagagataagagtcgtgtccgacaagaacatattttgtatctcaggtataaatatgacccgaacccgtctaatcaaacaacaatcgttcaatacaatctcgacgcatcgcgaccctttttactttcgtttatttcgacgagttcttgcttttgggttgagctgcaccgattcgatcttccactagaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14333 - DNA, 573 bp, Oryza sativa
ggttatttccgagcatttggtgcgcaacatccagccggatcttcagaattaccaaggggtcaatttgaactatcaatatcagccgccatcacctcaagttcaataccagcaggcagaatcggctcaacaccagtttgttccttagtacaaccaatttgagcccatgccacagcagcctcaaggaacgcctcaacatcaaccatgggccgatctaatcgcagatgtcatgaaggagcagtttgggcttaggccgaaagatgctggaaatttataccgacagccatatcctgaatggtttgagagagttcctctacctaaccggttcaaggttccagatttttcaaagttctcagggcaagatagcacatcaacttatgaacatgttagccgattcttagctcaatgtggtgaagcatcggctgtggatgccttgaaggttaggttgtttcggttgtctttgtctggatcggctttcacttggttttcttctttgccatatgggtcaattaacagttgggccgatttggagaagcattttcacagctatttctatagtggggtacatgagatgaa

SEQ ID NO: 14334 - DNA, 895 bp, Oryza sativa
ggtcgtaatcctctaaggttcgaccaggatgtcttcgcctccaattcgccattttgacaaccacatagctacataaaaggcgaacgcttgatcgacgaaaacgccaggggggcgaaacgaatcggccgaagcatcgctcgccgaacgttgaaaccgcgacagcttgtttcggaataaagataccgaacgccgttacattcaacttacgcaaaacacaagcgtttttcccaacgcaaaatgctacgagtcgaaaacggaagtcgaaagctgaaaagtcaacaaatcttttcgccaatccccaaaagggggccgaacgcatgagtttcggcgaaatccccgctaaaacaatagggaaaaggggaaagaaaaaaatacaagtcaagaatcgcgcaaagcagacaaacttggcaaaatataatcacccagtgtcataatacagcttcgccattctcgaaaggcgaacgccagtgttcatattttttctgcaggagtctaaaaagaggtttcggcaggaacatcggccgaaaggggacgcctcatgccataccgtatagtttgcacggtctcggccaaagctccttactcactcttgcccgtgaggggcttgttggaggcatgccatgaagcccttcggccggacctgccgaaactatagtaccatcaaggattcaagccaaagacgtcaaggccattcaggcgaagccctatggcgaaagccataagcgaagatggcgaaggctgaaagccgcgtcggtattccgaaaagtaaggcatctcgggcaaactacaaagacttcgccatgacgagttcggcatcaaggaggcccacaggctgcccccgccttttaggcccggttgccatagaccaagcccagcctatcagcccattaaaggc

SEQ ID NO: 14335 - DNA, 714 bp, Oryza sativa
acaggttttgtccacgccataccttccgccatagtaccaatgaggtacggcgtcaaggggtgcggccgaccaggtttcgcccacccacgccttcgccatagtaccaataacgtactgcgtcaagggctgcgggcgaacaggtttcgccacacccacgccttgcgccatagtaccaataaggtacggcgtcaagggcttgcgggcgaagaggtttcggccacccacgcccttcgccatagtgccaataaggaacggcgtcaagggctgcgggcgaacaggtttcgccaacccacgcctttcgccaaagtgccaatatggcatggcgtcaaggcctgcgggcgaagaggtttcgccacacgccatacccttcgccatagtaccaatgaggtacagcgtcaagggttgcgggcgaagaggtttcgtccacccacgcccttcgccttagtgccaataaggcacgacgtcaagggttgcgggcgaacaggtttcgcccacccgcgccctttgccacagtaccaataaggcacggcgtcaagggctgcgggcgaagaggtttcgccacacgccatacccttcgccatagtaccaatgaggtacggcgtcaagggttgcgggcgaacaaatttcgcccacccacgcccttcaccatagtgccaatatggcacggcgtcaagggctgcgggcgaagaagtttcgccacacgccatacccttc

SEQ ID NO: 14336 - DNA, 39174 bp, Oryza sativa
tttagtacttttagtttgatttcttcaattacaaagttttttttttatcttctctttggtctttaaacatttattttagttctgaaatcgcaattttctaaattttgtttgaactgatgcttaataatttttaacaagaacatatttgtgtgcatttgaaccttgcggctttttttgtgctctaacgtttaaattttggccttataattaaattctagagttacgtctcctttttcatcgaaaaaaaatatatattggttgcaaggtggacgtctaaattcgctcgcaacttattgattttatgaaaatggtagttttgtcgtaccaaacgatttcttggttctctgttgaggcttcatttttcatcaagaaatttatattttgtacttttaattggattccttaattttgaaacattcttcttgcatcaattcttcaaatatccttcttggagtttccaattatttttgttgtcacggttcatcttccttaagttcgtttgaactttgttttctggtttataaaaacaaaatattcttttgcatttttccctaactgatttattttgctcagacattagtgttgaacttttaattgagttgtaaagttgagtctccgtgtttattgaaaacaaataactttgttgtgagctggacccttgtagtttgttgcacgttcaatcttttcggaaaatcacagtttccttgtatcaaacgtttctagatttctcccttaacgctttattttccgtcctttcatttaaactttaagcttttagttagattgctttatttttttaatgttctcttgtatacatggttttgacatgcaatttggactttaaaactttactttggtttattgtgtgatggttcttttatcattcttaagtttcaactcggtacttcgagtttgatttcttcaattacaaagtctctctttttgcaacttctctttagactttaagctttactttagttcagaaatctcaatttgctaaattttgtatgaacttatgcttactagtttgtgaaaaaaaaattagttgcttgcatttaaaccttgcggcttttttctgctctgccattttaatagtagacttataactaatttaatttctagagttatgtttccctgattatcgagaaaaatatcttggttgatggataggcgtctatatttggtggcatcttattgattttgtaaaaatagtagtttgcttgtccctaacgatttattagtttcgtcgttgatgcttcattttttatccataaatttaaattttgtacttttagttggattcctttattttcaaacgttcttcttgcatggattctttaaatatcctttttggattagaattattataatctagattattagtaataatctaaaataaacaggtagattattatgattgattataataatctataagcctgattagtataatctgttaatctcctctaaacgtgcttttttcaaattgttgggtggctagagactcactacccttattataccataatccacatgaacatacaactcatagcttattcgactatagcttattataattcagcttttattaatctggctcaataatctggattacaacaatcttaagttgaaacaaccgaggcctaagtttatttgaactttgatatctgttatatgaaaactttatttttgtttcttgcatgacgtttgttttttcattattgaatttcaactctaaagtttctctttttggaacttctctttggactttaaagatttattttagttctcaagtctccatttcctaaattttgtatgaacttatgttactagtttgtgaaaagaaaatagttgcttgcatttaaaccttgcggcttttttgtgctcggatgtttagacttataactaagttctagagttaagtttccctgtgtattgaaaaaatctcttggttttgggctagatggctacatttggttgcatcctattgattttatgaaaaccatagtttgcttgttataaatgatttattggtttctctgttgacgcttcgttttcatccataagtttaaattttgtacttttagttggatttcttgattttgtaacgttcttcttgcatcgattcttcaaatatcctttttcgaattttcaatttatttttggtattacggtttgtcatcgtaaagtatgtttgaactttgttttctagtttataaaaacaaaatattctttttgcattgaggattaactgttttattttgctctgaagttaattttgaacttattaattgagttgtagaggtctatcttcttgtttattaaaaacaaataactttggtgtgaactggacccatgcattatgttgcaccttggagcttttatgaaaatcgcgatttcttaggtttgtccattcacgctttgtgttccgccctttcattcgaactaaaccttttagtttgagttctttattttcgaactttctcttgtatcaattgttttgatgttctctttggactttaaagctttaatttagatttgaaatatcaatttcctaaattttgtttgtacatatgattactagtttgtgaaaagaaaatatatgcttgaatttaaaccttgggctttttttgtgctctaacatttttattttcgacttataactaagctctagagttacgtctccgtctttatccaaaaaaaatatgttggttgcgggctagatgtctctatttggttgcatcttattgattttatggaaatcaaagtttacttgtcccgaacgatttattggtttctccgttgacgcttcatttttaatccatatatttaaaatttgtactttaagttggattccttgattttgaaatgtttcttgcatcaattcttcaaatatcatttttaaggtttccaatttttttttggttgtcacggtttgtgttcgttaagtttgtttgaactttgttttctcgtttataaaaacaaaatattctttagcattagggccttatcgatttattttgctctgacgttaattttgaacttataattgagttgtagagttgggtatccctgtttatcgaaaacaaatcggaaaacttaagctacgcagctggggcagccactcacgcgtgccatgtcggattgctacagtgcgcacggtggaatttagctataaagtcctccggtttctacgtaattcgatctgaggactgaggtattattttacataggtgcccttagaaaatatggatattgcatgcgaagaagagaaaaatcgcggattagggctgcgctctaaaatgtggaagccgagcggctttttggcaaaaggacaatcactaacccgaaccatgccccaacccctagcctctgaaagcgcatagaagtcaacgcgataatagattgatcacggacaagatgtcacgggtgaggagattggaagggggattgcagcgaagagagtatttgaacgcagttgttgggcgtgaccctggacctcgtcgacacggcggagccgttttcggcaccacaccagctgtaacaccccaagtaaccacgtacctagagtgccacatcaagaaacactcaaaccactaacttccaaaattattagaaatttcggcagtctcccctgtaaatacggacatccacgacatgcaattataagttaaactaataacaatatcattcccacaatacgacccatccttataatccatggggaagaaactactagaaatctaaaagattattacaagaccaaactaggatataatttaagtgtcattatggacctaagcaatatagtttgatagggtgcgagtagatgtggatataagggtgctacttcccgcccatgcatgtcggtgtaaatgcgtacctaaaaccaaataaaacacaagtgagtataaaaatactcagcaagtacaatatggaactagaaaacacatatacacatcattgacaataaagcatgaacagaaggatttctttctttgataggaaacacatttccaaacaccaagtcaaagaatataatagttcccatcccgggcaggcatgaattgaaatagtagtttccatctcggacaatagtgaatacatcctagcatttgccggcaaagccgagtaagcgtgatcagcgcttacccacaggaacatgaataaagatccaaattgaattcccatgactacgcatggtccttgaataattgaaaaccagaatcaaagaaccaaattgaaaccatattgcacatccatggcaagcatggtacttgaattatttaactagatccagaatacaaaatattgaaacaagaataacatcgtaaacataagatgaactcaaaatgtaaatagcgtgaacaataatctgaacattagtcacttatcacatagaaatatatcagaaataaatagatagagtaaacaatccatgaatcacacaattagttcgtcatgcacttgcctccaacgaaggattagtatcatgcacgatctggtggaccaccacctaatcacaaacaaaacctcagcaaacacattcaaacatgtgtataaaacaatgaaaaaggtgaacctactgcgccatcctatcaaaactcaataacaaggaacgccgcttggactatacacaagactgctgcttcaaacctttatatcttgaaatatgaaaaggctatgactgaaaatgtatacattttgaaaatctacagaacaatacctacaactttgatgtagaaagcatatttttattctgccatttaaatggtctaatttgcacttgaaagcaggcttccgaatctgtccagaatttcagactgtccacactaaaacaaccataactggagttctactcgcccaatcagggtgtactttaccaatatggaaagctaagaaaaaacttctacaactttgtctataggcggcctggctgattccactgtttaacccctccaaaaacagttcaatctactactatccagattatgacacaaaaacaacagtcatactaaaaaaaattatatctcctaaaccacttgagataaaatcgcgccctttggtcagaagatagatccaaacattatctaaaattcctagttatacactttcgcagaaaataacatttagagccccgaaacattgaaacgctgaagcactgcaaatctgcccacatgcagaactgcaacaaaccgaaccacaactacccaaactccttctctagccttccctaaccacgaattaaagcactaaagccatgctagaacaactgatacaacaaggggataagcctcacctagggtttctttagagaacttgtgaggagacaataagggagactccggtctaacccctccttctactcctctcctcctcctcgttccgtttttctacttcgcttcttgttccaagctatgaaggtggagatttagggagagcaatttgttgtagagggaagagatgcgaacacaggaggaggggagtagaaggtgccggccagggagaggggtgacggcactatgaggggaggtgggattcggttcccctctctctaggtttcaggggagaactaatggcctgggtttatgggccttctcacgctggcccacttctaaagatatttttcttttatttatttctgttaacatttttattttaacaagtcaacccaaactaaaaaaacctaactatcttttaatatacggggtattacaccagggaggcaggaaatacatcagatgtgatctgatctcaattgaattgacctacaaatttaaagcaaatccaagggatagaatcctagcaacttaagagataaagaactaacaaactccctaacaaactctaaaccggaccacacactattcctcgtcacggattgccgtcgctgttcctgttgcggcgccgtttatactataatccccacatgacatctctccctccctggagaagcaactcgtccgtgagttgaaaatctggataccgagaccgaaattcatccagcgacatccatgaagcttcagctgccggtttatccttccaatgaacgggaacttcacgaacaccacgcgccaaatggcggcccacatgaaacacgtcatgtaatcaagcgcccgggggtagatgaaggcgatacgccacggcgccaatgacaatgcatcccaacttgccgcgtcccttgacagcgagagacgcaatcggatggtgaagcaaacgaagccaaacccagccacccacactgaactccaatgcacgatgcttgccgtcatacgccatcttgtaagtctgttgagcttgttctaaacgatcacgaaacgccctcaggaagtcgtcccgctcctgtaacgcctgttgaactgcgggcagacgacatgaacccggctcgtaggcacgcagcgtcggcggctcgtgaccatagacgacgcggaacgacgatgttcgaagtgacgactgatacgacgtgttgtagcaatacatcgcgcatggtagccatcgaagccattgacacgaacgattcctagtgaaacatcgaagatacatcatgatgatcttgttagtcacctcggactggccattggatttaggtgaaaggctgatgaaagattcagctgcacacccgccaaccataaaatttcacgccaaaaagtgctggtgaagactggatctcggtcgctgacgatggagaccggaaaccatgcaagcggacgatctcagcgaagaaggcagctactaccgacgtcgccgtgtacggatgagaacgggatgaagtgggcaccgttacgatgaccgtcttgccatgtactcgcgggagcccctcgacgaagtccatagcgatgtcagcccacaccgccaaaggcaccggcaaggattgtagcaggttggccggttggaggtgctccgtcttgttccgttggcacgtgaggcacgcgcgcacgaaatcttgcaccgtcgctctgtcccgcgagatatggaaatccgcgcgaaggcgagatagggtcttttgcgttccctcaagtcccaagccatgcaccgactcgaggatggccggcaatgattcggatgatggcggcatgaagacgcagcccttgaacatgatgaggtcgtctgtgaacgcctatgctggcggtttggcacccttggtgatgtcttcacaaatggcggacagggcgggtgtggaggctacctcgcgggacaactcatcgaacagggagaattggtgggggggatgataaggcgaacgcctccgccaggtgttcgtcccatctagagagcgcgtccgccaccaagttcgccattcccaacttgtactacacgccaaagtcaaagccgaggagcttgcttgcccactgatgctgtggaacagtggagagacgctgatccaagaggaagcgcaagctgcagtggtcggtgcggatgaggaagcgacgcccccacaagtatggccgccaatggcggaccgcctggacgaggccaatcaactcgcgttcgtaggcagcgagcttggcgtggcgcgacgcagtcagcttgctgaagaatgccaccgggtcgatgccttgatggagaacagcacctaggccggagcccgacgcgtggcactcgacgatgaactccttgtcgaaatccgggagctggaggactggggccgccatgagtgcgtgttgtagttgccggaacgccgttgccgcggtgttagaccagtgaaagccctccttccgcaacagcgccgtgaggggcgcggcgatggtgccgaagtcgcggatgaaacgacggtagtagcccgccaagtgaggaagcccctgaccgtgcgcgtattcttgggcagtggtggacggagaaggccggggcagttgacgcgggaaggagcgaaaccgaccaatgccggtcacatctggagcgtaccgttccaccggttgagtggcgagggccaattggtcaactggtcgctgctagggtggctagtactgttgctgctgttgtcctccgttgttgttattgcagcgacggttgcggttacctccctgccgatcggtgttgttgccacgatttccagcgttgccgtagccggtggagtatgcgggcttgcttcctaatggcacccccccggaagtggaaggtcggcctccagtgccggcgaggagagcagtagaagcttagcaaggacgacccttcgtcagttcttcgagcagaagttgagcacgtacttcggcaaatgtggggaaaggtttctgcatagtgaacgcagattgcaagtgaccgaatttttcattcaaacctcggattgtagttagggaaagagtgcggttgcccacatcgtccaagtcgtctgccatggtcttcaacaggcaacagtagtcgttgatgctcaaatcatcttggtagaagttgtaaaactcggtggagaggttgagagcgtgggactcgcggttgcccaagaactgaggtttgaggccacgctgcacgatgcgagccgtggtgttgtgcgtcatcacggactccagtaagtcgacggagatggtgccgtagagccacaaaactacgatgcagtccatgcacatccaatcctgacgatccggcctgtagaggttggtgaggacgtgatcggcgagcgcgtacttgtcgagggtgacgaggatgagaccacaccattgtgtgtagttgccgaagttgagatcgagggtgacgggcatgagagacttgatgttcagcatcgagaccgcctgagcgtggagattggcggtggcgtcattgttgaggtcgacgttgtagaagttctgggcagtaggggcaggagcagcaccggtcatcagagggatgaagccaccgtagccgggaggaggtggtggtggtgcaccagctgcttgaggaggaagacccactagagggagtgttgccgatgcagcgccaggcgtgatgaagaaggcggagacgtcctgagcaggcagagcggatgcagaggcgtcggaggtgccatagaggccaccggtggcaaggatggccgtgagctctggcggtagtgggagagagatcggcggtagtgtcgtgcctaagggggcagtggtgaagagcccggcagacatcgtcgcagccgtcatggtggtggtcgcggctgaggaagaagagttgtcgccgtgtgggtgttgccggcgatgaaagaggtgccagtaccagcttctcgatgaaagaggcaagggctttcctggtggcgcaggcagcagtggtggacgccgtgtcgatgacggaggcggctatggctgggtcaacatcaaccctagatgagggttggaagacatcccgaactgcctcggtgaccacagatgtgatggtgtcaattgcggcagagggggtaaggggagcgttgtcggccatggcgcaggagcaatgtggtggcggcggtggtggcggcggcggcggcgtcagaagcgtgcgtagcagaggagcgcatggcgcgatgcgagattagagttggaggcggaagctaaaagcatctgataccatgaaagcgtatagaagtcaacacgataatagattgatcatggacagagaacatatatagggacggtggacctgtatctctacccgacttatagaaacagaatcaggagataattaggaaaccgaacccaatacaaatatgactctaacagcctctgccgcccgctcccacacctgctccctctcccgcgccgccaccgagcgctgcctacgcctcctcatcgcgctgccacctccgccaccgccgtcaccgagcactgccacaacaacgtcctccactgccgccgccatcgctgagcgccgttgtaatgccccgaatttcgaattagcatatttcggggaatattatagcaaacgagcaaaagttcaacctttaaaccgttgttcgaataggcgatcaggaaccgtggatgcgtagagctcgccgagtagtgcaaaataaactactagtttatagaaatcagagtccgagcgaagtccccgggattgaaacgatgtgggccgttggatctcctttgtctctttatataactaacaaaaaaaaagaaagaaaaaaactctcgctacagccagccctagccctagccgctcctgcgctcttgccgccgccgccgctgccgccgtcgtcccggttgccgccgccgtctttgcgctgccaccacggccatagccggaggccgcagccgtcgtcatccatcacaacctgtgtttcctttccattttcctttttcccggtgagttctggcggctgttccttgttctatcgttgccaatctgattgcttgttgctggggctactgatgccatgcgactgctgctgctagggttgttgctgctgctgctgttgttgcttgttgcggtggccctgctgctgttgctgctgcatgatcagaggagaagggtagagagaggttgtacaggagggagaaggaaaggaaaagacagagcagcgttgaggaatttcagcaatttcgcaaattagggaaatttgtcgcaaggtagtgttccttccctgcaaaggcaacttctctttagtccctagaagtataagattcaaatagaaattgattggatagctgctcgtgcaattttttaggtgctttattataggatgaaaccatgttttcaaatctggtatgaaaccatcaggattcaggttagttgtcctaaataaagtttgtagtcatcgttgatatctttctaacgccgctggtttcgctcgattccgataatcggtttaggagaaacaacaaaaacagtactgttgaccaggtccgaaaatcaggacaccaattcgttttttcttaatatgggatttacagagccataatctgattttcctcccaacataaaagttgtagagaattttatctagatgtcaaagttatattattttctagattccgttagacggtttgcgagttacacatagaacagtaagggaactgctataggttaattaatacaaatcggtaaaaaggtctatatattctaggttatcgattttagtaaatatcacttgtaactatagttagttgaatatagtggtttatgcgtagctttgctccacaggtgtggagggttccaacattggaggagttgagtcggagtatcgaaggagttaagacaagtacaagacggacttgtgtgatgtataaactgtgtttcttgtttgatttcacatacccaattattattcgaaagcttactatcagtaattatgtggatttggtatcattgctacatatttacgtttcactttatgttcaagttcacgatgttattcatgtttcattatttcggatgtttttgtttacattattcaagtaccatgcgtagtcatgggagtgtaatttgggtctttattcatgatccttgagaagtgttgatcacgcttgctcggcttaccggtaatgctaagaggatattcatacctactcaggagggaactactatcttttgacttctttggtttaaaataaagtaaatccaacccttcatattggtttcttattgcattaatcatgtgtatgttttactagttcaatattgtacttgctgagtattctttactcactcttgtgtttaatttggtttttaggtacctaatgacattgatcggcatggggcgggagtagcacccttggactacactttattattgcacactattgaaatttagttttagactatgtttatgcatagcacaagttttgcgttgaacttgtaaaggtcatttaaagttctggtccttattttcacgtggaatttgtggagctaggatggtttggattgtgtggattatatcggtattgacttttcttataactacctgttttcacatggaatttgtggagctagaatggtttgtattgtgtggattatatcggtactgatttttcttataactgcctgtcgtggatgtccgtattttttaggggagattttaccgaaatttctaataattttgggacttaggttttgagtgtattttggtgtggcactctaggtacgtggttacctagggtgttacagccgccactacatccttcgtcaccatcgtcgatggccgctgctgcgccctctgttgccgccgccatcgaagaaacggcggtggtgacagaacagacgtcaaggaaggcggtggctgcagcgacaagaggagaacggcacgttgccaggctctcgagctcacccctcatcagtgatccgttcttcgctcaacctcgctgttgtcgcaggctccaaacctagatgacggtacaaatccagtggagctcttgctgctcgtcacctctcaggtcggtcccctctccctcaggtaactgatgtacttaaggatactaaattttacattaaaaaatgcattacctttcttgaaaaccaaaaggacacatatttttaaccagagtgaatattattttcttttgtacatatgatttaattggaattgatatcactccaactcttcaagtccatacttaatatgagtacatttcaggcggcccaaacgggggacacaatcctcctatgtcgccgggacatgcataactcaaatggagaaaggccatggaaggatttaagcagaggcaggaacaactagaatgtgcactgcttattcatgttcttccttctgtttcatattactcatcgtcgtcgttctaggatttaattttatattaaattatttgtcgttttctcgatccaaagaaattttaaaggtgatcgatattattccctccctacctacagtaatgcagcaatacatattgatgcggtcataattggctcatctactttgaaaagataattaagatgtatctgacaagggcaaccatgtaatctttcacatcttcatggtttgcacggtatttgcctggataacaagtaaattggaacagagagagtacagttttagactttcagtgtgttccttccaatataagaaggggtaattgctcatttcaccttgtagtctaaccactaatttgacttttcaagtttatgtatttaacatcgctttttaaaatcggagtactcgaggttgatcctattccatgaaggtaagataatggtgctaactaagagacgaattatcttttttcctttcctcatttgaccatgttgtataaacgtttttttttgtttgctcgaaattttttgacatactttaacacattgagcatattttgatatatttgagacaagtctaatagatttctcttctttttaataaatttggcttcaatttgatagaattttgacaaaattaaactttttttttgcaaaattttgagagcatgtcgtctcaattttgttcatccaaacttacatacggtgaagaaaaacacggatatagctccagaaaggagatgctcggccggcaaacagaggttgatccattgtcgccgcccagccggcagccgcccttgaatcaccctttgctgatggccgccccgctgaccttgccgccttggctgtgtgtcacgagggcccgactagatatggacagagcgagccagaggtggatgtcgagctcgatgcaggagcccacctaccgcgtcgttgctatcgtcgccactgtcacgtgatatcaccgtcatcaagcccattgatggctcgattttcttgcaccgccatcgcggcttgttgtgtagttggtcgccattgatagacccaaaaccaaaacctaaactgtgaatcatacacagtgacgaatccagaacaaaagttaccggagatccgatacatataattatttaattattaggtaatatattaattaatatggtacaaattagttagaattgaataatttacacgggtccggtgacctaggaaacactacgtagaaacacccctggccatggaactgcgtgagataagggagagaaatggtcaaatggagatatgacataagatttttttaaaaagtaatgaaatgggaacataaaatagagggaatatgagacaataaaaatgcatacttagagtggtattttcaagttcatttctaactaaagatcgaggaatggataaaaattagatgctagagcaagggaaaaaaagcgagagatgtgtgactcaattactggtcaaagacaaaatatgttttcgtggatgaaatagtcttccccttgacctttgactgcaggaatgacacggaaattctgggtgtgtctagcaaccaaaaaagcaaaagagtagacttatagttgatcaaagttgattacatcacattaatatgatagtactgaagtatatatagaccagcatactactggaatagtacataatttgttcacaagctgacaagcggcatatcgaagaccttttttttttcctgaacagtaacaaatagtataataagtgagccgataatataaatagcctatcatggccgtgagacaccagttaatttcagattatatatatggccgtcgatcgagctagctaagcaaacacaccatggctgcttctttcatggctcgcgtcgtgctaatcctagtgctgtccctctggctgctgccgtcgcttctgcccggttctctcgccgccggcgcttcatcagccggcaacgagcttttgccatgtgagtaatctgccattttttttttttgggaactaaacaagcaggagctctgtcaattatatttaaatcagtagagtaaaaacccagagacgacgatggttaattacaggaaaagaaaaaagaaggttgtcaatctctattaccagtactatagtcaatagttgttttttatttcctcaaacattttatgtcgagaagaattatatatttctcatgttcaagtgaaatctgtggtgcagactactactgcaaccccgtaagttaacgtactgatcacataatattacgaatctagataaacccatgtctaaatttattgtattggtgatgtcatattttatttattatttattttagagaagggtatgttttatccggcatatacatctaactgtatatatgcagtatttttaaatcaagaacttagcctattatatagctagggaacttagctatcaaataacccaaactgaaattcgttcctataaagatttgaactcagcatcttaaaatgctactctatttaatattctatttaatattagatttatattttgggacgaaagaaatagtaattaagcatcgttcgcgtgtgcatgccagtgagcggtggcagctccaggcggatggcgatggtgagaagcagggagaggaaagacggctatggtttaagtatcgcgaaatcagcacggcgatctctccggcttacacccggttatgaacacagtaagcagcgcttggaattgacaacaaattaagtggtttgataatttgatgctgccatggaaagtagatcatgttgaatgggagatatatatatatatatattaatatatacacgaaacatatacagagtttgggaaactatgtaggttatacatgtttgattcaattatgttttttaggttatgaagtagatcagttcttttttcctcattatataacttttcagggttattactagtatgcgaatattgattccagccgtctgtaaaaaccatttctatagtagcgactgtcttgtaatattttcctgctatattaatatgaaacctcatacccggttccttaaaaaaaattgccacttacaaactattccagttgttttgcactttaaaatcctatttagaacgttggaattttgcatgtttttcgcagggacttcacacaagcagtaattaaaaaaaatgttttttaaacagggacaaagatagctagcttttataaattactgattttatcaagtattccctctaaacataaaaatttgacgtttcaggttaagatttggtcaaattgaccatcaatcacttctcaaatgcatattttaaaaggtgccgtggatagatttttcatgtctatcataatatcgaactcatgtaatatgaaatcgatagttaaagtttttagaaatttgaccttctaaacgttgatatttatgtctcgagggagtattagtatgtacgtaaagtttaggcaaaatttgttacaggatactcaaagactgtggtctttgttgtgagacacccgaagatcgtgtatttgctcgtggacactgtaaaaaagtggtaattagctgctggacactcttcccattattttattatttccggtcaagatgaagagagaaagagttgtgtaagtaccaaaatgccactggacactgttcttcctctctctatcttttttcccttcttcttccttgcagcagagcagaggtgcgagtgtgcgacggcggctggcccgagcctggacggctcagccatggcgaggcggcggcggggcggtgtaggccccacatcctttctttttctcttctttctctcctctctcgagcaggcgtggtggcagacttgcgtgaggcggccggcggcggagcagggggcggcggcgctggagagagggagagagacggccgacgcgatggcgagctcggcggcggagagtagcggcgcgcggcacggcagcgggggagagggggcgcgcgcaccgcccgtcctccatcgcgatggcgtgcagcacgttcttgtcctccagcgacgccggcgtgccgacgtcggaccacgaccaggccacgttcttcttgtcccggaagtccagcaggatgatgaaggaggtgtctgtccgtgggaacatggtcgctgccatgagcgtgctcgtgccgtcgagtcactggagcttgtcggcgtcgccgagtgcacagcccggcggctcgtagaagaagtcggcctgctcgccggtggtgcagtcccagacgccaatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcaggtcgccgggaaggcagttatacacgcgcaggtcgccgccgctcctccatcgctcatttgtacacgcgcacagcgctgccgtgcgcgacgcagcagccgccgtcgggcgcggcgcggacagccgtcccgtcgcccgcggcgttccctgccatggacgccgccagatgcagctggtccccgtcgaacggcccccaccgtgcctcgcggaagaggtcgaggaggccgtaatagagcgaggtagagcgcctcgcgccccccggcaaaaccttcgcgttgctgtcgaagaagaacagagaaagagagattgacaagtgggcccatggacaaacttgtctttaacttaagtttctctctccgttttcatcgaaaataataaaataatggcaggagtgtccagtagctaataaccacttttttaccgtgtcaacgagcaaatacacgatcttcgggtgtctcacagcaaagaccacaatctttgagtatcctgtagcaaattttgcctaaagtttattacttacatcatttcagaccctggggatggaccgcgtgaaactcctgtcactcctatagaaagaaataagcagccaggcaactgatcagagaaggaacacctctgatggcacaacaagaacacttgaacgaggaaatgattcagctgtgatcaacagaggttgtaataaaaactgttaaaaactctaataagaagttactccttacggagtaataatacttgtcattttgaacaagtctattattaaactttaaaaactttaaacatatgaagaccatatgtatagattagtattaaaaagtcttttcataaaatcatatgtattgatatttctatatatattgtaaaagaaaaatagtggtcaaaaatatttttaaatatcatttttgtccaaaacgacacgtattatcaacccggagggagtaacagatatgatagccagttgaaggattgtttgtctgttcattataaattttgtttcaattactcatacatattataagattatttgtaatgatgatcttccttttttttcttccctgccacgcttcgtattggcatggtcagagtcttcttcatgattctctatgtgttatgtgttgacaaaaaaatccacgtttggctgataatgtcgggtctgtgttggcacgtactaggtcgacgaacacaacggcctgggagatctgcttagcttctgtgcagatccaccggttgataagatacgggcgtgccagtcagtttgatcatgcaactgacaagatatacaaatagcatatcaataagccaattggttgtcaagccgatggagtaattcagctgatgccgataccagccgatgtcaatagggttttgagcaatcggatatatgtccaatatagataacgatataaatacaattgattgatagcaatgtaataaaacaataataacatccagtagaaaccaatcggctaacaatgatataatagaataagcactgatccgaaggttaaaacatacatcggctgaatgtccgatgtcataaaatccacaagattagataaacaatgaaacctttgttgcaacgggctaaatccaacttgtatgcaatccttgtaagccgaagcaacgtccagataactcatttgctgaaacctcaatgaaatccttattagcaatcaagaagcgggctagagattatggttctaagcacgacttaatagatcagacttaactaatgcaatactaagtatgaaaagaaacataatatctagaaaatcaaacatttttgtgtgattttcagggtggtagataccttagctaatctaatctagtaaaatgatttagccgataccagcataaaccctaaagcgagaatcggccgatatatctaaattgatatactaagaccagattaactaagatatatgataaataggtaggtaaatatatcaattgaaccagagcaatccaagaggtcaaatacactgatgcagccttgaacgacgccgatgaagccaatacaattgccagggccggcggaacataggacttatcccttcgtcagagattgaaagccgatgcaacccccgtcaagtgccaagtttcgtcaatgataagtaaaaaccttggtaaagaggttggcaatgtgccaagagtagttgtattgatctaggatatagtttacaataaccctgggtgcacatatttatacccataagtagatactagtccttgttggataagaaataaactttcctaaagataaaaggaaaacataaagtccttattgacactaagcacatttttctaaagacaaaaggaaactaacagactcttcctaattaatagataacttgccatgcatgctgcatccttcttgaactcggtctcttctggataagcttccctgaatagattaatttccttaaccgaatatagcaagaatccaactattgccgccttgataattcccatcggccgattacaggactctgaagccgatactgattctagatcgatgatgacttcggggcttactaaatttcactgttaacactatgtcccttctttcgaaagcccaacaacattaattgtcaagaaatcttcagaatacatttgttatagtaggggcctattgatgagaatgagagggtttattcttacacaccgagttgaataatcatgttcttaaattcacatcatcacatcacataccaaaattatcgaatactataaatgtacaaacttattgaaatgccggtagaaatatatcaatatttgatattgtcttgtatcattaataatcgactaaattaaccagcaagttcgaatgtgcaaatattacaatataaagaatgcaaatacaaaagatcttagacaaacaaaaaaaataaaacaatgccactaccttactctgcgcttgctcttagacatgaaagttttattacgtcttaactttagagaagatatttcactcaataaatatgactaagaatgattcaataaatcatcacataaattgtttctcaacttgttttcactagactcagtgcagaaaaaacactctcaacacttacagcggttaccgccggtaaaatcaataccaatttaagaagcaaatacacaaaatcataaaaaaaacatggttgtttgtttcaaaaagcaaccaattgttccaaacgcatgaataggtactaaaacaattttgagtacttttgtttttgcaccacataaattttccggtgggctcaccgactcgtgtaaaaattatttttcacaatcaatggtgtcaagcatattcccatatgcctgaaaacacttttgagtggtttcgaatggtttcattttcgcaccacacaaactttccggcaggcccaccgactcaagtaaaaatttctcacagtttggatgtaaaccaaatctattactttggaggttttatcttcctgaaagatttcaatattctctttacataccttggacatgtcttgatggcttcatgttatttttagaactattcaccttaacaaccaccgtttgctaaggtgatgaacatcacactaacatctacccataatggcatccaatgcacaattctgcgacgcgtgagtcacatagaaatttttcacaatgaacgcatccaatccattggtatgaaatttatggtttggtgctttttgaaccattccgttccggtgataaacttcgcaaaaccataaacccagaatggcattcaatgcccaactttacgttgcgtgagtcaccaaaggtgagtattttgataactgagcagaagaatatgactatagagttcgaaaacccgtaaacacgtaatattgcttgaagttacacattgagcttttgttttttgcgggcttcctgacccatcaaaccttagcttcatccctaagggcggcttgcaaaatggcaccccctcgccgccctttcgcagcgccccccaaacccaaacaaaaaaaggggcattctagagggcggcaatgggtctgcctacaaaaaatcctaggccgccctcacagcccttctgtaggtggcccttagcgcgaaaaaaatgctctctgagaggactgaaagaaacctccgagaggatggcaaaggggctgcctgcaaaatattcatccctcggcgggcagtcgttaagggggttccaatggccgtctgctacgtaggataaaacttctttccggagagcgttttttaaaaaacgccttctccaagggcgtgaggcgactagtattgcaaaatattgaaacaaaaatcatttttcaatattttagtaaataaaataaaaaaatccaaatcgacagtagggagaattgactgataggttggaattttgtggatgcctacgaaatagcaaacacgataaacatgcatgcagagagcaagctagctaattcggaaaccacacggaaaatattgaacaatagtttgtcccaaaaaaaaaatacttcaagagatatcccgcctcttcaacttatatattatgtaccgtgataggaatgtggcatgcatggttatctcgcctcattctcagtcaacgatttcatcagcctggatataactaatttatcaccgactcagattgaatcagtcgtgttgaaaaattgacatattattcagcgggaaaattaataacccttcttaattcttatgtgcctaggtagcttaacttgtcaagggatttaaatactcctaccatgcaagtagctagcatagccaagctacacacactatctgcagcagcgaactgaagtgaatccggcgaaaaaatttctgatctctgaagcaccatggaagctactgctcgacttcgcgtggtggcaatcctactgatgtcgtcgctcttgctgtcgccgccgtttcttctcgccgacggctcatcaggaggaggtagcagaggccgggagatgaagcacgatgatggccatctggttattgctccaagaaaattgacatggcctcgtcgagttctaaactctggtaagttcaaataggacaaattaattatgtctctctagatctccctctcctttgatgcaaattacagagaaattcagctgccagttttaatagaaggttgaactgaatcctgagtgaggtgcatacaattcacgttttcatatatacatatggctcttttatttcctgggtacaacttacaagtgaaacccacaccatacttacacacctgctcggatgtgttctactccctccgtttcacaatgtaagactttctagcattgcccatatatatatagatgttaatgaatctaaacacatacatatgtctagattcattaacatctgaatgaatatgggcaatgctagaaagtcttatattataaaacggaggaagtaaataagacttttttttttcaggcgatcaaccgaaccacgacccgatacataactctcctatctccccaggaagaagcaaaaatgaagtcaggcctggcaattgatgagagagtatccataaacacaaccacataaaggattggcatttaaatttttgctggaaacagatactctgcatttctgctatctgactttgagtggttgaaatgtggatctcacaaccaatggccctatgtgtcaatgatccaagtaaaaaaaaaaaaagtactgtacagaggagactcatcattttcgttgacagcctaaaacagtccaggaagagttttttttttcttcttagtttttttcttgggtgtgtggtctaaaagaacaacggcagtagccctggttattcagttatgatgttgttattgaaattattttacggatgtctgttcattagaatttagtggtaaaaaaagatattttcataggcaccctcttacattgcacatacagtcagcaagagcaattgtgcctatggaagccaatttctcgttgagcgcaattcctattttagttatccaaaacccctaataaagcatgacaaaagatggacaattaagccattgatataacgtttttcacgacatgtaccacatcattcaccatgatgttgtcccgttctttgaccatgaagaggaatcgataacaaatgaaaaaaaattaatatcgacctctttaattatgagtgggataagcatatgaaaaggaatttcacctagccacctatggaaattgttcgaggtggcttgctggtccacctgtgaaaaccactttgaatcgtctataaaattaactcttacaatagtgatactttgtgctaacacttattatatgttctagcactaacagttaattaattagtaacaatgggcggatgcgacgtaagatattgggcaagaattagcattttgcatgttaaacataatcaacgctttagtagctgtttagctcgcacgacggccgggtattattttttggtgaccaataattttttagatatcttatagttgagggaaaaaataattatgccgacaatggagtcgcggccgcgcgcccaaccggtaggattgcatgcaaattaacaagttatttgcgatacatgaagaaacacgcttcgacagcttggttgttccaatgtccgcatatcgtgtttacttcttcatatgcatttcttgtaagccctaatacttgattgaccccttcatttttgaaataataaaatcttcagaaagttatgtatgtaggcaatgattaattaataaatactccctccgtcccaggtttaaagttaaaagttaattttttataggacggaggagtaatagctagaaaaacatctttgtatggtcaaaatgtacgaatatccccctaggtttaaataaaggatggaccacgcctgctcacccatgccaaatgcccttccaccgcgcaacatctcagccaaaggtagcatatctgcactcggcagcatgtgtatacacaagcctattgccatgttttcacggcctagcattctccacattgcaaagaatgctaacgataactacagatttatatctaagaaagagggagaacttcatacatggcacactacatgctacatagctacgtgacatgcctcacgaccttctcccaccactcactcataaccctcatagtaattttgttactctcaagacacgctctccacacacatccataatagtaatatttttactgcaacagcctaaagagtgggctagggatgggaaaaagtgggttttctgggcttagaaggatgggctggcggcgagattggtggtgggtgttgacgatgggcagaaggcgtggcggcggagctacgggaatggaagcactagcggtgggtagggctagcagtatggatgagggaggccatggcggtcagtggtggtgaatcatacccgatggcataggggaatggtacccacactggcttaggatggaagagaggtaggggtggaagggggaggaggccggtcaggtatagggattacaagcaccattgacgtcttctggtcaggtggcaaggttaggggcaccagtcgggcgaggaggaagaggtgctgaaagactgtgcgcgtgagtgcgtgaacgagcgaagcgaagaagagatataaggggatacaagaagagtatgcacgaatctcaatgcaatcctaaccattaaaaaaatacttcatccgtcccataatataacaatctagaattgaatattttatagtacaacaaatttggacatgcattatgaaatatcacatctggttctaggttgttatattatgagacggaaggagtaactgaattgaatggtatttttcagttgactagacggtccttaatttttcaccccatgttactatctacctattgtcataacgtgtttttcttcaccgttgatcaacccaaagcatttgaattgacttgttggacgtctcacgtttgattgggtgcagacttgacaaacgtaatcacttgctttcactgcccatcaatgtcaaaataaatacaatgatgaaatattttctagtgtatatatgaagacagagagcgcatttgtgcatgttaaattggcacgcatgcatgcaaagaagtggtcttcgctgttccttttgacagtttgactgccggaatcatcacacagattgtttatgtctgtcagagtgtcagcagaaacatatcataattatagttgagttgaataggtcacctggataagacattgaaccttacctatgaagtttacgtatacagcaaacacatttttctgaataatcacctagggtgtgtttagttcacattaaaattataacaatatgacgaaaaaattgaaagtttatgtgtagaaaagttttaatgtgatagaaaagttaaaaatttaaagaaaaaagttgggaactaaccaggccccagcagagagagtaagagagcgcgtcgataaatagccgtacaagggcaacaggtcaggcacttattcagttcagttcagacatcacctagtacaatggcttcaccggcaataataaccatcctcgccgtgtccctcctgctgctgctgccgccgttagcgcttggctccatcaccggcggcgatcaacgacgcaaggagccttggattactacgatatgtgagcagtcgatcgatctctgaactttcagaaaatggaactttctggtggtaactaatatttaactgagcattaattactcatgtgttcatggcagtgaacggtggcggcagtattgcgggcatggagctgcagcaacgacgacgaggaggccatggattgccggtgatggtgagatcagcagcacggcgatctctcggaggacgatcgacacccaacagtaaggccaacacaacacacgtaatgaaaataaacattaagtaaggatactgcatataacaggaaggtaaaactaattagagtaaatttcagaaaactacatgttgtatggttcaaattgcagaaaaccacacatattttgacagttgacacttaagtacatatattttggtagtttagtttcacaaaaccacactatcaatgaatggattcacccgtgagatgatgtggttgttccatctaggatgaggacgtggcatcctattaatttcgtgcaatggctggtaataggatgccatgtcctcgtcctaggtgaaacagtcacgtcatctcgcgggtgaatccattcattagtagtgtggttttgtgaaaatacactaccaaaatatatgcacttaagtgccaagtgtcaaagtgtgtgtgattttctacaacttgtactacaaaacgtgtagttttgtgaaatttactcaactaattaatactccctctatctcaaaatataacaatttctagcctttagaatttgttctaaaatataacaattttttattaacattcttttcctaatcaatcacaactctccaccattcagttttcttacatacttccacttcttgtctaatcataaccttcccccatccaattctacctacttttttaataattgtctccaattctaaaaatgcttatattatgggacagagagtatataattaattaagtttaaaaaacatgttaataaaaattgagatagaatttgtatcttaataaaaagaatgagatttcagtactacgagtatttggcagtctattaactggtaccctgatcggccagttaggtgacattaattgttttttttttgttttttagaccctggtgatggtggacgtaaccctccagtctcccctgcacgagacagaccagggacggaagcctgatgaaatgggcaactgtgccctctgtgcccgagagaaattggtcccttggcagaatatccatgatttggtctgtgtaattttgtgcgaaaattgatcagaggcgccacacctgatctcagtctaatgggctcagtttgcggtgatgttgtactacatgctgacacaataaacctatctgacaacaatctgcatgccacaaccgaggcaaattgatgatatatatacagtgcacaaaatttattcagatcagattacatatttggataattttaccatcctttaatttagacgataccgataaatactatatttttctaatatcaaattttaatatctacgtgtactttcttaagaactataaaatttctcaatatatttagttacacacaagctagcactgtgtacgtatcatagccacagtagtgagtagtacactgggacttcaccgaatcagtctttggatactcactaactaaggctgtcgggcagagggcggtgaccaaaagcaaccctcccgcgggcagaccgacggcatcggctgcgggcgccagcgcgcccgtggagctgcaaaaaaaaacaacaacattaaacacaaattagtttgttggttcgtcgcatttacgagcttaattggtgagatcagcctgagaatatcgatcatgactgctcacaaggaggggtcaccggagtatggccgccgtccaccaccagcttgcaccggtagccgctcgtcgccgccagccagagcgccacggcgagctgaacgacggcgagtagacggtgtcgccgtcgcagcggcagaagcgccatcgcgacgatgtgctcaattagctcaggacggacgctaattaaagctaggtaaagtagagctctcgatcgatgcggtgaacttggccggccgccggtcggtaggtatgtacgcattatggacgtgcatgcacacaggatttgacaacagctagcaggtgattcacatgtacaagtggcgctgattagtcttcacttatatcctctaggacctctgctgtgggtgtgggcgtgtgcctaatgggcgatcgatcatccctatcccctctattacgctctctccccccttcctcctcccattcttctcttcttactacaccataaatttttaaaaaataaaaaaacaaagttggaaaaaattatgtatagaaatactatatataaaaaaaatatttgaatttaaattcaaatttgaaacgggtatgtaaacgtttgacttataaacttttggtctataaactttaggtgtatagaaatactatatataaataatatttgaattcaaatttaaatttgaatcgaatatataaacttttaacttataaactttgtgtctctaaactttaaatgtgtaaaaggtgtacaaactttaggtgtataaatttattaaaataggaaaataatacggtgccaaaaaaggaaaccacgtggaggagagggggtatcggctaatccgatcgctaggggcgatcgatcgccccatagccttttcgtctgctgtgctactactagttctaaattatttaaaaacactcgttgtattattttaaaaaaaaagaaaaaaacattttttttattaaacactcgttattttataagcaaatactattattttgattctactcactcgcaatttatattctatatttaacgctttgaatgagcttaaatgaaaattttgtcaactacgaacctgtagacatagtttagatatgtatacgactttcatatacattttgtctccatccgagatcatttagaaatattaaatatacaaatagatatgacaataacacattttcgcacatccaaatgtactcaaataaaaaaggtgataaactacagattgtagatcttgtcaagttctacaaattcataaaaagttaggtaaacaacacatatatgagtgatgtcatcatgagtgtcgattttaattgacaaccaacatctagaatcataggtgccggtttttattgaaaatcagtacacatgtgatctccaatatgtgtcggttcacaataaaaatcagcacctgttgggcgcactcacaagtaccggtttattataaaaactagcaactatgtaatgttcataggtgccactttattataaaaactggcacatatgacttggagggattattggtccttttttatgaattgcaccaataataaggttatgagcaattttactgtccttgaggaggtaccataaagtaccattttttctattataaatttggtacctcttgatacctaggtactacgaggtaccatgtggtactaaattttacactaaatttttggtacctcatggtatctcctcaaggaccgtagaattgctctaaagttataggtatcggttttaatttatagacctatgaaaaaggcaacaaaagtctcacatatgtcggtttttacgtaccgacacatatagtactagaaaagtgtttttcctaacgaccaaaactggtttttgtcggcggtcagcagtgtctctagcaacctaaggctagcgaaaatatatgattttcgctcgcagttgcggtctgcatgtaaaaattgatttttgcttgcagacacctatgaggaccggcagcgaaatctttttttttttttttgcaaaggaaaaaatcaatcaacactcagaaacggtgctgcattttcaaattcacatttagagatccagattcgaatcaattcaaatccacatcagatttagattcaaatccacatcaagaaagcactacatcgatattttccactacattttcaacgtgcaaacatcaacacactgaaataaaatagcaccaacaaatgtcgatcgttgtggcaccgtcagctatcggcgtgctggtcatcgtcatcacaggtggagtgagagtgagagaagaacttagctcggctagatccggagctgtgccaaaccagccgtcgctgctgagcctcaccgccctctccttccttctccgagtttgagggcgcagccacctgcaagagaggccactgccaccactccgtggatttagttttgtgatgaatgttctgggatgatttgatttgttgccgttggatttgtgattcagttttttaatgaaatttttggttgcatcgagccctttttattattattcttgagacaataaatgtgcggtttcaaaatcggcacctttgatttttctctgacagttgtttagttatttagttttctttagtactgtctgcaaatcaactccttgatagtactgatattaatttggttgacagagttgtttttcagatcccggggacggcggacgtgatcctccggtctcacctgcagggacagaccagggacggcaggctgattaactgcgcccaagatcgagaaatttggtgacttggcgtaaaaaaagaaaaactcagcacggactgaatgaaacaggacaacaaaataatgtaccctaaaatataagaaactagcaccaagtagtactactgattatactgcattgtgcatagttttttattgactataaattaaagctgatgcaaattgttgatgtgtgcaaatctgatgcaccaagtttattcagaaaacacacgtatagtagtacagtgcgttaattggtactccatacttaattttctcaatctttgttgctcgatacgacgacacatactatatagctaaggctgtaggcgcaagtgctggccggagcaaccctccggcggcgacggtggcggagggcgatttgcctttggagctgcaaagcaaaagggagaaaaaaaaatacatttcgttcgtcacatgtccatgatgttaatttgtgcgtgcaccggtgaagaaggatccggccgggctcgccggggccggagaagaagagagaaaggtactcacgaggaggagtcgccggcgtacggccgccgtccaccagcacggtcggcggcggcggcggtggcgggacggcgtcgagcttgcactggtagctactcgtggccgccagccagatcgccacggcgagctgaacgattgcgagtaagcggagtcgccgcagccgcgccatctgatcacaatcagaagaaacaagattttggagtgtcttgtgtctactatagctactgtactaaaatagcggcccggctgttcaggatttgacgacagcagcttacgtactccctccgtttcacatgaatcctaatcctgaagattaatttggatacacgctatgtccaaattcattcaaagaattatttctttttacataggaagtaattattagctcatcaagtgtacacctatatgccaaagtactcccttatactctcaggcatgctaggtagatagaagtgataacttattttttctaaaaaaagggatcatcacgtgataataatacctctaatatacatccgtcccaaaataagcaccaacctcatattagaatgtaacacatcctcataaaatataaatgatgtatcacattctagcatgagattggctctatgtccagattcattgtaatatgatgtgtcgcacctatatatattagtctaactaggatgatagcccacgcattcgcgcgggcatgtgtattagtttgttctgaaaatagttctaacaaaataaagtgaaattaaggtaaggtgttttctatttttaacagggtgttcattgtatctctttttgaagaaatctcgataaacttttgctggcaataaatgtttttttccaccttgtcaatcctctttttaattgattcatatatatgtgtaattcgttatgcatgtgaatcaataatgataagttcttttaaaactattagttatattttgaatgtagtgattgagtgattataatttcgaatttgttttcaaatcaaattattgtgttattctaaattttcattttaaggattttaatttgtacttaatctcgtatcgtgttgtatttggactcatcttttaatatttattttattattattccaaattttagatatttataacttatacttttatatggactgttttatattatacatgggatcttgttatacattttttaatagttttaatggttttttttaaaaaaattgaatgtgtattttaatcaaattgcttattttttctgaatttaattctgaacacctcggtgatagaaacgtctctctctggccctcctctcggtcctttgtccttcacctaatcatctagcatgctattaggcttaggaagtcatggaaagtctatattggcgcttccgtcggtgtccacctcgctaaggttgtgttcttcccccctcctttcccaacttaactctctcgttttcggtgcacatgctttccaaactaataaacggtgttttttctaaaagttttctatagaaaaattgctttagaaacatattaatccattttataaaaaaattaactaatacttaattaataataatctaatgtaatgagtcgctttattttacgtgcgtgggagagattagctccaaaacctatctaatgaacacaacctaataatatattgcagctccgcctccgttgagttcaggcccagggtatccaccatggttccaaactctttgatggtggttgaatctagactttagactcacatatttgaattcatttgtcttttcacagtgcaaattttgctcaaatatttgtagtcataatggctacattatctaaattttatatagtaaatatgggtaaatggatcttgaattatgtatttaattataaataacatgacaaaatgcaaataaattgagaaaagtgcatgtaacttgagagtcatgatcatttaactatctgattattattttttatatattatatgttagctagaaaataggaaatgttggctcgaaaataggaaatgttggctcgaaaataggagaggagactgggatcccggaggagagagttgaagggttgagagactacgtatgtacatgtgtgcccacacacggcggggttgggggtaccatattttcgtgtattggggataccatattttttttttgagagatctaatggttaaaattagtgggtccgcctatttaaagaaatatcaatggttagtctttttcttttttatcaaaacttttaggatttttttctaatttattagatcgtcaaatggcatcttaagaacatttgtaaaatgccatgtgacagtttgagagcgtttgtagggagttcaatgaacttttagtatataatagatgtttaatggattttagtatataatatatagatagatgtgtaaagaatataatgcagtaaactttcttcaaacattatatacgtttatgatgatgcagtctaggtttgcaaagttataattgtttgtttttaataatgaatgttatttcaattatccttagaaattataaaaggaaaggagagaaatatggacgtgataagggtgagcggtttcgcacgtgcgtacgtacttacttcatatgtacggacttatgggagagctggggccgttgtacattaatacaagggtttataatatcggacccactaatttaagtgaatattttaagggttagatattttgcttttgtagaatttctattatttatttatcagagcgccacgtggtagcttaggagtatttgtaggggtggcatgtagcgacttaggaccgatttaagtgaatatcgatggacaaatatttttgttacaaaataatataaaataatgggtacataatataatataatggtgtaaactttattttcaaatattgtagagctaatttatttatgttcacttgtagagatttgtatgctggtatattctatatttgtaaagtgacttttattcaaaatttattatcacttattattattattagtattattattattattagtgctactattattattattattattattattattattattatctcaattatataccggaaaaaaagagaaagaatagtaacgtaccttggaaaaaaaaggttatgtacgtgcatgcaccccctttaacagatcgcatgcaagcagtaacgtacctatatatggaatggaacagaggagttattttgagataaatctaatctaacggtttataatattggacccaccgatttaagtgaaaatcgagagatagatatttttcttttttctcagattttttagaattttttctaatttattagagcgccacgtggcggtttgagagcgttttgaggaagcttcattgcttatgatttagggggaaaatattgtttgtgaaggatcaacttctgtaatttttaatagaaactaggaaggaagcccgcgcaaatgcttgggtaacttatttataaaaaattactaaaagaagtcatacttcaccatattaattataagaaacgcttatttattatttataaaaataatgctaaagaatcctatatcaccatattaattaattataaggaccatagatcaccttataattatataaaaataaatgtctagacacaacaaaaagatcatctctacttcataccaaattgttcatgtctcacttgtgttcaaatatatgcataaatattttgaaatattactcctaccaattcatgggataaaaccattaaatttatgagtaagtatactattttttatgctggtatattctatatttgtaaagtgacttttattcaaaatttattatcacttattattattattagtattattattattattagtgctactattattattattattattattattatctcaattatataccggaaaaaaagagaaagaatagtaacgtaccttggaaaaaaaaggttatgtacgtgcatgcaccccctttaggaatggaacagaggagttattttgagataaatctaatctaacggtttataatattggacccaccgatttaagtgaaaatcgagagatagatatttttcttttttctcagattttttagaattttctctaatttattagagcgccacgtggcggtttgagagcgttttgaggaagcttcatggacttttagtatataatagataatagatagatagatttgaaaaatctcaatcaggttgagcaatcttcatcttggcatgcagaaaaaggggacacaatatatgttggaataatgggctaggcccaatttattctcaattaattctattggtccacaattaatactatggggattaatatcagcttgaaaatttaagtgggaagatctcaacttaaataaggagctattagagagcccctgttaaccggttgaggtggtggtgggacagccacgcgcgcgcgcgccgggctgggccgaggccttggcaaggtaggcaggcggctggtctctctctctcgttttcattttgtaacagacggagattgattcagtaatcaattcggttttaacgagagcgaattcattcgatgttaatcatgtgattaattacgcagattgaatccgagtgttatccttgcgctacaattcctctcagcaacagacagaggagtaacatctctctatctcctagcggactgtctacttcctcctcgattccccttccttttcctgagctgcttctggcttccccggttctgttcacttgcgcgcacgggtgatcaggacgagcaggcctccggaactccgtccagttgcgtacctgcatgggtaggcgggcgatcaagtttttggggagcgctcttgggcgcgactgctcctgttcgacaacggttctacactgctacatcttcgccaacatgtcgacggacaacaccaacactcgcactggcactggaaagcctcaactagtacatgagcgttctcagggtatatgtccattcccttaccgttaattatgctgctagaagatttttctgttaatgcttatcgcaatgttacaattgcgttactatgtgaatgttatacttattttatgaaaagcatgctcatgctgagcaccatcactagatcaattctcattgcaaatgtcatgtttattatcttgttggtggacctgcagccaattttgggtcaagaagaagagaacgaggtagcggagaggtttgaggtgatgttgtgtggtggagaaatgcgtgagatgaggattgtgtccgatatttcacttcgcaccggttgctcgatctgaagcattttcggatttgtgattctattttgaacatttgtgttgtggtactgaaatttccgagatttcagaaaaactttttaaaataattcgaactaattttagccaaatctaaacaaatttggaccaaattcaaaaaaagagaaaaaatttgaaaattatgacgaaatattttggtgtccggtgagggtccgaaatttcgggaattccgaacgaaaattataaacattgtgcatgggagtttaattacggggatgggaatttatcctcatgactccctgcctttcaatacgctgggggaattgggaggaaattcatcttcacttaaaatataatttccttctatactacgtaagactatcggattgaatccaataaacttctaaactgcctaagatatctgtccaaaattagagataaattagcaacaccataccaaaccaaccaaaatgacaaattaattctcagtccaaaattacatgcatggacagtgcagcaacaaccggcatccatgaatccataaaccgagagtggccaaacagctgctacttcacctgcactgcaacttcttgcgaatccttaaccctctgaatctgataggttgtcaagataatcttgcatttgtggctttgacacgacgacgatgacgaacactgcctgattctgatggagcagaagctgccatttcccgatgggcacagcaagctattcgaccgaggaatctctaccttcgctgccgatgcaacctcttgcaccggcagcaagctggtcgtcggtgccgaggagaagcccttctcaatgttgatgttattccaatacactcctataatcgataatattgtaagctaatatattgacgtgcaattcttttacgtcttcgcgaaaaaccggtaatgtcgtaaggaaatgcccccaaaagctcccacgtgttcacccttccaacctcttacaggctagatgttgaagaagcatcctgggccgttggatatcaatccaacgcatagcagtagtcgaccgagtagacattgacttgggccgtgcccggcccggcccatcgtgcttcgtgccaaaacgggccgtgccggaacaaccccccaccacggcggcggcggcggcggcgccatggcgaacagcggcaagtcatcgccggcggcgacctccaccaccgcgccgccaccgggtcggccgaaggcgaaggcgccgcccctcaccgtcgagggctaccccgtggagggcatctccatcggcgggcaggagacctgcgtcatcttcccgacgctgagcgccgccttcgacatcggccggtgcccgcagcgcgccgtctcgcaggagttcctcttcatctcccacgcccacctcgaccacatcggcggcctccccatgtacgtcgccacccggggcctctaccggcagcgcccgcccaccatcttcatccccgcctgcctcagggaccccgtggagcgcctcttcgagctccaccgctccatggaccagtccgagctcagccacaacctcgtccccctcgagattggtcaggagcacgagctcaggagggacctcaaggtgaaggccttcaagacctaccacgccattcccagccaggtgaagggttcatcagttcttggttgttctggatgaattattcttgattgattgatttggtcggaaatgtgtggtgaatttggttgagatgtgatgtgattgtaggggtatgtgatatacacggtgaagcaaaagctcaagccagagtatcttggcctccctgggagcgagatcaagcagctgaagctgtcacgtgtggaggtctgttgttgtttttttttttttttgatattgaggatgtctggatgaaatggaatacaattcacaatttagttatgttgttgatgctgtgcgtggttctgtttttcagattacgaatacattgacggtgcctgagattgcttttaccggagatacgatggcagatttcattcttgatcctgataatgcggatgttttgaagacgaaaattcttgtagtggaggtattgcttcttatcgtctatatggttaatttgttgtcaattgtcattgttgctattcagcctgagaaaaaaaaaagagggaaactgtttcttcaagcacggatatcagtatattaccaagattaattttatcaacagaaggaaaagccacagcctttgcttttcaggagagattgattccaactccatattaactgataactgagtaccattttttcaaactgaaacctttgcggaaccaattggcagcaattagtgggaactatgttgcctgaagcatgtttcagtttccatactgaatatttattgtccttctcctgacgaaattttaattatctccaaatttaacttagtgaactgtgttctggaaattgcagagtacttttgttgatgactctgttacaattgagcatgcaagagaatatgggcacacccatctgtttgaggttattcccaaattttgcttatttcatatttctgtggaagaaaaacatttcacctagcattgctaattttgcccttatcttttttttttatgtatgcagatactgaatcagtgtgacaaacttgaaaacaaagctattctgctaatccacttttctgctcgttataccgcagaggtgagctatctctgttgtaatccaattttacttatatcattttatcctgattcaattagtaatctgtatgctttgtttcaactctgtggatttattttttgtttcaagcaagtttcaccaatattgttattttttaatgccatcattatgagcaggcaaaatgtgcccacttttcttgtagcatcctcctttcctcttaaaagtacacatgtttgtgtttcattctttacaaataaatacatttatcttcaatttttttctcaccatcattaaacatttcatcacatccttttcaggaaattgatatagcaatcaataagttgccaccctctttcagaagtagagttcatgcattgaaggaaggtttctgacaaagatgaagtgatcaatcagaaatgaagcattcaaccttactctcctctcgatgcactcatgtaccaagaactctttttttttttggggggggggggggg

SEQ ID NO: 14337 - DNA, 14336 bp, Oryza sativa
  unsure (1)..(14336): unsure at all n locations
gtagcaccccttcacacaccgaacattaacaatattttacatttttttggtcattggtgatcgcaaagagcaatcgttacatccatgctgtattacattatacatagagatagtacatgttgtggataatccctggcccctcttgaaaatacgaacataccaaaattcactcaatttcaagacaaaatggacaggaaatttaacctggctacccttccatttgtcacccttctatgtcgtccaaatgtttaattttctttccccattatattttttttcttgatgatgatgatctccgtggtcgctcatgctgcatgcctacgtgacgtcatctcgccggcggatcagcacggctcgccgggccggcaggagagcgcgccggcgaagcgtgtgagcctcctgacgtaggagcctggcttgggcttaaccatgtcggagcccttcaccttcctgttgatggcgccgttggacgcctggaagtaggcgccgttcatgaacaggtctccgtccgagcgccacgcccagttcttccactcccactccggcgcatagtgcctcgtgatctgctccatcacagcatcgactgtttagacgatgacacggtctctaaaatatggtcgatggtttctttttttaatatcaacatggtctttagaatacgacggtattgattttcgtgtatcgacacgatctacgaaacatgagactagtaggtgttacttcctccgtttcagcttatttgttattctagcaaatttcccataaacaagtggaaaattacatcgttacctcattaattacttcctaattgtttcccaaagcttatttataaaccgttgtgcacggttgtattgataaaggttagagatggaaagtactctctaaaatattttgcattccggaaaacggttattactattttgataaggaatttcaatgctagctagaatgataagtaatctaaaacgaaaggagctaatagtaccagttggcggcgatgttgggaggggcgatgtatcggttgccctggctgaggatggtagggctcatgccgccgccgatggcgtacatgagccagtgcgtgtagtcgttgttgacgacgtggaagaacccccaccggcatcgcggcatccgctgcacgagcccacggccgaagtggttgaacgccacggtgatctgcatcaccttatcctgcgggtagggggtgataatggatcaagatccatggtttttttcttttcacaactttacctaagctctcatatatttttaggtcaaatacaaattaaattttagcacaccctattttgaactcagccctcaaatttcgcaaattttaaaagttggaccatttattagcaaccttaattacctgcgggtacgagtcgctggcgcaaaacagcatgacgtcgttgtggttggtaaagtgcttgttgagatgtcacccccgtcgagccctgcangacgtcgatgagcccgtcctcgcacatgaacatgaagacgtggtccacccacacgtcggtggcggcgaagagcgagatgccgtcgccgtcggcccgcgtgcgggggccgatgtgcgtcggcgagtcacggaccgcgccgccgtcgctgtgcttcacgtcgtggacgtggaggctggtgatgatcacgttgcgggcgaactggacggtgatcccggcgccgccgcgcgcgatgtgcacctgcgcgccgcggccgtcgatggtcttgtcgctggcgacgaggagctcctgcgtgaggcggatcaccatggacttggcgaaggtgatccacagcggcgccgcctgcatggcgccccaccggagcgtgccgtagcgcgggttggcggcgtcgccgtcgccggggtcggtgacgacgtagatcttgccgcggacgccgccggtggcgccgcggccgaagcccatggcgcaccgggcgagccgcttccggtcggtggcccagtccttgcggcagcgccagcaccggtcgatcgggttcgtcgccaggcacggccccttgtacttgctgttcttcccactcaactctcgccggagaacgccgcgctccgtcgatctacatcgtcaaacacatgggggtaatggattctaatatctcgaggaaattaaatatcccctcgtgcatgcacatttttcaatcaaattcaatgcgaatggctgaagaaaattctaaaaaataagttgacaatgtagagtacggtgccaaaaggatatttactggagggattaaaatagttttattgaacgcatgcgcttttgtcatgcaacgataatggcaatctaggattccatcccccgatttcaaacgtaagtttgaaagaaagctagttcaaaattcgaacaaaaacttaaacataatacgaattccgacaaaatttgaacgaaaattgtgtgaatggcatgcctgatgacagcgtggttgaactcgttggtgacattgaaggggtccggtttgtacacctcctccgccgccgcctccgccgccgccctgcgcttctcccaatgctcgtcgaactcgcctatgccggcgttcgacacagcggccgccgccgccaggaacacgccggcgacgaggaggaaggagccgggcttcctccactggagcctctggtcatccatggatatatatcttcctatatattattctctttgtctataactatatactatttgtcatgaaactttgtttctctttttttcttttcttgattgtttaaataaaaaaaaaacttaatagggttggattttttttggggaaaatgaaagaaccctattgctaacgtgcgtggattgaggaaggagagggttatatatggaggatgagatggtataattagagaagaggtgtgaggcgaggaaataggcaagaaaaagctctgggttttttttttgtgtgtgtttgtgtgatttaattattggtggtgaagaagcttgtaagaacttgtgtgccatcaagtgacattactttgtttttttattgtgtaatatttggcgctctattctttgtagggagagacagggcaaagggttagttcaaattaataattcctgttgatcattttttttagattaattgatttttattaattcagcctctgtatccacgaaggatatacacagccattttttttaggaatacacatattattgtattataaacacctctcaaacaaagattgaaaaggagataaacacctctcaaaggtctaattggattcaattcgtcctccagtatatcccgggattggacactgtcatcgacgtcgtcctatttctctgaagctgaaagataaagaccacccagatgaatcacaaattcgtcgaaaccgatgaaccaaattaaatgggaaaattcttcatctaagttcatacagaaaaaggacctgggtcttttcatcacgagctttgaaaagattgtagacctccgagtgatcataacacttggccatcagctggtacagctagctttgggattctaggcgaaaacggaattaaatcacaaactgataaacaaaatgcaaaaatttgaatttcttttatgttgatttggataatcggaggagatcgttgaataggcgaactgaccgtgctgcatcacaaccggtcgtgtacacaatcatttttgcagaatgtgggtgacgtacggtgtgtgacaatcagaaaaatctgacttttttttaaagatgcggacatccctctaaatattttttcaagaaattgtgagcgtgttggggattaaacatagaacctcggagttgaaactacacaccacttaccgctacactatcaaatgcatctcctactcttatcgtatcaatgtgcttggtagagccaaaacattggataggcatgtacatgaaatgtgctttcaaatcataaatttgacacgagtgttcgtatttatagctaattattctttcaatggtaggcgatgtacccgtcgacagcgatacgcccgtggtgacttcgttaatctcaagatatactgacccagtctttcggatgtcctcatatgagtagggtgtgcattcataaacggatgagtgtgcgtgtgttatgagcgtctacatttgtactgtgtttatagaaaaaactttggataggcataaacatgaaaggagcccccatgtgatatttacgtctcgcgtgggagcaacacaccctagcaaggattgcgtggtgccaccaggacatccgtttctatctctttttgcatctcttttctcaactcaacgtacacgcgtaagagttggttttaactttttttcgtccaaattgctgaaattgccaaataggacattacatgtccaatgagtccctccaaactccgttggcaaattgcaacttttgcaaatcaacctgtacatcgtacaccacctgtatatatagacagaagcgcacataggacagatagctagaaagaaagaaataaagcatatacttttaagcaaaaacaaatgtaaagagcatgtcaccttgtcgattctctatggtgatagggtccagggcaatgccatgtcatgctatcttatccctgtgctttgcacacagctttttcaccaaatccctgcaagaatcctcctataaatacccacccaattgatccatcaatttcccatcacaaaacacataaaactatatcatcatcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccaggtgctatatatatgcgcactttaatttgcatgagcctcactacatacggtgctctctactggtagtagaaatcaatctaaaccgttaatcttatttgaccgaatggttcagagatctatttatattatggtagtaaaatcgtggatgggtgttatcgtcagaaaaaaaaataggggtgaagggtatagtcgtcatttagcagtggctaaactcttttttctccttttttggctttttcgatgaaatatgagcgatgccagcgcaatagatgatcatagatcaatttagctgagaaaaaacataaatgacaaaataatttctaatcattgtattagtaaattactaatttaccttaataatactgatactagtagtataatactaccagtagagagcaccagagcgtcgatttgcatacgaggcagggcggaggcaggcctaggacaggtagggcttaagccctaggcttgttgcctccaaaatcatggttaaactctcttaaatcatcatttaaatttgggaaaagaaatgaataactaattaataacaccctacctttgtcctactcttagagtccgtcactgcatacgccgaagttctattgatagagcagaaaaaaattacaaaattataaccctgaaatgtcgaaaccaggaaaaaggaaaaaatatatattgattgtgaccctgatagatgcgatactaatgcaacatatattgactgtgtttgtagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacgaaagagatggtgctgtgtaggatctccaacaaggacctgcctaaaccacccttcatccacaacagcttgttgcagttctcttcagtggggttgaatggtgatgggtataattacttgatccttgatcaccttgagcctccagcaatggagtatcctaatgttggcattggtaatgttgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgcttgttagctagcctatataccaaacatgccttggcgaggctttctatttgtatatagctttttttcttttttctattgtaaggttcgaactctattgagttgattgaataaacattatgcaatttatgtaacatattgtctataaagttctattggcatgcatattcatatatagttacagtcctttagttttaaattgaaatttcattttaaaagttcattatttgtcattgacaataatgacaaaatgctctagtatgttgtttccatttacaaatggaaagtccgtttggtttggctgttactgtaacaccccaggtaaccacgtacatagaatgccacaccaaaatacactcaaaaactaagtcctaaaattattagaaatttcggcagagtctcccttaaaaatacggacatcacgacaggcagttataagaaaggtcaataccgatataaaccacacaatccaaaccatcctagctccataaatcccacgtgaaaaataagaatcagaaccttaaatgacctttacaagttctatgcaaaacttatgctgagcaaaaattatagtctaaaactaatttcaattgtgtgcaataataatgtgtagtccaagggtgctactcccaccccatgccgatcgatgtcattaggtacctaaaaaccaaattaaacataagagtgagtaaagaatactcagcaagtacaatcttgaactagtaaaacatacgcatgatttatgcattaagaaaccaacatgaagggttggatttactttatttttaaaccaaagaagtcaaaagatagtagttccctcccgggcaggtgtgaatatcctcttagcattaccggtaagccgagcaagcgtgatcagcgcttcacaaggatcatgaataaagatccaaattgcactcccatagctacgcatggttcttgaataatgtaaacagaacattcggaataatgaaacatgaataacgtcatgaatttgaatatgggtcgaaacacgaataaatagcataacgtcatagccatacaatcagtaataacaagcaattgaataataattatgcaagtaaagccaaacaaaacaactcagttttgtccatcacataagtccgtcttgtacttactttaactcattcgatactccgactcaactcctccaacgttggaaccctccacacctgtggagcaaaactacgcataaaccactatattcaactaacgatggttacaagggatatttactaaaatcgaaacctagaacatataaaccttttaccgatttatattaaataacctatagctgttccattactgttttatgagtaactcacaaaccgtctaacggaaactagcaaataatacaacttcggacatctagacaaaattgtctacaactttcatgttgagcacaaaatcagattatgcctctgaaaatcccagattaaggaaaaacgaactgctgtcctgatttccggacccggtcagcagtactgtttttgctgtttctcctaaaccgtttatcggaatcgagtgaaactagcaccgttggaaagatattgacaatgactacaaactttatttaggacaactaacctgattcctgatggtttaataccagatttgaaaatacggtttcagcctagcgttcgatataaaataaattcgaaaaaaccggaaacagatcgtcttgaatataaattagaaacaactatagactaaaacggattacctagcagtactaatgtataagaaaaacgaagaatttggaaatattcaccaaattccccaaatttcccttcttctatcaaatttccccttctttccctccttcctgttcttttctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcacaaacgaccggctgcggacgacgacggctgtggcgaccggcgacggctgcaccagcggcggcaccggcgaagagaggaacagcagcggcggcggcagagtgcaggaggtgcggcggctagggctacaggagaatcgctcctgtttcttttttttcgtttgttttttttggttggttatataaagagactaaataagatctaacggctcacatctattcaatcctcgggacttcgttcggactccgattactataaatttatagtctattttgcactactcggcgagctctacgcatccacggttcccgatcgcctatacgaacaatggtttaaaagttgaacttttgcgcgtttgctctaatattccgcgagatatattaatttaaaactcggggtattacattcttccccccttcgatcgaattcgccctcgaattcgcccaatcatactctagaacacgggatattacattcctccctccttcaatcgaattcgccctcgaattcgtccagttatacctcggacaagtatagaaaggaactcataggtaggacttatataactcaccagacgtgaataactctggatacttctcccgcatctgtgactcaagttcccatgtggcctctcgctcggtctggtgcgtccagagaaccttgacatacttgatagttctatgcctgagcaccctctcagattcctccaatattcttacaggatgagactcaaatgtcaaatcttgctcaatggtcatcggctctacggtaatatgatgttcagggtctctcaaatattttctcaacatggaaatatggaatacataatgtacacctttcatggactctggtaactcaaggcgatacgctaggattccaactctttccactatcgagaatggaccaatatacctagggctgagtttgcctttcgttccaaatctcacaacacctttggttggagatacctttagaagtacttgatcgcccacttcaaactctaattctcgtcttctgacatcggcgtagctcttctgcctactttgagctgcaagcatgtgttgtcgtatttctgctatccgttctgtggtctgttgtacccaaccgggtcctaaaatagctctctcccctatggaatcccaacacaatggggatcgacactttcttccataaagtgcctcatatggtgccatttgaatgctagcatggaaactattgttgtaagaaaattctacaagcggcaaatgatcctcccaactgcctttccatgaaaggatacatgatctcaacatatcctctaaagtttgaatagtccgctcagattgaccatcagtctgagggtgaaaagccgtactgaatttcaattgagtatcaaatgcctcttgcacagattcccagaacttagaagaaaacttagcatccctatcagaaacaatcgagcgaggcacaccatgtaacctcactacctcgcgtgtatagatcggtgccaagtcactcgcagaataagtggtgcggatagaaatgaaatgtgccaccttactcagacgatctacaaccacccagatggcgtcctttcctcgtggagttcgaggtagcccaaccacgaaatccatagcaatatcatcccaaggccatacaggaacttccaatgattgcaactttccagcaggactcttatgttcagcctttactcgctgacataccccacatgacgccacgtacttggccacatccactttcatcctcttccaccaatagatcttcttcagatcatgatacatcttgttctccccaggatgcacagtatatggtgttcggtgtgcttctcgcaaaatctcttccttgactttagctttttgtggaacacataaacgcccatggaatcgcacagctcccgaggaatccaaagtgaaatctccagtttttccttcctttacacgtttcttaacttgttgcagcaaccgatcgtgttgttgggcctctagcactcgttggggtatggcggactcaagaatgactcgtgactcggtacttgccactccaacataacaataggagatatccatccgttcaaaatcagttatcaaacaactcatagttggaggaacgaccttacggcttagagcatctgcaaccacattcgccttacccggtgtgtattgaacgttaagatcatagtctttaatcaactctagccacctcctctgccttaagttcaaatccttctgagtgaagatatatttcagactcttatgatcagtgaaaatatcacaagattctccatacaggtagtgcctccaaattttgagagcaaagaccactgctgcaagctcaagatcatgagtggggtaattctgctcatgcttctttaactgcctagatgcataagctataacattgccctcttgcataagaacacaaccaaggcctactcgtgaagcatcggaatagacagtgaaacgtttaccaggttggggcaaagtaagcaccggagcagttactagcctctgcttcaattgttggaaactacactcgcattggtccgtccactgaaacttcacatccttatgtgtgagcatcgtcataggtttagtgataatcgagaaatccttcacaaagcgtcggtagtaccccgccatacccaaaaaactcctcacatccttaacattagtcggcctttcccatccgacaacacttaaaactttgcttggatcaaccgagatatcttgctgattaattacatgccctaggaaagccacttcaggaagccagaactcacacttcttcagtttagcatagaacttgttttctcgtagggtctctagtaccatcctcagatgacgctcatgctcctctacatctttggagtaaatcagaatatcatcaataaacaccaccacgaaattatctagaaaactatgcaacatgctattcatcgcctccataaaataggccggagcattggtcagcccaaaggacattactctatactcataatgcccatacctcgtggaaaatgcagtcttctcaatatcctcttctcgcactcgaatttggttataaccagattgcaagtcaattttagagaacaccttcgctccctttaactgatcaaacaaatcttcactacgaggcaatgggtacttgttcttgattgtcgcagcatttaaggcccgatagtccacacacatacgccaacttccatccttcttctcagtaaaaataacaggtgcgccccatggcgacacactccgtcggattaacttcttagataatagatcatctaattgtttcttcaactcttcttggaaaggacgagctaaccggtacggggctctggagataggttgtgttccaggaacaagatcaatacggaactctacatcacgctcaggtggcatccctggcaattctgcgggaaaaacatcaggataatctcgcactacaggaacatcttcaatcactaaaggcttggatgacttctcggctaaggcccataataaccccgtctttacagcacgctgcccaggaaataaccttgacatcacgaaaagagaatgcggaggcgcgctcccttggaaaaccatctcctcgcctgatggagcttccaaggtaatagtcttccagaaacaagagattacagcatgatatcggttcaaccaatccatgcccaagatcacatcaaagagcggtaagggaatcacaattagatttgccacaaattcctccccatcaatagagattgcacaacctggacatactactgaactagagattataccccctggagagctgacttggacagatcgagagacctcttgactaaatagattagctcttttcgcaaactcgattgaaacaaagcaaaatgtagcaccagaatcaaacagaactagggcatcatgcgaatcaactgaaagtgtacctgtaacgacatccgggcgaccaagggatgaagctacaggcatgttgtagactccagccatagctggggtagtagaggctgagacctgctggtgaggtggagctgaagcagaaggatgcgccataggcggtgcaggcaactggagtggagcacgtggagcaaaagattgaggcatgggccaatactgtcctggtaatggtggtggtgggtaattatgtgtgaactgctggtaaggaagtggataagttgtcatcatctgaacggcaccacggggagtactagtggatgaacctgaacctcgaggatagctagctgtcgaagaggttgctgaataggagctcggcttttgccacttgatgatagaatttgggttacgcttacataccaactccatgtgtccagctttgccacacccacgacatgccccagtaaacccacactctgctgaatggtgattctttccacacttaaagcaaattagtccttgccctggcacagggcgaatcaactgagactccgttggacgtgaagctgcattaggctgagaaccccactgcctaggtttagatgatggttgagtgacctgattttgtttgtacttcttgaaatgtggtcgctgcgagttctcacccccttcctaatgagctctcttctgctcattaccagtgacattaccagaacgattcttctgcgcagtagtaatttggagctcaacctccatccctcgagcctcctcaactgcattgaggtatatggtaggcaggtttcttcccatcacttctctataccgagcattgagccctcgaaagaacttcctagccttctcacgctcatcacttgccacgctaggcacaaagcgtacaatactgctgaactcccgttcatactcatcaacggtcttgcttccctgttggatattgtttaactcatcactcatcttgtccctaaatgattatggataatacttagctctgaactgctgaagaaaaacttcccaagtaatagcaccacgatcagggttccacgcttcaacaactccatcccaccaaatgtccgcctgaccagtcaactaaaaaggcatgaaagtaaccttctcctcaggagtcattctagatcccctcatatacttctccatcttgcgtaaccagtctgcagcattaacgggagtaccagacccatcaaatgtgtctaagcgcatggatgtccatctagtgagtgtcatcccctgagcagctcgaggagcatcatcagagacagcagctgagtggctaccaccctcctcctcttccatgtgctcatcctccatctggttcgaggatgctgcctcattatggcgacctctaccacgacctcttccacggcctccagcacggcccctaccacgacctccacgattaggaataggggattcagcaaccgagttgttcccaacctcttcattatcctgagtattttcaacttcttcattatggtggcccctaccacgacctctacctccgcctctcccgcggcctctgttagccaaccgaacactcactctaggtggcatagctatatcaaacacaagcatttatacgtcattagtttaacaataggttagacaatggcatgcaaggaaacacaatcatacacatatatatgcagcagaaacataaatgctaggaatgacccatgctcccattcctattgtgcaccagtgtgtcaagttcttttagatgtttatatataacccaagttctactcttattatttcctaccctaagagaaagtattttttttaattggttaggaactctagttcaaaattttatgttgatttatatatctcattacccagtcacttcccatggacctaccgcccgctctgataccaactgtaacaccccaggtaaccacgtacatagaatgccacaccaaaatacactcaaaaactaagtcctaaaattattagaaatttcggcagagtcacccctaaaaatacggacatcacgacaggcagttataagaaaggtcaataccgatataaaccacacaatccaaaccatcctagctccacaaatcccatgt

SEQ ID NO: 14338 - DNA, 2425 bp, Oryza sativa
ttttttttggttgggtatataaagagactaaataagatctaacggctcacatctattcaatcctcgggacttcgttcggactccgattactataaatttatagtctatttttcactactcggcgagctctacgcatccacggttcccgatcgcctatacgaacaatggtttaaaagttgaacttttgcgcgtttgctctaatattccgcgagatatattaatttaaaactcggggtattacagtaaccgtcgaaactttcatccaaattgccataaatgcccttagtaaatgttgatagcgaaatctaaacaatagttctgagcaaaattggggctgacagggcccaattatcaacaccagtttattttgcctccataagcggtattaacgctggtttcatccgacgtgatgcttatgtgatattacaattagaaaaatagatcatgagtcgcacatattgacgacgcactcctttatctccctatttcattcctccccattctccctcttctctccaaatgggcacgccatggagctcctcgtgtggatggacacacaaaaaaaaacttgtataattagctggttttgatgccatctaacctatatcccaagcatgcctcgtaaggctttctatttgtaaatggctttttttcaccttttaaagttccaaagctattgagttgattgaatgaacattatgcgaagcatatcatttgcaatgttctattggcatacctattcataattagaaatcctttagtttttttttcatttttaaaggtaccttattttccattgacaaaatgctagtctgttttctattcacaaacgggaagtccgtttggtttggctctgtggcattgattaagtgcaaatgtgtgcaactggaaatggaacagtggagtacaagctttcatccaaaaataccttaaatgccctcaattattaataaattgatagcccaataatttaaatagtgcctaatgaagttgtggaggaaggcgaaccaggcaagctgattatgatgttataaacatataggggtgctaactttttagcttacaaaatttgagggttcagtatagtgggctgaatttttattcattttaaaccaaaaatataggtaaggttgtaaaaagaacccatatttttgaaccaatacatgtgcaaccccttagaattggatagggagcatttcgtacaatttagtttgggtgagttttgatcggtattagagttagaataaattaactactcaatatctcacaaggtaaattggccctctttataagaaaatattgtctctatgtatgctgatgaaacataacactgaactgatgagaaacagtacatgtagtagggaggtaattttacctgtattgattatttctgaatatcggctaactgtaataagattgtgctgccttttacttctgccaaaaaaaatagctttgttgcctatagaagcgtgaataaggcattatatatcttaaaataaatatgtcaacacagcttaatgtatcacaccacatggctgactagcatttctgatccaagattatcattatcggggtttcctctctcccctgggtcgggaggcgacgacccagccgccccctctcttccacccctttcactatactggagaaccccacatctctcccggttcgcaacccctttactcccgggtagcgaaccaggagaaggaatccgggactaaagatcgcagtctttagtcccggttcagatacccgggagtaaatatttatctttaaagatagctgagccacgtccggttgatccccttttctttttttttaattgttaatttactactggcagttaatccctgtattttctcgcatcgggtgagaagcatatccccaaatcaaaccccaaatcaagtaacatcccaaatcactcacctcacaaatctaagttacacacaaatcaaatacatcacaaatccttaaataaattacacacaaaataaaaacatcacagatccatgcaatgaatcacaaattctagaaattatacatccagggaatcacaaatcacaaatcacacaaaaaatggaggacgccggccgccgcctgcgtgcgcggccccaccaagcgccctccgccgctggccgcccgccgcgcgcccgtcaccgctggccgcaggccgcctacccgctgtcgccgccgccagccgcctacccgcgccgaccgtcgcttggcccggcgctcgctcgcatcggccgtagctcggcccgccgttcgccgctcgcttgcgccggcctccgcctggcccggcgctcgcccgcgccggccgcggctcagcgcgccgctcggccgtgcagagggatgagggggagtaaaggggaggaggaagggaagaaggggaagtagaaaaggggaggggaggaggaagagatcg

SEQ ID NO: 14339 - DNA, 12322 bp, Oryza sativa
aatctttagtcccgattcttattagaaccgggactattgtggaaatcgctcgaccctcgaaagatcatttctccagtagtgtttcctccgcctcgccgtcgcccgagtggccgccggcaaagccgcgaggctgcaaggacggcggcagggggcttctcgctccccaaagttcaggcggtcaggggacctgccctggcggcggcggcggtgaccgccagatccatgccgctcgaccggatctggtgggatggcgatggcggcggcgacggggacggcgacggcggcggggttggtgacgacgaagatcggggtgagcggcgctgggcggggatgtgggcgatggcatcagggatggcgacggtgttagagcggcggcggtggagtccacgaatccggcggccagcgacctgccccacatctcgcgcttggccagcaatggtggtgaggaggacggccggttctggctaggtctagatccggtacgtcctcggtcgggtcgggggtggcatggaatccggtcgttgtgcaggtggtgtgcatagtgcatataccttcggtgtgtaggtgcaggtgatatttggtggcttccactgtaggtgctatggttgagggggactccgaggcgaaagccttgctccgcttctggtgctagcaacggcgatgccctcgggtgccgttcaccttcttgaaggcgttgctattggagccctcgttcaacgccactaaaggatatcctctgggtgaaaaccttagattcgttaggatcggacgatgtcgccattctttcggcgtaaccttcttaaaggcttcgttttaggagttttctcccttgttggactgctgttcttaggatcagtacgtcaatgtcagggttttcgccggttttcctttaattaaccatgttgttgtaaggtttttagccccggttttccttataaactggatcaactctcttcttctatagtaaattgcaggaactccctgcatgtcccctgaaaaaaaaaaacatggctgactagctagctgtgtatgtgtacctttacatgtgtaatctgtgctaaccccactatcgcaagcctgtttgagaatactaatttcgatctgcagaacagcagcatcaaagagatgatgagaccggtgaattcgatgagataagctgggtttcgcgtcaggttgcaggcattcctactgatgtccctcttgctaatgcagatgccatttgattctgccttgtacgcttgccatcggcagctttggagacagggagacgcatcatggaggccatcatcatctcttagctccaagcaaatcaacactgtctcgtcgaatcctatcaattgtttgcattacaagtgtcattaccagagctagagatcgagaggcaacctctgacgagcatacatatcgatcactgtcgttttcttttgcttgcacgatttcattaatttgatttggagtttcgtacgttttcaggcggcccgggcgggtacacaacgaccctccttgttgctaggaatttgagagcagagagccaaggaacaaaggatgcaattgttattgcatggagcaatattggatgtaaaggattagcgcagaattggatgcctatgtgatcgagatcatgtggaaattagtatcagttgggtccatgtattttggttttatttgaagtttgtcaagtgtggatcctttggacgattgtgcgtgttttacttgtattgactaacataagttaggtcatgaaaatctaagcatgtaaggtggttatttagggcttgtttatttttttcttttttgtcgctttcaaacctaccaaattttggtagatcaacggtgtcaaaaaaaaaatggtagatcaacaaaccaagcatatattatcaatgctgtcctacttaattttggtaattctagaagtttctactcttaacaattatgatgaaatcccttctttcaataaagttaaggccaaaagctcaaacctcgtgcttccacgtcatcatcaaattgtgaaccgttggatgaatgcattagatcgcttttcaaacgttggatagaatgcagcatagagcccaatccattagtcaccgggtgagtctcttcgcctccttagtgccaaatgtagcccatataaacacaatggcccatctccacacacatctatatgtatccagcccatcaatccgtataaaagagctttatggctgaacaccccttcagttgacatgtgctacctaaattatctacaaaattttggatagggctactaaaaagaatttctccaagaaagctatttgtttttctgtttctccttgagattatacctcctatctaataaattaatgttaaccaaatcccgcagcaacacgcggggcatcctctagtttggtaaggcttaaaaccaaacatatctaacactatcaaaatttaatactaacacaaaatatgtcaaaattttggtagtgttaaaagtggttatgaagtgaacgctctgtttctgttgatgtacatgatggttggaactatgacgaagattgagactatgcccattgaaaatgcaaagatagaagcttcaaactagaagataaaaacaggggctttccaatcttcaaatcattttgattggttgaatttgtgccaaggagtagaggaggagcgaagttatagtgaatgtagtaacaatttatgatttaagctctttgtcaacaataacgactctgccagagtttgttcagtcaattcaattgaatttacaccgaacaaatataactgtactagcatgactttcaaacaagaagacattattttaaaaaaacgaaccatcagaactaatttatttttaagataatggataaaaattcgccaacgaaaaaccaaattagctccaaaaattatctacaagagttacccacggtcgccggctcgccgccgagcagtgcagtccgcccgacgccatgatttccatcctgtccacgtcgagaagctccaccgtgtttgcgcgttgcctcgcctcgccggcggcagcggcggcggcggcggcggtgatggccgctggataaagcgggcccaaaaaggatcgcggtgtacggtgcggcttgggccggaacgggattgcagcctacgtgagtcctataagtgttgggccggaacggcgttgcgtttattaataagtctatttagcccctctcaactcttgccccgattcagtcagtgggtatgagttgagggacaaataatagacttatttcttatccatgcggcccatacatttgggccgggacgggattattgccgcctccgtgaggcccgtgggccctggtgatttgacaggtgggctgggctacaacgagcctgcgctgcaggccgcctcggcgtcttcttctccggctctctccgccgccgtctcgtctccggcgcgcatacggcggcgagtcgccctggctggcggcgatggtgggggcatcggtgatcgtctccgccgcccgcacgcctcatgctccgccaccacgaggcatatatcgagcgcgcattgcgatttttcctttacccttctgggtttttgttctagctaggcaaggcagccggctaatcacgccgccgagatcgccggagcccggaggccgccgcccgcgtaggcccgtctccacccagcgtctcaactggtcgactcggtggtgatgctccaccccccgcctctgctttctcctcccccgctttcatcgaaggggtaaacgcggaaactttttttttttccttttgtgaatacactgatactctcttgtttgcttgggatgatgtcgatgcatttgagtttgcaacttctcaaccaaatggggaaacataaaacattatactttgtggtaatggatcttggtaaatgtccattcctttaggttagtttagtgcagttgcagtactgaaccattggaattgggatttttcaggagaggagctgtttgctgtgagtctctgaacttgcgtgctatcgaatgcttccatcaaaacagtttgtaggttacaagcgaaaaaacaaaaacaaaaaaaactgtatgtgcagttagtcgatttacatattcttcctgcaaatgctaaatggttcatggttcttatattttgttcagtaacagcaccctgcatttggctgtgtacaccccacaaaggtgtagaggccgggtttgataatcctttatctaaaaaaaaacagcaccctgcatgtgtgaacatcatgaagctactcatacaacctgaacctatgctgataaggcttcggttgctcggctgtaaatatctattatagcctggggattattatgccaaattattcagagatttgatgcttcaacgcagggacacgctaaacttgtcttttgttctctgcaactctttcaaagcatctccgatatgcatgcgatctgctggagattcctttgagcaggaaactccaatctgcagaattgatatgatgcaggctattctcgtgtctctttcttttgccatctgagtttctttcttctccatcattgttctctgatagtaagtgttggtctgcaatatcgatcacattgtctggaagtgccatctttacataattatgaaggctgagagcttctttaaattcagtgccagttggtctttttccggtaaacatctccagcaacagtataccatagctgtagatatcacccagaattgaaacctcattgcccaaaccgtactctgtaatcataagaaaatgttacataaaggaaattgttgcaagtttaagcatttatatttaaatttatatgtaggcttcagtctaataatatataatttacactgctgcataattatcatttgcaagaatttgagttttttcataacaaattgcacacatctgaatagcaaaacgatctacttaagtatggatcaatggaaaggtttctgaataaattagaaagaaaaccgtggattgtagctgttagaagcatacctggagcagcatatccattcctctcattgtagcccagccacttgatttctctaacatgtcactatggtcttgatgcaggactcttgcaagcccaaaatcaccaacgtgagcaaccatttcactatctaggaaaatattgcttggcttgagatcacagtgaataattggcaatggcctatgttggtgaagataatcaagtgcagaaaccacatcaatggcaaatgtcgagccttttgatgatatttaaaaccttgtcttccccatttgttttgacagcgcaaacgaaggaagccttagccacttctactagtggttgggaaccttcccctttagcacacaaagcgaaacaacggtttagggcataataattaagtattagctaaaaaatcttgaaaaatatattaatactaaaagcaattttcttataattttttttcaaaaacactgtttagtagtttgggaaacgtgtgtacgaaaaacgaggaaatagaggttcggtaagtgtagggaagaacacaaccttaataattatatcctaaattatgcatatagacccctatttggatagcaaaattttcaaattagccttcctcatctcattcccttgctcggtcggtgatctgaaccaaaactctgggtcgcaaccaaccatcaaaataaaggacgattttgcaaaatgtattaaaatgagagcgtgtgtgtgagagagagataatcaccgccgttggatcaagcaggaatggttcagatgccactgccccaatccttcctggccagtcgccgccttacgcggccttgccggaagtccagccaggagcaccgccacattgtcggagccaccacctccccctccttcccgtcgttcgtagcacccctgcatcttctcccggatccatcatcctatcttcatctccttcccgaacctctccttgacaatggaagcaggtgtcgagtacatatccttatatatttacattgttcaacattatctaaaaaaaaactatttacattgttcaaatcctttatattatgagacaaacaaagtactcagttaagcggagatggctgcttgttcaaatcctcaacgggaggtggctgcttgcaccttaagcggtaatccttgagcatttgttgccttcttctcagttactacttgtttgcttttgatttgtgtcgattaataaatggagaattaatcaggtaatgataattaaaataaccttcttatattttttttgcaaaaaaaataattgtttaataattcaagaaacgtgtgtgtgaaaaatgagggaaatgagggagtaaaaattaggaagataaagagccgaacacatcctaaacattgataacaactacgctaattatggttccactgataagccggaaaaaaatactatactagtaaatctgttatgaacacaacacaatgtagagaacacacaaggcacggggttttcgcctgaaattccatatctccatctaacagtctaacagactgtacattttaacttgcttcacgttacatgttttgttttgtactacattggtcagtcagactaatgcctccacgtccagtattgcctgaacattatggacttcttcaacaaaagaaacaatggtaaactcctacagaagaaacaatcaaacagtgtttgctcttgatttgtgtcgatttttaagtttgaaatgtcaagatgcagtatacagatcaactccagtttctgccaacttaagagcatgcaggaaaccttgacagagagctcgtgtcctgaaggtagctaaatcatggtcttctggtgcatagctgctggtgggttcggtcatttgggtgagcttcccggttcattcctggcgttgcctggcgcgttgacggccaccgcatttgcatccgcagtctatcgtcgacaagcaatgtgaagatgaaaaatacttgttagagcagattaaccatggtgttagataattcgatatccatataggcattaggcaacgcagagcttttgctatggatttgcagatggatagagaagacgacgacttcccccgcaaaaaaaaaaaagagaagacgacgacttacaggagcttgcttggaggaaccaagatcctctgccatcggttctggtcctttatgttcggttgttaatctcttaccatgctgcagaatgtgtaaatcagaaagtgttagttcaacaaaagatcacacaaagataccacaaagtccaagctgcaagaatttcaaagggctccgaaggatgaacacgacgaccgaggttcgagaatttatcctgctctggcacttgatacaacaggtacaactggatgaaaacagggaggacaacctaatgtggaaatggaatgcgaatggaatctactcagccaactcggcctacaaaattcaattcactggaagcattcaggacaatcgtgttaacttcatttggcgagcaaaaacagaaaacaaatgcaagttctttggatggctcatggtccaaaagaaagttctcacgtctgacaaactccaaatccgaggttgggacaacagtccaacttgctccctctgtgggacagaaccagaaacagcgacacatctcttcatggattgccccttcgcgaaacaggtatggacaaacatttggttgaaactaggactcaacatgcctaggtcttcttccttcaatggaaacatgatggattggtgggaagcttgccggagagaaatgatcaaagagcagagaaagaattttgatggcctacacgacatgggggatttggctacaaagaaatgctagaatttttaacaatgactatggtacagtgttacatgtggttgactccatcatcaacatgtgcaaagccttcgatgaagcgcaaatcgtttagatgaaaaaacgcctacttttgttgttagtggctttgcactttctcaaagtgctgtaacctcctccaatgtaaaaatctgaagacacctcttggaggtgtccatgtacgtgaaactgcttctttctcctttaatgaataggcagagctcctgccattatcccctcaaaaaaaaaaagaatttcaaagggctcgtttcgcataaatgcaaggtatagattctaaataatttgtatgagactatgcacaaccaaaaaaaaatcctgtgagataaggaaaaggtacaaccaatgctgccttaaatttcattcagatgaaaaggtcaatacatctatggtaagcaaaataatttcatcagcaccacagtctttctccacaactcaacagcacaagagaatttcgctatgtttctagcaccgatatggataaagattataattcacatatagcagcaagccagcaagaacagaactctacaatgaaaacctcattgttactccatcaatttcatacttttatattataagtcgtttgacctttttctagtcaaacttggttaagtttgaccaaatttatagaaaatttggcaacatctaaaataccaaactagtttcattaaatataacattgaatacattttgataatatgtttgttttgtattgaaaatactaatataatttttctataaatttgtacaaactcaaaaaattttgactagaaaaaaaatcaaacgacttataatacgaaacgaagggagtacataaataagcacaaaaggggaatgccacttctttaaacaaaagggcgcatgttaataaaagaatggagtaagtatactgttagttctaatgattcaggctcagctagttctaaggattcaggctcagctaaaaaggagacatctcaaattaaaatggtggacgtcgtgtcttgaattttataaatgagacaggacagaaccgctcattggaatgaactgagaggagaaagtacctgatctttggtctctgtttcagtaatttctctctttactccgatgttgtgaataaggcttctaaaatgaaaatataacatgaggcagggcacataattatacaaaatttaatacagcttttaaaaaaaggaaaaatagataccttgctgagtgtcccgtaggtttgtgatcatccaacaccatatcagagtcagggtcgtgcctttcatctggatcctcttgatcttcatctggctgaataatgagcacatatgcacaggacacaaatacattcagtcagcccttgagttatcacttccaagacatcatttgcatgcttatattaggaagcctggagactcacctcaggtagctttgtttcaggaattcgctcttgaaattggacgctaggtgcatgttgaagttttgaaagattgtccagaatattgcattttatttcctccagttgcttgtttgtatttctgttctccatgttacttgctgcaacgtaaagactgtattctggaccaaaatattcataatactcattgtaaggcaacttctcctgtagctcttcaccaagtgcaactcctgtctggccaaataaaaaaccaaataaacaatcagaggataaaaccatagctgtagcaacagatgttcctgatataagactccagcaagcataaggcactgccattcgcacttgttcgccatgtttagcctgctgtgtgttcagatttataaattcacaaaaggaaacgaaagcaggcttgcaaggtccaaagagccaccagattttgggttgctaatttattaaacacacctttgatgaaagctaacaactgaggaacaggtggtggcctgaagcatataattttgcaagggttaacagttagctagtagcgttttccgggattcatcggaagtaataatgttaagcttgtctatgaaagctctattgtgccttgcctgatactatatctgttttaaaataaccaccctttaatgctttgagaaacacaggatgatttgttactgcacaagttctcacaaattaatgcatttgaatgaaacagagtagaaaataaatagattaagcattacatgtaaatgggcgataggtgttctgtgcatttcagtcatctgctcagcagaaaccaaaatcttagtttcgtgattgtaaaattacagcagcatggatcaataaacaaagccaggtagaaggtacagaccactatagaagacaagttcttgatgctgagcatcgaacacagttgaaacacaaagcaaattaggttctaacacattaccgagctcatggctttgctttatcatccataaacaatagaattaattgtatgttaaaggcacaaaggaaaaaaaaagcggggggaaagatatatatcagttttgtcttctgatcagattacatacctcgtaacaccagcagcgtgcaacatttcttatggtatatccaccaccaccaagaagaagcaacggaacattgaaagacctcatgaacttaacacattcagcatgacctttccctgagagattgaaacagcccaacctatcaccggacaacgaatcagcgccgcactgaagcacgactgcaccaggacgatacatctccatgactttgctgatgatcggcttgaagatggactggtagctgtcatcatcaattccatcatccagcgggacattcaggcagtaatacttcccttctgaatacccaatgtcgcggatatcccctgttcccgggaaataatccccaaacttgtgaaatgagactgtcataaccctgtttgttgtgtagaatgcctcctcaactccatctccatgatggatatcaatatcaatatacagaactcgctgtaaatatgaagacagcatattagtggtttagcacaagaagacaactagaccaaataggggaaaaaaacatctgatctgttttcaaactttcaactgttcatgataatctaggattgtctttacgcaacatccattcttcagatctgtgtaatcagtcacctcttgttctgaatacgtttcaatcaaatcaatctcttatcatgaatcgtccaatgaaaattctgtatgttgtactccctccgtcccataatgtaagcgattttgagatttttcttgcaacgtttgaccactcgccttattcaaaaatttttgaaattattatttattttatttgtgacttactttattatcttaagtacaacttttcgttttttatatttgcaaaaaaaaaaatttgaataagacgagtggtcaaacattgcaaacaaaaactcaaaattccttatatcggagggagtatatagctttaacagtatacatcatgggcaaatttaataacaaacacagcaagttcgtcgtcatatcattctctctctttggaacatcattatatcaactagaaatacatatacacattcagaatgattcatcaacgtacatgagcttttatccaggaaaacaaaaatctgaataaaattgttaatacataattctgcacgtgccaatatgccatactattcagacaatgtgtaatcgcgtaacgaatagtatagtatgagatttaagttgagcaaaaagttaatccaatttctgtctacagatagccatttcatttacatttacagatgattaatatttcctaccgatccaaaatttagcggaagatcgatcgaactgtacacaacaaaatcagagcaactggagagaaagaagtcaagatgatttttgcttccgtcttcattgacccacccaacttacacatcaagtaatctatctattcgaaaaattaaacaaaccacccatccaaatagtactactcctaatctattcgaaacattaaacgaaccaaaaaaaaacaagaaaagcagaaaaaaattgaaaaaaaaaaggaacacaggtacgagcggaataggatgacgtcacctcatggagcttgaggagctcgaggatggcgaggacgatgtcgttgacgtagcagaagccggaggcctcggacttcttggcgtggtgcaacccgccggaccagttgatggcgatgtcgtgggtgccgtggttgagcttgacggcggcgccgacggaggcccccgcgtaggtctggcagtaggcgtagaggccgtcgaagacggggcagtccgggccgatgttgaagcggcggagggcgcggacctggccgagctgggtctccggggtgacggcgcggaggaaggcgacgtagtcgtcggagtggaagcggcagaggtcgatgccgcgggcggggagcgggcggagcaccttcatcttggccggtgcgaggaggccgtagtgggcgagcagcgcgtgggtcatcctcaccccgtggggcttcatcgggtggccctgaccgtagtagtagttgcccaccttccggtcgtagaagtagcacacccgtcggttttgcgcgtccgcgcacgacgccgactccagtgagttgacgccgcgcccgccg

SEQ ID NO: 14340 - DNA, 35557 bp, Oryza sativa
aatggaagggtctacaagtatataagccgcatacagagggcagggaagacggctgtgtcaaacaatgggctctcggcgcctcgccgttttccctgtacaaaatcaccgattattaaaatttaaaatttaaatttaaattttaataattttatgaattttcaatgtatttgtttatatttgttttaagtttttaataacgcacatataaaaattttgctcataaattattttttaaatcgttaataagttgttttaacttgcaatcagctcacgatcaatcagtggggccctagatattccatgaattaccagggtcaaggctaatactccctccgttaataaatgtttgacaccgttgactttttagcatatgtttgaccgttcttattattcaaaatttttgtgaaatatgtaaaactatatgtatatatgaaagtatatttaacaatgaatcaaataataggaaaagaattaataattctttttttaataagacgaatggttaaacatgtttaaaaaaagataacgacgttaaatatttagaaacggaggaagaattgtttagtccaaagctaattataagtctaaagtgatagtttttttatatgtgtgctcttagtaaagtcatttctaaaatataaactataatgaagacaaaatcaaccctaaacttaagtgatattcgaattttggttgtgacacaagttgcaacacaaacgatggagcttaatttaatttcttagatagtttttttttgtttctgcagtggtggttaacatattttttatttgatattgcgcaaggtaaatacggcgcgcatgatggtattggaactataggtttaagaaatattttgcaactataatttcctatacactataataaaatcacacaatttctagcgcaaatcaataactttgtagcccatatttttggctgacaggtagacgtagagtcatagactaaggctgggttcggaacccctcctccccgacatgcacaacgaagtacgtattattggatggttaattaagtattaattttttttttgaaaaatggaataatttgattttttttaaaataactttcatatagaattttttttgctaaaaaacacaccgtttagcagtttgtaaagcgtgcacgcagaaaacgagagagatgagttgggaaaagtgggataagaactcagcctaaggctgtgttcgctgctacctcttcacaactcctctccctcgttttccgcacgcacgcttttcaaaccgttaaactgtgcgtcttttgcaaaaaaaatttctacacgaaagttgcttaaaaaatcatattgatctatttttgaaaaaaaaaaagctacttatcactttccttttctctctccctcccccctctctcttcccctcttttctctcgagacacccataggccagccatgccacgccctccaccatcagcctgatagtcttatcggacatgaccgtgccacttgtcgtgttgaaggcaccctacatgaggtagagcgctggggggatggcccgttgagacagcggcgctgctgagtcgcgataggatgcgcaaggaacacatccatatttgtcatcgttgccgtgatccatgcacctcggagacgcggctagtgggaggatgggggtggtcaaagaagaggagtgctatgcgagggcgaggcgggcggcggtgtagaggagtaggagtgggtggtggccgccaccgccgtagccatggcggcgaggagatatgtgtaaacggtcgttaagtactattataataaataaatagagaattaacatttcttacacatatatcaataataaataatatagttgtactaaatttgaagagctaacatggatatagagattatacaccaaagtaaaacaaaaatgaagccgtcatgcacacctccgatgaatcacgtacgagaccgtgatggttagaccaatcgactattcctaccatcagaaagtcatgaaccaaaatcaaattaaatttctgtacatagtatatgcatgtcagtgtaatgccttgtttagttgacaaaattttttgtccctgcgtgtcatgtcagatatacgaacacacgttttaagtattaaacgcagtctaataataaaacaaattataaattccgccagaaaactacgagacaaatttattatgcctaattaatccgtcattagtaaatgtttttattgtcgcaccacattgtcaaatcatggcgcaattagggcttaaaagatttgtctcataatttacacacagtttgtgcaattggtttttttcgtctacatttaacactttatatatgtgactttatatatgtgttcaaatattcaatatgacagtgaaaaattttgttttgagaactaaaccgggcccgacagatatgcatagttgaaattggagatcgatttagacagcgaacgcggagtgagttgaatgcaagatatatagaaatgcgagacgcgactggagtttatggaagacacagcaggagacttcacttccaatgtttgaaatggtacactttattgcctaaggccctgtttagttcccaaaacaataacttttcacccatcacatcaaatgtttagacacacatatatagagtattgaatggtacactttatactcaaactgaaaatcaacagtactgaaatttcagacaggtatatatggctcttcctaccatgtgccttgtatttatagacatcaggctgcagtcataataagtaaagactacatgataagaacactactacaaatatagtactactctggaaaacctctatattaaataacaagaattgagcatttctgatagtgctacattctatgggggcgctttttaactagcagcctctgggtattgggacagcttacagatacaacagtgccacaaatctgcattccccgttaccttctgtttgtgaccaaaggggtacacatggacaaggcacaaggccggaacaagggctctccgtgaactgtgtgaatggggaaattgggaaaaaggagccaggcagcagcagtacattccgagccgcagaattgcaacgaagcaaaactgattccgaagcaaaactgatggccaaaccatgcctagagtatcctgaccatcgagagaggccattggaggcttcttgtcgaggatcactcgccatctccgttgccaaaaactccgacgcgctgcctcctcttatcgaaaactgccctgaaggattcaccttcgtcacgaagttgttcgctgaatcgcttctttgtatcggtgttgattaccccctttgcctgcttggaattatcttcagccaaggggttggaaacctgcaagcaatgggaaaataaattgaactgcccaactgtcaagggaggggcttcctgcatgcattatctatgggtcttcctgtaccatgtggctaaagcaggaaaaacaaccatctaataaacctttcagaatcctaaccaaatatgagcatgaggatcttctaacttgcaaactaagaaagatgagtctgaggctatgttcgaattagatgttagggcttgtgcagcataaaaaacgagacaagtcattaggatatgtttagttaagtattaaatattataaaattgaaaaatatatttatttacagaaacttttgcacaaatcacaccatttagcagtttcaaaagcgtgccctctataagcaagtgccagtgcccagtagacgaaaagaatttgcttaagccttgttatttactagcatgggttctacttctacagcagcttcaaccgcgcacaaaaaggcctctgctacatcatctatgcttacaggtttttaagagccaacgtgctgccccaagccctcaactgtaagcactgacaagaatcaattttcataacattagcacttggagaatgaatgtaatttttttattgagtatgcagatgaagaagtttctaaagttaaaagtgttaaaatcaaagcatataattgttttctctacatcgcagagccttttagaacattgtctgatccattattaatgactctcatgacccacgttttctgcaagaactaggataagatggcaaagagatacaaggatagaggatcaagttatgaaactacgtagggcatgcagaaagattaaagactgcgaaagtaccaaactttagtaataagtcaattagaccactgaccaaattgtaccctgatccgggtcctatgattaatgaagaagtgagtcttcttttagctgcaccaatagaaaaaccacccttttctagctgcaaggaaagaacagaaaatatgggaggctagttaaatgatgcataccaataagaagttgcagaaggacaataagggcatcacttgtcctcttctttttataagtatcatcaaatatgtgtttgtaatactaagtgagcaatcaaatacgattagttatgtactccatcccataaaaattgtatttctactaatgcaggaccaagcaaattaattacatcaaaatatatttccttgtaatatccattccttccatcacatctctaacttgttgtttcaactctcaacattccttttaattaagtttatatatggaatgtgtgtatgtattgtgttcattaaataaggttattgtggtcatttgtctatcctactaatctgtccttaattccctagaaatacaaggtagttgtttaatagtgattggtttattgcaatgacagaaatataggccgctaatatttgatattaacaaaatgcaagaaaacaatgcattttttcccttgaagcaaaaaggcatacccgatctccccaggtaactgtttttcgatgcgtgctgtaggtttgagccaatccagaaagagcatgcgtacttccttctgcatggtcagacttctcggtatcctcatcaaaatcttttgaccatttactctgtcctagctctttgtagccatccaggtcgtcttcttctgacgagtcccacttcttccctgctcctgagatgtctaaacagaattttacaggtctgacttaacatgtccttaatactttcactaagaatccgttatagtgtttcttataattttaatgcttaaggataacttccaaatcaaactaacagtctgctactgctgatgcatgcactacaatatcagaacagtgggtccacattcatggtacagtgaatagtacaagtttactattattgatattcacaatggcagggtgtctgttgcacttatttaaccatctatttcaaacccacagtgcttgttttgcaggggatttgatctctccacatttcatcagtattgccaaataagtatttggttgtattataagtactaactaacacaacagaacaagaaaaaggctttctacatttatgtgtaaagtaacttacagtatttcctcatagttttgaaggtttaaatgttacaataaattgtggcaaaggaatgccaacactaatcactgaagaataataggaatctgtaccttgatcatgtccattatctagtgattcagacacagccttctgtgtgttttcagcttcagtactagttgctgtgttactggccccatcagtgtcttctgtctccatatccacctatttgaagtacaatagattttgagcacatagatctctttaagtgactggtagggtagggatatactgatatgggatacctcttgaatggaatgctcgcgtagattgtcatcgttgaataatgactaaaaatattaatacaaaacatgaaaaacacgattaatcatgtatctaatagcatgtcttaagtcttaaccgccaatcatatgaatactatcagaaaacatacatggatgtctagtcgaagatatagtggtggagcctcttcccagtctgctgccatcttgttcacatcatctactgtaaacccatgcacattcctagcagcacagccctgttgttcacaagatatcacatcatctactgtaaacccatgtacttactggaactgaaatacattctcagatgtttataatatatggtgtaaatattggtaatataactaatgggagtgcaaacaagattttttacagcctgatacatatatgaatcaaataaattcaatatgattttcccaggactgcctagatagcttatagttaagaaaacttactgttggatccttgtatggtgcctccagcaggtacacttcatagcctgatttctacaaaaggaatagaacagtgaacttactttcaaatgactaccaacaagataaaatgattcagagaataaaattccaaagaacaaggtataggaacagagtgcctcctgaaatggcaaggtataatccaacaaaatttgcacagattagtctagaagttacaatcatatgaaacggtcacttgtcatatgggcatatcatctaaattctaagaagtcaatagtgccattaaagtggaagtcaaagatgctttggaccaactgaagcatcaagaaccacacggatacacaaataccgaattcattttagcaactcgacagttgattcagggcatgtaaaacaagcagataaccaaaaacccttgaaaataaacgagcaaaaggtttatattattgggcaaaccatgtaatattgaaagaaagcacatatatgcagttaattgcatacagaaaccagaaatacagctagcgataagtctgcactaagaaacaaccaaataacccctctggtgtataggtacattcaattgcagcaaagaagggagagaagggtccaataaactggactgccttagtgtcttagtggtaataaatgcacagtgctattaattaaggctttgggacgcgaattcttgtaggaattatcaattccagcaggaataaagaaaaaaatggtttccaaacagggcattaatttatgacagttacttaatgctatgcctctcatactatccactacacatatgtcaagggggtgctagcaggataactataatattccctccttttcaaaatataaggcatgttttgtttcgttaggacaaggctgtgacccacaattgctctattaggatattatttatgtgatacagaagcataatcataattaagtgcttttgaatacgaatctaacaaattcaatttcgtgtcacaaaaattatatcctaatagagtaattgttggtcaaagtcttgtgctagcaaaaaaaatataccttatattttgaaacaaagggagtagtattaagagaccattaataaaaaaggaaagagaaaatagaagattcgtagtgtatccaagataagttaatagtgttttccagccttataatttgcactaaagtatgcttttcaagtgcaggccacctcttgttctaaggggagaaaaagcagaacccctcttaaggattcaaaaccttaacaaaaagctccaacaagcaatgtaaattctcacagttgacgcaacagagactgagagtttaccttcgcacttgcccaaaattgagcaaaatcagctacccgcagattgcggtcatccactaaaaacgggcagggataccagcaataaacaagtcagttaccacaaatccagcatcagccattgctaagaatgaaggcatcacccggtacaatgccattgtaggcctgttgcttaattgaatgtttcaaacagtacaaaacataaaccactagtacaaatggatgtcctgtcatcctcccaatgtctaggaacccattgcctatgtcctaatcccagaaaatggccaccaaacattgaacttaataagacaaagatccaatcatgaagaaaagccaatagattgaaataatatgatgtcaatgaatatatgataaagtttgcatagggctttttccgtactcaatgaaatttatgataaataatgaggcagaacataatcataaccaccaaagtaattaccaccaccatgaattaaatcattaaatcattaattcatcctaaagcaacaatatttaaaataactcataccaatcacaaatgtaaaattcccttcatcaagggtcttcttaaatgcgttcaacatgcttgatctgtacgtctgtccaataaagaagaaatttagcaaaattactacatcaaatgataaatagtgaaatacatgaaaaaaacaattactcatgctgcaattatcgaaaatgtgaatgatggacaatactcccatgtacagtatacagattccacaacagaaacacatctatgtgggttatgaagtatactgcagtctgggagatcatatcctttcaacatcaaaatgcccagtgctgcaacttctaggcgatgtgctctgatattgttatttaaagtaaacctggggaatgtgacatttctaaaggtttacattagttctaatgagtaaagactaatttttcaggcaaatgaaacagtttgccataacatagctccaataattggcaatagcattcataataaatgagataaaggaatgaagtcaaacaaaaactatttcatcacctcctccatctcaggctcataacagtactcgatcactttcttggtcagctgctttcttcctttggatgtactagaagattttgacccttcattgtcttcaactttctaagagcattaaaccaagttacaagacagaatacccatcaaataaaacagaaatgtaataagcaattctgagtatagtgtgacaaattagtgtacagggttcatgataggttctgctattcttcaactgaccttctcaacctcaatcatgaaatagtcatccatcgaatgaattctaggtgcatttccaccattctcaacttcaaggtcacgcaatgcctttgcaagatagctctttccactacctataaattgtaacagtggtaacacagatatatatatgaataaattcccagagtaaaaaatattgacagtcttgcagactattaaatcatgatcataatgcttgcgtgcaataagaggaaaaaaagttatgtatcaaaatcagataaaaaaatgttacgagcactctggacagtagacaatgtctacaatcttcatggtccaatttgaccacaagtttctgatcgtctactatgatatgcttgtaaaatgttacaagaataatagcactatgaaagtatttcaaccattggtttattattgatgttattttagtagtttgatcaatataaatgcctctattaagatcatgattgaagtcagatgaagcagtgtgcatttctagaaacaacatatatttatgaatggaagagtagtaaaagagcttatcatgtgtattgttttgtgaactgaaaaaataggcatttgataagtataaaagaaacatcagcaactcccaggtgttatatgcagagaaggtcagatcaatctcaacaaacaacaggtacagtaaagctaccacacaaaagatgaacgctttttgaggcatagtataacaaaattagtctaaccaagcgctgtggccactggctagcatacaaaactgtcaacagtgtcggcaatgttctttggaatgcttaatcagccatatgggacataaaagtggttgtgagaaaacctggcagcccacggaggatgataacaatatgatcaggccgtgacccacgaagtggctgcttgaacaagtcacaggcactaattacactgattttagcattgttgatggaatgctgagcttgggtttgccttccacctcctaaatgttgctctaagtgtggttgatatgccaaacctggtacctgaaacattcgtacaacaacaagtactgctttctgagtgcccgggaaagtattgaatcataaccagtgaacacaagttcacagagagaagaagataaacctcattgtggataggtccattgtaacgatttgcattaggcatcaggtgagcttgatgcaaagtatgagaactaggtgggcgcgcagttgcggctggagaaccggaatgaataggaaacaaagatgatttcacagcctgcaaaggtggcttggcatggtaatctgaggaagacggtacaggaggctccagtggtggtggtggtggtggaacatccgcctcaggatgccaaccgtgggaatcataacggcttctcgcctcagggtatcgagccggtggagggagcggcggcgcaacaggcgattccgagcgttggaagcgattgtagcggtgatcatggttgaaatacccctcctgaggtcctccaggcacaaaacttgaacctaaggcggcaagcctttcatgcgcaggtggaaacctcccggcgtgctcgtaatcgggaaaactgccttcatgcgcatagggattgtcataatttggaggaggaggatagcctctccctcctccatagccgaaccgatcaggaggtgggtacggttcgccgtgcaacatcccaggcggcggcggaaacggagggcggccgtgatcccggatcaagccgagcagccggtcgccctccacgggaaccatccccggcggcggcggcgggggcagcgggggaggcatcccgtcgccgtacggatcgcccacgcgcatccgcttgtggggggcctccatgtcgaggacctcgtaggggtgcggccccgggggggcccacatcggcggcggagggtggaaggggacgtgatactccggcgggggaggaggaggaggaggagggtggaagggggcgttgtactccggcggaggagggggcggaggcgggtggagatcgtaggggaaggggtggggcggaggcgggcagaaagggaagtgcggcgcggcgcagaccgggcagagctcgtcgccggcggggaaccgccatggatggtccatgggggagatggtggcggtggtggtggccgaatggggttagggatctagggttttgggggaggaggaaggatcagggagcttcgagaagattcgagaagcttccttcctgggcttggggtccgcgggggtggacggctgcggcgccgcccgcctcgtctgggtagccagaaaaagcctatggaaccagaagggctatattggaaattgacgtcgtgcggtgccatggttattccgttttggttgttttgcacgtataaccctcccaggttcttaatttgtaaaagagggctgctcgagaggacaagcccttgtgaaatgataccgtgaaaacaaagaagttgttcaatagtactggtagaaaatgtacgagcatagacatcaattgcgatgttttaggtgtgcaatgtgtgaaaatgttactgtaggagacaacgatttcatattgattggctatagctgttgtggctagtataattgtgctaccgcctgccgccaacatatgaacaatctaaagaagaaaaagtcgtaatagcgttgtaacgttcaaaattagttctttttgccgaagtatctttgctactatgatgcaatgcttatatttttgaggaaacccacttagaattcatggttttttacttgtttaagctagtttgaattagtatattctgtaatattctacaaaatttgagcgaaagcaatatatttggacaaattgtgatgatttgatgaagatcacattctaaaacaaacaatcaaatatacatggttgttttgttaatattataaattctagtgttaccaaacaaatttcaatacttcctctgtaccgtaaagcatgacgttttaaggtttattacccagattaatgtctactaaaaatgaccaatttaccctcattaattcaatttagctctgatgtgcatgcactctagaaggccccacagaataatagatattgcagttaaatagtaaacgaagcacaccttgactaccacgtgggatttgcataaacacattagagccatggccataaaaattacacatgagaaaacaaccattaccatagtttaaacatttgaattagcctatgtagtatgtgctttggtgcctaggaatgcccgtctatttctgaaagtgggccacttctttgattatggccaggacgatatttttcctgggacattagttggacgggccgggggaacgtccaaacttttgggataacatactttctccgtcccataatataagtgactttgaggttttgcttgcactgtttgatcactcgtcttattcaaaaattttagaattattatttattttttttgacttactttattacccaaagtattttaagcacaacttttcgttttttatatttgcataaattttttgaataagacgagcggtcaaacactacgagcaaaaactcaaaatcccttatattatgggacggagggagtagtaacaatattcaacttgcttcaaatcaaatactcctcttatacttatatgtaaattgaatatattcactgacaagatgcaaaagtatctagtatatgaaatttataacttctgcagccccataactgcaaatttatctccccgttcgaagttcccacgcgaaccgttgccgtgccgccgccgccgccattgacgccatgggagcagcatctccgcgagctcgctcgcgtttccaatggcagacgccccgcggccaccatcgcctcctcctcgtggaaagaaatcatcagagctcgtctccgacaagaaaccctcaccgcctactcctccagcctccgtcccgccttcacctaaccctgcttgctcaaggccttcacctagtcgagctccggcccgggacgaagcctccacgatccaggtccacgcccgcctcgccaattcgggctttctcctcctgcgcctacgctacgagctggcgccgaactcgcgagctcctccgcctcggggtcgcgcgcagggtgttcgacgaaatgccgaagcggaccgtcgcccgcttcaacgccctcttcgctgggctcgcgcagcgcggggaagctgatgaggcgaggcgcgagtcttaagcccctccgggaagaagggttgccagccaccgagctctgtcatggctgcctgccttacttatgcggtggtcaagcacggggagcagttgcattggcttggcttgtttgaattgctagcgttacaatgcgatggattctgggttattgaggaatgatgagcacaccatgcccttggatactgttggagaaatgatatttgggttcagtgaagaacctaatgggaatgatttcgctggtgttctcagcatgcacaagtttgtcagcattgtcacttggtaaacacctgttgtcatgtatgcaaggtgcagttagtgcttatcggcttttatcagccgtggaggaacaaagcttggtgtcttggaataccatgatctcgggttttctggcacacagggttgttcatgataaacagaaggtttcaagcctgagtgccggacagttttacatggaacctgatgattaatgggtctgcagactgtgcacaccacgggagattgtccaggtcttttcatcttttagtaagatgcaaatggagggtttttcttttcctcgagaaactggcaggagatctgccttgatttatattaagaagaatatcaactgagtaggttcaaattacgtgtcctgatacaagaaccgaaagaaaacaactgttaggatctaattgatgtacataaatttctgcaggttaattctcgtcggcagagattggcaactccatctgtgtgatgttctgaattgccatgaaggcgatttgcagttgtctttctgttgctgctgaaagattcttctgttcctctccagccaaatattctgaaaaaaaacaatgacaagtgtgccgaatgcttgttcagccttatcaattttttcggcaatgctgggagttcaagtatgatgttttccaaacaacagcaattgacatgtttgttgctaatcatttactttcttctacctagtttgatcattaatggataatttttttatatatttattggtttacatttctttgtattttcttggcaggaaagttgtttccaggttgcaacactcaagagtaggaatgtgcatgaaagcctggtcattgcggggtgacatttgatttgaatttgcaccatccttattccctcgcaagtaaagatggtgccatggtaccaaacattacagttccacaatatcaagaacctgatattaggttgatatgctgcgtacctgtgttaaactctcgtagtgaccttgtgccatctcagcagaattagttttgagcttgcattttgccgcaaagccatgatcaagattgaccctgtggtcgacacgtgtcaagtggtgggagcaaagaaccacatgcactgtggaggcctagaggttcgcactgtgagtgccgctttaggcatcactgagaatgcaagctggagatggagaagttaaaatcaaatttgtcatcttttgcgagctgatggtcccttgtatcagtggaggatgagcccactggttttgctgggaatgttctttttgcagaatattttagtctgcgccgtagcgtgtgatctgctgagtagaatatactgcttgtactacttttcttagccacagtaatgatagaactgtaaggatttggtggatttacctgtagaatttcatagtaatcgacaaatgatataatcggtaattaaatggccttcaaaatcgatagtgttgtctattgtcgcatataacattataaaatgtacgttttataatgtacaagatgagtgtactgtatcttttacacgccagccatcggtgctaactcattttgatctgtgaacttaaggcaaacgaatactcgtaaaccttttctatataagattaaacctagaataaggttaacaaaaattgtagttagttatgctgcaactttagcatgatattttagttaatgcaaccatctttacatggttttttttatatagaattgtaacttaaaacgcaacgttttgcccgtgacaggtatggcatattcgtcaaactttatcatggaattgtaaccttggaacgttgggtcaagcttcaacacacatatgacatactcacggtttcacgcagacatagagtagctgtgttcttttgttggtgttggtaactaatcccttgcttttgttggtgttaggaactaatctctgatctctggtgcatgtaaaacggagttattaaacacatgactaattgcgtattagctatttttaaaaaatagattaatataagtttttaaagcaacattcgtgtgtgtatgtgtgtgtctatatatatatatatatatatatatatatatatatatatatatatatatattaaaaaaacacaccgttcggcggttgtttgagaagcgtctgcatgaaaaaggagaaatgtgaggtgggaaatgaggggaggaacacaaccttaggccatatttagttcctacacaagaatttttaaccctgtcacatcgaacgtttaaacacctgcatgaagtattaaatataggctaaaaaataactaattgcacagattgcgactactttgcaaaacgaatcttttaagcctaattgctcaatgatttgacaacacggtgctacagtaaacatgtgctaatgacagattaattaagcttaataaatttgtcccgcggtttactgacggatactgtaattagttttttttattagttcccgaacaccccatgcgacaccctatatacccgatgtgacacgccaaaactttacaccactggatctaaacacccccttagtctaaatctacctatcagccaaaaacatgggctacaaagttgttgatttgtgctagaaattgtgtgatttattgtagtgtgtagaaatttatagttgtaaaatatctcttgaatgccaataccatcatgatcgccgtatataccttgcggaatatcaaagaaaaaaaataaagctatgtgagccacccctgcagaaacaaaaaggaaactacctaagaaattaaagctccatcgtttgtttttcaacttatgccacaaccaaaattcgaataacacttagagttgattttttctgcattatagttatattttagaaatgattttactaagaacacatatataaaaaaattatatcattttagacttatgattaactttagactaaattatattagccttgaccctgataattcatggaatatctagggccccactgaattgatcgtgagctgattgcaagttaaaacaatctatcaacgatttaaaaaataatttatgagtaaattttttatacacgtgttctaaaaaacttaaaacaaatataaaaagaaaaattgcattgaaaatatcataaaattacctttaaatttaaattttaaattttaatgatcggtgattttgtgcagggaaaacgacgaggcgccgagaggcgagagcccattgtttgacacagccgtctcctctccatctctccgccccctgtatataaacccccccttcccctcctcgcccatcgcggcatcgctcgcctcctctgcttcgcttccttctccagcaagcacccgaccacaacacacacgcgagctcctcgacctcgagagagagagaaaacccaaccccgaattcggcggcggaggcggaggcagcggcgatggacccctcgtcggcgggcgccggcggcaactcgctggcgtcggcgtcgtgcggcgacgcgcagaagcggcgggtgtgctacttctacgatccggaggtgggcaactactactacgggcagggtcacccgatgaagccccaccgcgtgaggatgacccacgcgctgctcgcccactacggcctcctcgccccggccaagatgcaggtgctccgcccgctccccgcccgcgaccgcgacctctgccgcttccactccgacgactacgtcgccttcctccgcgccgtcaccccggagacccagttcgaccagatccgctccctccgccgcttcaacgtcggcgaggactgccccgtcttcgacggcctctacgcctactgccagacctacgcgggggcctccgtcggcgccgccgtcaagctcaaccacggcacccacgacatcgccatcaactggtccggcgggttgcaccacgccaagaagtccgaggcctccggcttctgctacgtcaacgacatcgtcctcgccatcctcgagctcctcaagctccatgaggtgacgtcatcctattccgctcgtacttgtgtttgttcgtttttttttttgggttcgtttaatgtttcgaatagattaggagtagtactatttggatgggtggtttgtttaatttttcgaatagatagattacttgatgtgtaagttgggtgggtcaatgaagacggaagcaaaaatcatcttgacttctttctcttcagttgctctgattttgtcgtgtacagttcgatcgatcttccgctaaattttgatcggtaggaaatattaatcatgtgtaagtgtaaatgaaatggctatctgtagacagaaattggattaactttttgctcaacttaatctcatatatattcgttacgcgattacacattgtctgaatagtatgtcatattggcacgtgcagaattatgtattaacaaatttattcagatttttgttttcctggataaaagctcatgtacgttgatgaatcatgctgaatgtatgtatgtatttctagttgatataatgatgttccaaagagagagaatgatatgacgacgaacttgctgcgtttgttattaaatttgcccatgatgtacactgttaaagctatgtactccctccgtccaaaaaaaaaaagtgaatctaggactggatgtgatatattatagtacaatgtctagattcgttgtactaggatgtgtcacatccagtactaggttggttttttatgggacgatggagtacgacgtacacaattagaatgttcattggacggttcatgataagagattgatttgattgaaacgtattcagaacaagaggtgattaatcagacagatctgaagaatgtatgttgcgtaaagacaatcctagattatcatgaacagttgaaagtttgaaaacagatcagatgttttttcccctatttggtctagttgtcttcttgtgctaaaccactaatatgctgtcttcatatttacagcgagttctgtatattgatattgatatccatcatggagatggagttgaggaggcattctacacaacaaacagggttatgacagtctcatttcacaagtttggggattatttcccgggaacaggggacatccgcgatattgggtattcagaagggaagtattactgcctgaatgtcccgctggatgatggaattgatgatgacagctaccagtccatcttcaagccgatcatcagcaaagtcatggagatgtatcgtcctggtgcagtcgtgcttcagtgcggcgctgattcgttgtccggtgataggttgggctgtttcaatctctcaggcaaaggtcatgctgaatgtgttaagttcatgaggtctttcaatgttccgttgcttcttcttggtggtggtggatataccataagaaatgttgcacgctgctggtgttacgaggtatctatactttcccccgtttttttttccttatgcctttaacaaacaattaattaattctattaattatggatgacaaagcaaagccatgagctcggtaatgtgttagaacctaatttgcttttgtgtttccactttgttccttgctcagcatcaagaacttgtcttctagtagttggtacctactgcctggctttgtttattgatccatgttgctgtaattttacaatcaccaaactaagattttggtttgtactgagcagatgactgaaatgcacagaacacctatctcccatttacatgtaatgcttaatgtatttattttctactctgtttcattcaaatgcattaatttgtgagaacttgtgcagtaacaaatcatccggtgtttctcaaagcattaaagtgtggttatttttaaacagataagtatcaggcaaggcactgctagctaactgttaacccttgcaaaatcatatgcttcaggccaccacctgttcctcagttgttagctttcatcagagatgtctttaataaattagcaacccaaaatctggtctctttggaccttgcaagcctggtttcgttgccttttgtgaatttataaatctgaacacacaacaggctaaacatggcgaacaagtgtgaatggctgcacttatgcttgcttgagtaaattatctcttatatcaggaacacctgttgctacagctatggttttatcctctgactgtttatttggttttttatttggccagacaggagttgcacttggtgaagagctacgggagaagttgccttataacgagtattatgaatattttggtccagaatacagtctttacgttgcagcaagtaacatggagaacagaaatacaaacaagcaattggaggaaataaaatgcaacattctggacaatctctcaaaacttcaacatgctcctagtgtccaatttgaagagcgaattcctgaaacaaagctacctgaggtgagtctccaggcttcctaatattataagcatgaaaaaaaaagatgtcttggaagtgataactcaagggctgactgaatgtattcgtgtcctgtacatatgtgctcattattcagccagatgaagatcaagatgatccagatgaaaggcacgaccctgactctgatatgctgttggatgatcacaaacctatgggacactcagcaaggtatctatttttcctttttctaaaagctgtattaaattttgtttaattctgtgccctgcctcatgttatattttcatttagaagccttattcacaacatcggagttaagagagaaattactgaaacagagaccaaagatcaggtaccttttcctcagttcattccaatgagcggtgctgtcctttctcattcataaatttcaacacacgacgtccaccattttattttgagatgtctcctttttagctaaatccttagaactaacagtatacttactccattcttttattaacatgtgcccttttgtttaaggggctattgcttatttgacccctttttgaatcctaactaccaatttgaccctactttttagagtttacttatttgaccctccttttcagaaacgaagctcccgtctgaccctgtttccattagtccgttaagttttaatttaaaacaaaaaaaaagaaatacaactaatattcataatacccagaataccgttagaaaaccctatgcatccaccaaaccctatccacatttctctccttgcggcgacggcggcgacttgcggcgagacggcgagccggtgccgccaccccctcagatcggcgccgccctggtgacgacgacgatgagccggcaccggccctagtgacgacgacgatgagctggcaccggccctagtgacgatgacgacgacgaggagtggcggcggcggctcatcgacgacgaagagccgaagccggcgccctgctgacgaggacgaggacgacgacgaagagccggagccggcgccgccaccccctcagatctggcgccaccgccgctgcgtcctccctccttccgcacgcttgcgccagcgccggccccctcccccgcctcctccctccttccgggcgcttgcgccgctgccgccgtcgccacctcctccctccttccgctcgcctgcgccgccgtcgttcctccctccctccacgagccaggacggccgctcgccccctccgtgcgcccccgccgcaactcaccccctccgtcagccgccgctgcctccctccgccccctctccctcagccccctcaaagcgccgccgccgccggcccatcagtcgccgccccgtggaggagaggagaagagaagagaagagagaagagaggagaggagaagaaggaactgcgggtgggtcccacatgtaatagagtcaaatgagtaaggacaaaagagacattttgtgcttcagttaacaccgttagatgcccttaacagaacagggtcatacgggagcttcgtttttgaaaaggagggtcaaataagcaaactttaaaaagtagggtcaaattggtagttagggctcaaaacggggtcaaataagcaattgtcccgtttaaagaaggtggcattccccttttgggtttatttatatacttgctccgtttcatattataagtcgtttgacttttttcctagtcaattttttttagtttgtccaaatttataaaaaaatatattagtattttcagcataaaacaaacatgttatcaaaatgtattcagtgtaagatttaataaaactagtatggtattttagattttgctatttttttctataaatttggtcaaacttagttaagtttgattaggaaaaaggttaaatgacttataatatgaaagtatggaacgtagggagtaacaatgaggttttctttatagaattctgttcttgctggcttgctgctatatgtgaattataatcttatccatatcggtgctagaaacatagtgaaattctcttgtgctgttgagttgtggaggaagactggtgtgctgatgaaaacatgtgctcatcatgtattgacattttcatctaaatgaaatttaaggccgcattggttgtacctttttttatctcacaggatttttttttgggttgtgcataatctcatccagattatttagaatctaccttgcatttatgcgaaacgagccctttgaaattcttgcagcacggacttgcatctttgtgtgatcttttgttgaactaacactttctgatttacacattctgcagcatggtaagagattaacaactgaacataaagtaccagaaccgatggcagacgatcttggttcctccaagcaagttcctgtaagtcgtcgtcttctctatccatctgcaaatccatagcacaaactctgcattgcataatgcctatatggatatagaattatccaacaccatggtttaatctgctctaacaaatcttttcatcttcacattgcttatcaacgatagactgcggatgcaaattcgatggccatcaacgcgccaggcaacgccaagaatgaaccgggaagctcactatgaactaacccacttcaggccaccagctcttatgccacggattcctgcatgctattagttacttactccgaggtgttgtatgactgtttcttctgtaggagtttacaaattacaactgtttcttttgttgaagaattccaaagtgtccaggcaatactggacgtggagacattagtctgatcaatgtactgcagagtacagaacatgtaacatgaaccaagttacagtgtatagtcttttagactgttagatggaactttcaggcgaaatgcctgtgcctacttgtgtgtgctctctgttggttgtttttcgttaaaatattttgttccggtttatcatgtacttcctacgtttttatgtatgagttgttttaaagagacaaataaatctattttttaatttataatagttaatacttaattaattatgtgctagtaaattttctcgttttgcgtgcgctgaaaatatcattttatactattgaatagaacggagctttagattgtgtcaatttgattgaatatagtcaactatttagaagcataatcagtggagacggaggtgcggttcagagattactgttaaaccaaccaattaatggggttcagagttagatctacacttgcaatgatgagaaagggaattgcttctatattattaatgtagactctgataatctagagagaatgaatgacttctatatgattaatgttgactcggataatctatctagaagatggggacttcagcagtataataagtgcaggttcagcgatggaaaaacaatatatatacaaaaaaaggttcagcgatggtgaagcaaaataaagatattccgatcgagtagaagaactagatggtaactaaaattacttttgatgtggtcatgagagcatatgtaagattttacttgtattatgcatgcaccagggaccaagattcatactgataaaggaaactatccctttagaaaatatattatataaattattttttgcggggaaatatattcatattattgataaacgaaactgttaggaaacgataaccgaacaaacgataaaaaacaatagatcaatcacagaagacacgagatttaacgtggaaaaccctctcaaaacaggagagaaaaaaaccacgggcgccaaccagcaaaatatcttcactatatctaaggtgaggttacatcgccgcacggcgacttacaagaggtatatatatagtggaaccttaaaagggatgacgatccatatcgctccgctacggcagaagctggcctttattaagtgcaaatgaatttggatcacaactcaacaaactccaccttgagacaaattccttcttgtagcatgaatcaatccttcaccctgaacacaacaaagacaaaaaacactttcggcgccaaatagcctctcgggctaaaccactataccaactaagcttgagcaaagctcaaacttagcaacaggaacatgctttgtcattatatcagcaggattatcatgagtacttatcttgcatacctttagcttaccttgcgcgactacatcacgaacataatggtacttgatatcaatgtgctttgtcctctcatgaaacatctgatctttggtgaggcatatagcactttgactatcacaaaacaagttaatgcaagaatcaactccacaaagctcagcaaacaatcctttcaaccaaactgattctttacatgcttcagcaatagccatgtattctgcttcagtggtagactaggcaacaacaggctgcaatgttgccttccaactcacagcacaactactaatggtaaacacataacctgtgagtgaccttctcttatccaaatctgcagcaaaatcagaatccacatatccaacaagccccttatcagtcctgccaaacttcaagcaagcatcagctgtacctctgagcctgaaaatccactgaacagctttccagtgttctttactaggattcgccatgtatctactaaccaaactcatagcatgagataaatctggacgggaacaaaccatggcataaatcaaagaaccaacagcactagaatatggaactctagacatgtattatacatcctcatcagtactagcacattgtaaagctgataatttaaaatgaggtgcaataggagtactaacaggctttgcatcatgcatgttaaaacgctgaagaaccttcttaatgtagctttgctgactaataaataacaaaccagaatttctgtctctagtgatttccatacctagaattttcttagcagcaccaagatccttcatatcaaactcactactcaactgtttcttcaatgtagtgatttgttccttgctcttggcagcaatcggcatatcatcaacatataacagcaagtatataggtgatccattaacaaatttaatatacacacagctatcaaattcagatctcttaaagccatgtaacaacataaatgaatcaaacctttcataccattgacgaggagactgtttcaaaccatacaaagatcttttcaacttgcaaacataatcttccttaccaggtactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcgctaggagataaaccctcctttctcttgaagatccatttacaacgaacatgcttcttctattttggcaagtgcacaagctcccatgtgccattcttctcaagagactgcatctcctcctgcatagctgagatccacttctcacagtctccagtaacaacagcttcagtgtatgtggctggctcaagagtattctccacctgttcagcacaactaaaagcataataaaccatatcacattcctcaataagacggactggagctccacaactcctctttgttctgcgatgggcaataggttcatcttgtggctgcaaaacaggaggtgagtgttgaacagtatcattaacatcattaccaacaatttcagtttcctgatcatccacgtgctccacctgcacgctaacatattgctactcctcatctgaaccacctggtatgacatctgtgggcaagctgtcattaaacataacagattcattgaaaacaacactcctgctcatgaaggtcttgttagtttcaggattccataacttatatccttttactcctgaaccataaccaagaaatagacacttaatagctctaggctctaattttccattatcaacatgagcataagcagtgcatccaaaaattctcaactgtgaataatcagcaggcttaccagaccatacctcaatgggcataccagaccatacctcaatgggagttttcttattaagtgggatagaaggcgacctgttgatcaagtagcaggcggtgttagcagcctctgcccaaaaacgcttgttcatgcgagccttggagatgatggttctgttcatgcgctcagctacaccattctgctgtggagtgtacgggatggtgtgatgcctaacgatgccttccttcctgcagtaatcatcaaaagcatccgaacaaaattcaccaccattgtcagtgcgaagtacttttacctccttttcagtttgcctttctatcataactttccactccttaaaagcagcaaatgtatcatctttatgtttcaggaaataaggccacacttttctagagtaatcatcaataatggtaagcatataatgagcaccaccaagagagggcttacgagaaggcccccacaaatcagcatgtacataatcaagtatacctttggtgcgatgaactgaggtattgaattttaccctcttgtgcttaccaaaaacacagtactcacagaacttcatgttaccctgagtgcagccatccagcaggttcctcttcatcaattctgccataccaagttcactcatatgtccaagacgcatatgccacaggttagtcttactaggttcatctttagaaacaacagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagagagatgagatttctcgccatccctggtatgtgtctcacatctttcagcgtacgtgtcatgccatcatgagtcttgatctgaacggagccaatgcccacgatctcacgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactagtaacaacagaggccttaccatcagatttccttttctccttattctgcagcttccaacattcttcaatgaagtgatttttctttttgcaatacttacagaactttttacctctggatttagaacggcctctactctgactcttgtcacgatcattgctgacgttgtaggttttctgctcagatctgcctctgacctgcaatgcttcgcccttagaggacgacgcatcagactaaaccatacctttcatcttctccctgttttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccacagaaccactctcctgcaacttgtgcgagaacaacttcatcttgatatgcatcttactggttagatctttagacatgtagatcgattccagtttgagccaaagttctgcaacagtcttttcctgcaacacttcttacaaaatatcattagatatatgaagttggatcagcgacagagccttacgatctttccgcttctcctcagcggtccattcagtcgatttcttcttcccgaagctttccagcgcctcatcaagatccgaagtttgcgccagaacagcctgcatcttgacttgccacagcgagaatctcgtcttgtagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaaccacgggcgccagccagcaaaatatcttcactatatctgaggtgaggttacatcgccgcatggcggcttacaagaggtatatatatggtggaaccctaaaagggatgacgatccatatcgttccgctacggcagaagctggcctttattaagtgcaaatgaatttggatcacaactcaacagaaactatcccttttaaaaaataaggttcatacagagaaacgaaactatcccttttgaaaaaaggaatgctagtaggtgaaatgaagaaggttgtacggtcttgtgaattagattatcagtctcttcctcggtacagcacggcccaacaatcagaagaagggagcgaaaataggcttattccagccattagacacggtccaaagagatgagataggtaaaataggcttatttcagctatataagacacaactcaagagaagcaaaatagactttgtcagtgatatgggcccgggggtatcatgtttagagggaggaggctgccccccaatgccacgtggccctcccccgaggggagtcaggcccgaggtggggtggcggccactcctacatagactagtcggaggaggctgccccccaatgccacgtggccctcccccaaggggagtcaggcccgaggtggggtggtggccactcctacatagactagtcggaggaggctgccctccaatgccatgtggctctcccccgagggggatcgggcccgaggtagggcggcggccactccttggccgagactagagggagaaggctgccccaggcaccacgtgatccttccccgaggggggatcgggcccgaggtcgggcggcgaccgccccctcccgtgactaggggtcgggctcccccgaccccctctttaggtcaccacgtacggtgggttaggtgtccgcctccaggtgcccacctacccgcattaatggtgacccgagcggtcgcgccacgcacgcatttaatgcggtgtgcagtgcactcaacaggtctgtgaccggtcgaatgactgatgggatccagaatgtcaggcgcaccatcgcgtgtgtcaggcgacgtgcagcccgacatatcccatcaaataataatggtgagaggttctcatcctcttattccagtcggagtcggtcctcctgctctggtcaaagcaaggctcccgtttcctggtgtaataggagcccagaagtcttcacccattaaatggtgactgacaggggcaccccccgtgtcaggcggcaagatttgacaggccccatcatcaagacgacgtgcgcttggcttcccaagtcaagagacaagacatgcatttaatgcaaagattataatacttctccaccggagctaggttgggttgttgggcctatgtggtatccccttgagctataaaagaaggaccctgcccactgagatagggggacgactcccagaaaacccgaactcgagaagagaaggagcaggtgcgctctctggggaagaaacccttataaaactcatccataatcccaaacacaggagtagggtgttacgctcgatagcggcccgaacctgtataaaccccttttgtctcatcgtctttgggggattgaaccccctcaagatcacacagcttcgctcaccgaatcctcgaatctcacccgctgctcctggccgaactcacaaaggggggcctcacgattccctggtggagaagttcattctccgacagacttatttaaggacgagcacgtgaaccgattatgcattcagaccagcacggcatgacctgagccttattggactgtaggtgtagcttgtggaccggcacgacatgacaagtcggaccgactactctcgggtggttccggcccgactactcttgggtcataccttggtcatggtgggcggcctatttaatttggccatctataggatgcccatttccaacacaaggccgcgcgcaccaccacctgtgtcatctcctgcgtcatcgccgccaccacctaggagcccatcctcgcgtcaatcgctcatttccggtcgcgacctcgatcaatctccgatgcgtgatgaactgatgatgaacgatgatgggaggcagctaggatgtcaacgtgcttgcctcactcctgatcgagcggctcatcatgctcttctcatgtggcttctccatgctaataaagattgagctcgatatagatagccataaggtctgaggtccgacggcccggcccaaggcacgatcatttggcccggcccaagcacggcaccgtccgattggtgtcgggcccgtaccggtatgacccaacagttgggccatgcctgggccgatgccttggcacggtgggctggcccggcatggaacgatcgaagaaaaatagtagaggatccaaaatagacttaatcagccatataaaacaacatccaaagagaagaggaatacaaaatagacttattttctagccatatggacacagcccaaatagttgagggagaaaaaatatacttattctgtggagagtacgataggctgtctgacctttgggtcggctcggcacggccccaacttattgggccgtgcgtatagcccgtgggctggcacggtatggcactacgtgtagatcgggccgtgccggcccaactgccctcggcctaggcccggcgatgccggcggcccatttggccatctgtagagctcgagggcattggatcaaggggaagagagaagataacttagagagagaggggaagtgaaaagtaaatgaaggaagaatacaatgataattttgttaaaaatttctaaaatgaattgcagtcatatctttaatatttattaaattgtaatggtacggtttgaatttcacgagttgtaatactttgttttcaaaacggataaatttatattggtatgaatctagttaactcgactagatatgggtatttcaactttcggagttaagtagttttttcaacatttaacaagtacatttctacaacttgttttcaacatttgacagcaacaaaaatataagatattttgtgttatctcctgccgctgctgtttcgaacttcggcaagttgcagtacaaagtcaaccttggcgcgcagcgcgctggtggtttgtgaccaaaccgtgatttgttcctttttactacattcccatagtccttaattttttaataaaataaataatcaaataaacgttcaaaaatgaataataccgtatatttaaaaataaaatgagtattacattctagcgtctctcgtcggtttcagtggtgctagagtctattcttcaagaagaccatctctagtcatttgctggcggcctggcgctgctgcttttaggggtttgctgggagtttagtggggttccgcctcctccaccctccctcgatataggagttttttttctctcttttaagtagtggagtagttccttaactttcggtggtctttttttttcagttttttcttttttttcctatgctccattaatagccttttattcatttatgttgtataactattcttttaatcacgtgtaatatttttgcatgttcaataaaagaaattacatagtagcgtcattgatcagctaaaactgctacgtagtcgattttggctttggaccagtggaaaaaaaactaaaagctaataattgagttactaatgtcactgtctgataaaattaactctgcatgctgaaggtcttgtgagcttctgttctctactttattcaattacagggtctcctgaaataaaaataaaaagataaagaagatcgaggtggggacatctctaatcagggagcatgaaacctaaaagtcttggccttatcttttcggtatatttatacttatcagtcaaatttaaatttttaatcttaaatttaaagttgattttaaggtttttccatcgaaatttattttttagcttttacttttagatcgctacgaacacgtatatcaaaaattttgttcacaaattacttttggttataaatatgctgcatgaataagccaaacaatgggaccgactgaagctgacccgttgaatttttttttatgtggtcagcaacgagccaacgactcaacattggtagtaaatcagctcatcatcgctggtgagtcaattattaagaaactggcattgcagcggagataaccggaaacaacaatacggaatgtggacaaattcagcggcgtatttccacaagaagggaccactggaattgaattggaagcaacggtctgtgctgaattcttcgatatgatcaactctcgcgtcagtgtaccaatttcggcaagtaggggccgactcaggattagcccaaagcacagacctcacctatggtaggccttgcacggtaattactcacttaataaggcgtacatgaatattcaactatttaaacatctgacaactaattattttattataggttaaatttatttgataaaaaataatatcattggagtgacatttgaatttactttcatatgataaaatttttttagcgtaaacgttgtaatatatgagaaatttaaagagaaacataatttttgaataccatgccaagttcaacagctccttattcagtgggacggagggagtacgtcgtaggctaagttcagcattcaactttcccaacttatatataataccttgttttccttgcacatgttttccatactgttaaataatatatatttttttaaaaaaagtttctataggaaagttattttaaaaaaacatattaatctatttttaaatttattttaattaatatttaattaatcatgtgctaatgaattatctcgtttcacgtgtggggaggtggacttcccaacctccacctccaaacatagccctaataggtctccaataaatccaaggcctcgggccacgtcctgggtggcccgaggcttgggtctacccctgtcggcaaatgtatattgctcactatggcatgtcccctcatgtggcaagcgaccactgctgccacaaccgacgatgacaacctcgagctgatggcgttcgtgacacgtgcgttaatgttaatggctcaccgccaccgccggtggctttggagtagacgtggggaaccgatttgttcccgtgtgctagtggcgccacgtgatgtatgggcccctggttctctgccggctgtcatgtcgcctctgcttgccttaaagcacggataatagtggactataagttagttataagcttatgtggaggagagataaaaaaataaggagtattggctcttatgtaagaactaactctagacatgtcctaaaataaatgcattaaggctgtgttcccaacctccctctctcgcttaccactcgcacgcttttcaaactgttaaactgtgcatgttttgtaaaaattttctatacaaaagttgctttaaaaaaattatattaatctatttttaaagtttttttaagctaataattaattaatcacgtattaatctattgcttcgtttttcgtgtaggaggcacctagctaagaacacagcctaaatacataagtgaaaaaaagatagagggaaaaaaataaacacaaccttatagccactcaattgtacttgttagttctaatataagcttatagtcagtagttcgtgacttcgttctactatttaaacttgatcatatatcctgtagttatggttagacctctcgatacgttaattcagtaaaaaaaaatcgaatcaactgagactgaattactctatcttaaccaagactaaattcggatttgctagttatcaggtgactgagattttctccaaatctaacttaccttcttcttgggagccacaacctccagcaaggactactatggaaagaaagaaaaggacgagaggtgtaacctgactaacttcagagggatggtggctttgagtggcagctggacagatgatggtggttcgcggcagggcgaaaccaacaggtggttaagaatttaggggacggatccgacggcgagcggagacgaggaagcattccctgtgaactttgattcgaagtcgtgatttgacccttaccggacttgttgtcattgacaaaggaagaatggaagcaaagacaatgttaccgcctcgctggaaaggcgcccttgaccgtgaaatgcctccgcgcaagccttgttttcaaagaaagatctcgtgattgtacacacgaaattttcatggcgcaatacatctgtgattcttgagaactatccctgttcgtgaatcctttatagtatttatatttgtcaccgttaactattacggttgcaactttaaccactaatattttgttttcaataattagattatgatgaacaaaaatatagtttaatacttttgtttaagtaaataatacactttgatagcatggctattaaagtatttagaatctttttttaaaaagaaaaattatcaaagtttaaatacgaatagtgcttggtgacagatacaaaggaatagatggaatagtatttaacttgttcaacaagatgttgaagtgtttgatgaaatttcgtaccaaaaattcatagaaaaatcattggggattaattttacgtgccaataacatttgcaacccttatttacaaaatacatttgagggacggctttatgataggcgagcccaaaaattccaaatgtcgcgatggtccgaatatattcaatattggacttgtcattttatatttcaaataaaaaataatggttcaaacggatttgaaatacaatacatgattccaaatttctaggctgttctagcggtagtccttgttgatggctgctaattagtactctgattggattgattatctctagcaactgtgggcacacgaccaatacatgcatcttgacaatttaaattaacgcgtgattagcggcggggtttgctgacacggttgagagcatgttgaatagcatactataaaccagctatacacattttttaagcagataaaagatgagagataaaaatagcggactacagatttgtagccagctatagcacggactccaagacacattttatatatgatagatgagatcatatattaattgtgtagtatatatttatagataattattatatgaattagctattaagttaactataaacgatttggaccaaaagttagctatactattaaacttgctctgagagtcatgtggcatgtgctggtcacggtgaatattatgtcgcgcgtacagacaaatattgggaggaatcgggagaaggctttatagctagtgatggcgcatagcggcactgtgcagaactgcagatgcgcagccctgcactgcacacatgtacatccagatcaatatagttgccaaagtaatcgtcaaaaggagtatgcttcatcgtcgctggtgcaacaccgaactaatcattcgtcttccgtcgagtcgcgcttcatcaacatgatttctccgtcaacctatttatcatcaacaacacaacagcatcacggtgctgtgcgcatatttgcatatatagcccggtattatcagagggatcaaatatacgctatagtgctgtgaggtcgcgaaacctgaccgacagaaaagtaaagtagagcacatatgaatatatcatggatacgttgtgaacttgttgtcatggatacgttgtgaacttgttgtcatggatttaagtatcccagcgacagtaaacacatgcacacgtcatctttattaatcgattaacatgagctaaaaataaatacaaggctagtatgaccctcacgagcgttggaccgtctaacttatcaaatatcagagctggatatttatttgtataaatttgggaggagtttgagccttattgacaatagaccaaccatgatttatgcatatttatattcttgttcgtgatacaatatcgatgtgaatatctatttgtataaacttgggaggagtttaaggtggtgtttggattcaaggactaaattttaggacctgtc

SEQ ID NO: 14341 - DNA, 19601 bp, Oryza sativa
tggactaattcgcgagacaaatctattgtgcataattaatccatgattagcccatataatgctacagcaagcatgttctaattatggattaatcaggcttaaaaaatttgtcacgtaaattagctctcatttaatacttctaattaatgtccaaacatccaatatgatagggactaaaatttagtacctgaatccaaacaccacctaagccttattggcgtcagattgttgacagaaaacacgtggcctgggagatctgcttaactccagtgcaggtccaaaactcgccttcggatgtattagcgtgacagttgatttgatcctgtaatcaacaagaaatagaaacaaagaaaccgtagttaaatctataaatgatagccgatcggctagatgccgatgacatatcatttatctttgggccgatgtcatccatgtatcgatcggcagtcataaataagtaaagaagaactaaatctactcgatcggctatagatattaacgatatatactccttatatcgatgtatacttaaatcaagtgattgggatagattggtcatcatgccgagacagtataaatcacttagatcgaaatatatgtcaataataagactatatatgtttatagcatagacgatcagatagatctagcatgtatcggctaatactccgatactactctatatcaagatattaaagcaagtataatatattgagcaaaagcctaacatacttagatacaacaatatcttaacataaagggcagatttaacatgtcaataaggcatatagaacaaatgaagttaaatcagatacgatcggctgaaactccgatgctattctaatcggcaactagaaggcaggctagagatcgatattctaagcacgacttaatagatcaaactcaactgatgcagcattaagtatgaaaagaagaacaatttctagacaatcaagccgctagaagtttcatagaatggtagatatctcatataatctagatcaatatcaaaatctaacctaatcggctgccctctgcatacagatgttagccgatagtagattaggtggcgatattgctagagattatgtaaggtatatgataactcgatgaattatataaataagatgagagtatcataaagatggaagcactaatcctaagaacacaatccgtcataacgaattttacctcttgttgatgatcgaaatcgatgcagctcaacccgaaagcaagaactcgtcgaaactaaagcaaaaagggtggcgatgcgccgagattgtattgaacgtgtgtgttaaaaattacatagggctcggggtctatttatacccgaggattacaagatatgcctataccggacatgaccactatctctaacaaactctaagataccacaagtctttgcggcagacttttgcccacacttatctataagaaatttacataaaatatcctaattaatagatacaattgccttcccaggactccatccatacgtgacaatcatcttgaagtacattaacttgaacccgatgtcgcgtacaagtcatattgtcggaatcggctatatcggcttatttagctcgactcagactcagccgatcccaaccgtagccgatccgggcatcagccgattcctgctttgtttccgaactcgatcttctcttccgactttgcttcgatctaatcttctctccgaggctgatgttaccaaatttggttgttaacacagaccaacaaggctcaaactgaatttattaaaaaaatgcagtttgttgagaatgatgaccgaaattaacttaaagaaatagggactgtctagtattgtcaactaaaaaaatcatttaattttttgaactgattgtacaagattcatgcggaaacacgcaacaaccttaacctcaccctttttttcccttttccttttcccgtgttcacttaggctccgttcataagtcctagttcctaacttcctccgcctcattttccgcgcgtacgtttcccaaactgctaatggtaccttttttttaaaaaaaaatttatacgaaagttgtataaaaaatcatattaattatttttgaaaaaaaaaactaatacgtaattaatcacattctaatgcattgctccgttttcccattccagcgaacacagccggagctagtcctgcgcatccgcatcttggaagaagaaacgagcaaaatacaacacgcaaaagagtgtttccctatgctgacggctcacgtcttctttttcttttttcgaacgactcacattggatggtgcgaagttctattgataaaacaggaaaaaattaaaagattacaatctgtaaggtcgtaaccaggaaaaacaaggcttaaagtcttcaagataagtttttaaaacgagtccaagccgccgggcagactgcgaatttgcaaacccgtcgaatgccagccagtgcacccacaacttgttacttggcttgaatcaaactacacagtggcaagtgctccttccagctatatattaatcacatcataaccttcaatttgccttaagagatatagcagaaaagaaaggaccaaccaacagcggcagcaatggtgttgatccaccatacccatgaccatgagcttctcttgctcgccatcatcatcttcctttcgtgctctaacaatggccatgcctcccggcctcaccttcttcatccaccaccaccaacgtcaccgaccgccttgcgctcatgtcattcaggtcgctcataaggagtgacccaacccaggcactcgcatcctggggcaaccaatccatcccgatgtgccaatggcgtggtgtggcgtgtgggctgagtggacgccgcacaggccgtgtggtggcgctggacctcaccaagctcaaccttgtaggcgccatctcacctttgctcggcaacctcacatacctgaggcggctccatctccacaagaatcgcctccatggcgagataccgtcggagctcggccatctccgagacctgagacacctcaaccgcagctacaactccatccaagggccgatcccagcgacgctttcaacctgcagaggaatggagaacatttggctctacagcaacaagctgcagggccaaataccaagtgagtttggatccctgcaaaatcttcaggcacttgttcttggggaaaatagacttactggaagcatcccttcattcattggaagcctcgcgaatctgaaatttctaatcctagaagaaaacaactttacaggagaaattccatcagacataggcagactggccaatctcactgttctaggactaggttctaatcaactctcaggaccaattcctgcctcaataggaaatctctcggcactacaatttcttagtgtcttctctaataacctggtaggaagcatcccaccgatgcaacgcttgtcctctctcgaattctttgaactagggaagaacaatatcgaaggaagcatcccaacttggctgggaaacctctcatcattacttactgtgaaacttggaggcaatagactagatgggaacatccctgaatcactggggaaactgaagttgcttacatctcttgatctatcaagtaataatctagtgggcccagtacctgatactattggaaacctatattccattaagcagtttcatgtagaaaataatgagctagaaggttctttaccttcttcaatattcaatctttcctctcttgaagaactcaacttacaaaccaacaacctaaatgggaccattccacttgacttaggcaaccgcctgccaaagctccagttattcctaatatctgaaaaccagtttcatggctcaattccaccctccctgtgcaatatttctacgcttagatggatccaaacagtaaacaattctttgtcaggaaccatcccccaatgcataggaatcaaccaaaagagcttatattccgtaacttttgcagtgaatcagtttgaaacgagtaataaatatggttggagcttcatgtctagtttaactaactgcagcaatttgcgactacttgatgtgggtgacaacaagcttacaggtgagctaccaaattcaattggcaatctttccacacgtcttgagtattttgtcaccaactacaacagtatgactggcaaaatacctgaagggctagggaatctggtcagcttgaagttcatcgagatgaacaataacttctacgagggcacaataccagactctcttggcaaactcaagaacctgaatagactatatctcactaacaacaacctttcaggatccattccatcaagtatcggcaaccttcgtatgctaacattattatctgttgcaggcaatgcacttagtggagaaataccccccagtctcagcaattgccctttggaacagttgaaactctcatacaataatcttactgggttgattccaaaagaacttttcgccatctctgtcttgtctacttctttgattttggatcataattttataactgggcctctgccctctgaagtgggtaatctaacaaaccttgcattacttgatttctctagcaatttgatttctggagagatcccgtcctccattggtgagtgccagagtctacaatatctcaatacatctggaaacttactccaagggcaaattccaccatcactagatcaaccaaagggcctcctgttgcttgatctttctcataataatttatccggaagcatccctaagttccttgggaccatgacagggcttgctagtttgaatctttcattcaacaactttgagggtgatgtcccaaaagatggaatctttagcaatgcgactcctgctttaattgagggaaataatggcctatgtaatggaatccctcaactgaagttgccaccctgctctcatcagacaacaaaacacaagaagcaaacatggaaaattgccatggcaatttctatatgcagcacagttctatttatggcagtagtagccacatctttcgtgttccacaaacgggccaagaagacaaatgcaaaccgacaaacatcacttattaaagagcagcatatgagagtttcttacactgaattggctgaagcaacaaaaggttttacttctgagaacctcattggagcagggagcttcggctctgtgtacaagggaagaatgaaaatcaatgaccaacaagtagctgttgctgtgaaagtgttcaacctcaagcagcgtggttcatctaagagttttgcagcagaatgtgagactttaagatgtgttcgacatcggaaccttgtaaaggtactgaccgtatgctcaagtatcgattttcagggccgtgatttcaaggccattgtatacaagttcctaccgaatagaaatttagatcaatggctacaccaaaatatcatggaagatggtgaacacaaggcattagatctcatcacgcgactagaaatcgcaattgatgtggcatcctcacttgaatatcttcaccaatataaggcatcgccaatcattcactgtgatcttaagccaagcaatgttctcctcgacgatgagatggttgcacatgttggtgattttggccttgcaagatttcttcaccaggacccagagcaatcaagtggttgggcatcaatgagaggcacaactggttatgctgctccaggtaagctcctaattgttgtagcttttttttatcatatttcatattatatgtatcctactatgctggattcagccaaaatggagtaagacttattggtacttcattttactacatagacaagttttgatgaaactcttatttccctaggaatttgaaaggggaaaaatgaacaagtatatggtagcaaaatgttgtatcctgtaaatggatttcgcacaaacataaataggcttgtggagttattttctcataagccatttcttatttttagagtatggactgggcaacgaagtctcaatccatggcgatgtatatagctatggtatattgttgctggagatgtttagcgggaagagaccaacagacagcgaatttggagaatcccttggcctccataattatgtcaatatggcattgccagacaggacggctagtgtcatagaccttagcttactagaagagacagtggatggcgaagcaaagacatcaaaatctaaccagacaagagaaatgagaattgcttgcattacctcaattctgcatgttggagtttcctgttcagtggagacaccaacagatcgcatgccaatcggagatgccctgaaagagctgcagagaataagagacaagttccacagggagttgcaaggagcaggagcgacaaaccatcaagacattcaaatctgttgatgcgcagcaaccaaccggatcaataaaggcgtaaagagctgcaagatttctgctactccttgccatctaggctagccaaaataaaatcataatgttgcaaattacaaagtttggcattctgtttgatccttgccatgaagatcttgtacatactatgaaccaaccacatcttggcaaatcacattattatatgcttttcctttgttgatatttcttcctcacaaaaccatatatgcctttctattccccttttgtaagtgacacagtaaacctagtcgcagtgaatctctaaaaaaaaaaaaacactatacgcttgcatcttagtttaactacccgcaggattccatccatccaggtgagttccccttcctttgtttccattaggtaatcacagaatcacagtagatcactacatatatatgaacgaaagtggggaagagggcgttccttcacctccggggtagcgaacgcgtcacgctagaaggagaagaggcgtgtcgcgggcgcgggccgggagctccgctgccggcgccggggttgcggcttcacggcgagcttcgcctggatgcggggccagtggcgctcgccgccgacggcgtcggatctccggtgggccgtggggcgccgcgtggcggagagagaaatgggagtgagggagagaacccaccgaagcaaaaggggagagtagatttgggctttgggctttgcttaatgggctattccccctaaggccgacacgcatgtggatccatgaattttggagggtttttggaaaaagtacaccgaaggtccctcaacttgtcatcgaattacaaaatcgtactccaaccacaaaaccagatacaatacaggagatccttaacccttaacttacaaaaccatttacttcagttccttcggtggttttaacttaggtggcggctgagtcagcgtgggacccacgtgggccccacatgtcagtgtgtacagtcagcacctctctccttccactgttttctcaccctcctctctctcactcgggcagggcagcggcaggtggggaggaggccggcgggtcggcggggcgaggcaggagaggaggtgcggcagctggcggcggcagcgggagcatggggaggcccagctgcccgtctgccccgacgccgccgcggcgcgccgtcgtggttgcgggagaggctgtcgacgatgaggaagagctgggcagcgacggtggggaggtgggcgtgggcggttgccggcggaggaagagatgggcggcggcgacagtgggcgaggagctgggccgtagaggcgatgtgtccggcctgtactttgatcgtctcaggggcagtactatcacaatttcaagttcacctgtctcttttgttcttgagagaagttcagttgtttccaacgaaagtcaacgctttgctcctctctcaaggcctcgatacaggattttttgtttgaaaaggaggattttcggtattgattccaagtcaatggtactagttttgctcaagtaaacaaaagcacaaaacacacatacatgtcgagttctaacatgttgctagtggatgaaaaacgcctcagcttttacagttagtgtcatgaagatctgctagatttttttcttatgtcctgatgcacttgtttcctgtcaaatttctatgaaaatcacgcagaattcatacgattttagacagccccaacattacacacacaaacacaaatgcatataccatgctcaatgtcctgcttgaatctcttgtattcctacaaaacaatacacatccaatttctctttacaatttacaaatcactttactgatcattctgaaagatgatcagttgagaaatttgaggtagtccttgaggtccgtggggaagcaagggtactactgcctccagaacgcgccgtgcgctcgcagcatcttcaccgccttgtccttggtcgacggcgagctctccacctgcatcagcgccagcagcttcgccacggcgccgcccaccaccatgtcctccagcaccctctcggcgggggtgggggcgcacgccaccagccacagcacgttgacggccagcctcgtggcgagcccggacacccggagcacggcgcgcgccacggcggccaccgccagcccgtgctaggcgaaggccagccgcccctcggggcacttacacaggcgcttcaggaggaggagcgaccgctcggcgacgtggcggttggcgtcgaggaggagcacgtcgtcttgccgtacctgaagaaccaccgctccatgctgcggcggtcgtaggtgacgccggtggccaccgtgacggggtcctccattagctccatcgagatggggcactggaacaggggaggaggctccatggccgtcgtcctggtcgcccggcggccgccgccctcctcctcccaccaccgcgctcgcctccggccccgtgccgttcctcgtcgtcgacagcctctcccgcaaccacgacggcgcgccgcggcggcatcggggcagacggggcagctgggcctccccatgatcccgccgccgccgccgccgccggctgccgcacctcctctcctgcctcgccccgccggcccgccggcctcctccccacctgccgccgccctgcctcgagtgagagagaggagggcaggaggcgagaaaacaggggaaggagagaggtgatggcgtggacagtccgacaggtgggccccacgtgggtcccacgctgactcagccgccacatcagagaaaactgggttcaaaaccattaaaggacataaaataaacggttttgtaagttgagggatgtcgtatatctggttttacggttggaggacgattttgtatttcgatgacaagttgagggacctttggtgtactttttccgagggtttttcatgattggttttagtggattttatcattctttgggctccttgcaatgaaagaaaaatcaaggaattttaaaagatttgaatcatacaatgaaattttctatgagactcttttgggataaaatattgggtctctaaaatttatactccttataaaagggagtaatggcccaccaccaactttcaactttctttaagagaaaaagggacatagtctcacttgttaactactcataccaactctctattttttctgggaatgaaaaatgaaagttttacagagctcgccaacctttatcgccgctactgcctcccacgacaggctcactaggtatgccgcccacctcgagcccactcgtcacttttatcgccgctactgcctcccacgacaggctcactaggtatgccgcccacctcgagcccactcgtcactgacctcccactgccattgctgtctctcacagatgggcctgccgatcgtcaaccttctccctgctggcaagttgttggggaagagaagagaggtgaaagtttacttacatgtggcatccataattttttttctgattagaatgccatgtcagttaaaacaaacatccatactgttttagaagtaacttgaacagtttttgttaagaggaggggtgaaaaattccggttatatggttagggatatcacataaactcgtcgtaaagataaaggacagaaagtggacttattccacctctgtgcactgaccgttgaaggtttgaagaagcccaagagagcccaaagcaaggcccgtttcttcttctgcggcgcccggcgctcggcgctcggatcaatcccgccgacgagcgcctccggccgccgcctcccttcccccgccgcgggaagctcatggcccttccagcgcagccgctcccgtgtcctgaacgaccaaccgccgccgccgcccggccatcgcgtcatcttcatccaccctcgaggcgacctccccggaggtaaaccgctcccccccccccctcctaatgcctgcacgattactaccgattccttctacataactagcaaagtgatccgtaggaacatttcttgcaaaatggttgtagattcagttctaggtcgtcaactcgtccgccttggagaagggaatagatctcatagatcgaatggggtttctactttcttctgaacaattttttttttcgaacaaatgccctagtattcaattttttttagccgcacagcacttacaaatttgcaatcatgtataatatagagcctctctgtaattgatgctagctttacataaacaaaaagctgcagaatccgcagcttccggcaccttatttgtgtgttcaatgacatggagcataatatcatgccatgcgcaaaaatgatcttggaatgcttcattgtcttcattggcttgatgttccttcattggacacatgtttctcaaacttgtctcttattgcttgcaactccttcagagcgtctccgatttgcacgcggtccgttggtgcctcctctgagcaggagattccaatgcgcataaccgaagtgacacaagtaattcttagatccttgccgttgtaagagtttgacttgattgctccgccatcttctgtctctggtagtaactgttgatccagaacattagccgcattgtctggcaatgccatttggacatacttgcgaagcccaaccgcttccccgaattcatcgtctgtgggtctttttctggtgaacatctctagcaacagtatgccatagctatagacatcaccttgaattgagacttcattgccaattccatactctgaaaccaacaaaaggaactgtgaagaagaagaaaaaaatgggtacatttccccattctacataaaagggacttctgtcgaaatatactcatataattaagtgagtcagataacaagaaatcctactttagaaagcagatttcttgagttatatacacagaagagaatacagaattatagcaattagagacttagaggtgcacctggtgcagcataaccgactgttcctctcattgatgcccaaccacttgatttctccgactcctgatgcagaaaccttgcaagcccgaaatcgctaacatgagcaaccatgtcactgtcgaggagaacattgcttggcttaagatcacagtgaatgattggcgatggcttatattggtgaagatattcaagtgaagatgccacatcgattgcaatgcgtagtcttgcagtgagatctaatgccttgtgttcactttgtcccatgatattagggtgtagccattggtctaaatttccatttggtaggtactcatatacaatggccttgaactcattgccctgaaaatcaatactcgagcatacagtcaatatcttcacaaggttccggtgtcgaacacatctcagtgtctcacattctgccatgaaactttgagatgcaccacgttgtgtgaggttgagcaccttcacagcaactacttgttggtcattgtttgtcattcttcccttatagaccgagccaaagcttcctgctcctatgaggttatcagaggcaaaaccatttgttgcattgactaattcagcataagaaaccctcgtatattgctcactaatgagtgatatttgtgggtttggttttgccttcttgttcctatagtagaatgcaaacagcataaatattaatgtgattaatggcattattctgcatatggagattatgatgataagtttcctggatgccttcttggtggtttggttgaagcagggtggcaatttcatctctgggataccgccacacaggtcatcatttccagcgaggaaggtagctgttgcatttagaaaaacgccatctctgggaacttcaccttcaaatttgttgtatgagaggttcaaaatagatagacctctcatgcccccaagaaatgcagggatgcctccagataaattattgtcagaaaggtcaagcaccaggaggccctttagttgcccaagcgacgatggaattatcccttggagggaatttccagatatattgagctgctgcaagctcttacattcaccaatagatgtaggaatctctccagaaatgttgtttgaagaaaaatcaaactctccaagattttttagattacccatttcagctggtaaagcccccgataaaaattatgtcccaaaaacatgttactggacaaagtagaaatgagaaaaagttgtttaggtatcaagccagtgaggctgttatatgaaagatccaatagttctagaggacaactgctaagattggaaggaatggacccattgagtgcatttccttggagttgtagtagatttagtcctgtaagattgccaagagttggtggaatggatccagacaggttattatatggtatagataatttattcagcatcttgagtttgccaagagaagctggaataattccctctaaacggttaatatccatatagagcaattttaagttgatcaagttccctattccttcaggtatttttccttctatattgttgttcgctatgataagatagctcaaatgcgaagaaagattcccaattgaactcggtagctcaccttgaagcttgttgtaacccaaatctaatgcattcaaattgctgcaattcgccaagctggataagaaaacccaatcagcatcatttgttgcttcaagctgattttttgaaagggccacaactgataagctcttctgttgaattccaagacactgaggaattcttcctgacaaaaagttgtatactgtttgcagaacttgaagcatggtggcattacacaaggatggtgggattgttccatgaaattgattgatgtctacaacaaacctttgtagattcggaagcttattgccaatatcaggtggaagagccccgctgaggcgattgctttgtaaaccaagatcatcaagggaggaaaggttgagcagtgaaggaggaaacgaaccttctagtttattataatccagacgaaggctactcaaggcaccaaggtttccaagagaatctggtatggagcctgaaataagattattttgtgaaagatcaaggctagtaagcatctgaagtctacctaatgattcagggatgtgtcctgagagccgattttgctggagactaacaaacactagagatgagaggttccccaaccatgcaggcacagttccttcgagattgttctctcccaattcaaggacaagaagtgatgaaaggttttgcagcgatggtatgctccctgtcaactttgcagaagggatgctaaggtacttgagtgctgaaaggtttccaagtgaggcaggaatggagcctgccagctgattagaaccaagacctagtccaacaaggccagcaagatcacctatctcctctgggattcccccagtgaggttgctgaattgcaggttcagagtcatgaggtttgcaaggtttccaatctctgatgggatgcttccggtgagggtgttcatgccaaggctgagtaccctgaggccgcgcaacgagcagagctccggcggtatctcgccgtggaacctgttgttgtacagagcgaggatctcgaggccggtgcagttggcgagcgacgccgggatctgcccctggaaggcgttgtcactgaggttgaggtgtctgagctcagcgaggccgccgagctccggcgggaggacgccgtgcagccggttgccggcgaggtggagccgcctcaggtatgtgaggttgccgaggtccggtggcaccgtgccacggaggccaagccccggcagctccagcgccacgacgcggccgcggcgccggcctctcgcgccgcacgccacgccgcgccaccggcacacggggacggaccggttcccccacgtcggcggcggcggcgagccactgcccgtcgacatgcgcgccatgaacgccgtcagcgcgaggccgtcgtcgacgtcgaccgccgccgcggcggcggctgctgctagccacgccagtggccataccgcggcgagcaagagacgcttgccggcgagtgccattggtgtcactgtcacgtaagaacggtgtgcaaactgcatggaaattgctatactgatgcgagagttgatcatatctgtgcatataaagcctttttatatgattataggtacccattttatatcggtttctgtttctgtttatattagtatgattttcaaattgctaaatgataaagtctgcgcaaaattctctatagaaattattttacaatattctattttttaagtttgtaataattaaagttcaattaattatgtgttaatggttttgttgttttttttggctaatttcatcttcattttcgatgcatagacagttgctttcaatccaattccagtagtccattcttgtggaaatacatcactgaatttgtccacggtccacatttttggtttctggttatttctgccgcattgccagtttgttatggagttgctacttgctagtcttctgcagagaccatggaccagcttgattgattaaccagcgattgcgaggtaatttactaccatgctgaatcgctggacatacgaaaaaaaatcaagggctacaattatctgaacatgcaaagggaaattcaatgagtcagctctattttttttttttgaaggaagatgagtcagctctataggaaagcaaagcaatggctttcagggttgttgtctgatagtgggataactactggagcttatcctgttgatgcttattgaccagcgcaccaaggttgaccaattgtgctgcaacttgctgatgggcaaagcagcagcggcgcgagataactgaacatttcggcatttttgttgctgttaaatgtcgagagcattatttgtccattgtacgtgttggtgtaggcgagaaggcccccattcttatgtaaaaaggaaaccattatttttcaagtgatctgtctcaaaataatttgattctcaattcatcttagagagaatgaactaagtatagagaacatattttcctttggagcgcacgattatcaaaatacaggcataggaaaaatgcatgagtaaaatgtcatcgcactttaaatcctaaatcctaagtaaataaaacacagaaaaccatttggatggagcacacgaaaaatacacgattttgacaaagagaaaaattccaagaacttggagctcatattaggaatccttcaaaattccaataaaacatttcattccaaaggaatttttttttaaaaaaaactagcatactgcccgtgtatttgcaacgtgattttagttaaagaaaattattattaacatattgtcactatcccttaattgttatacatatttgttactaacatattattgatcatttgaccccccccccactatatctttttgaggcaattgcttattttaaccctgttacgaagtctaactactaattcgaccttatttttttaggtttgcttatttgacctcgtttttcaaaattgaagatgaagactgaccctattttgtgtaggcaagataacggtgttaactgagtgatgatttgtccttttaaccctggctcatttgactctattatatgaaagcatcttgtgtttggacattcttaacatatttataacgaatttgatatagccttgatagatttgtgacaattttgacagatttggtctcaatttattaaatttagtttcagtttgacaattttgactttaatttttttttaaaaaatgacaaaacggttgatatacaaaattatttctcctattttgtccatcccaaattagatacaataataaagcaaaagctcagcagcagtcaaagagattgaactcgatcacagctagggtcaacgtttcgagattgaactcaagaatgtgatgcccagacacagatagcaaccagtagagggcgttggcaacaagtatggcaggtgaaccaaaatggtagatggtggatacaggccctgtgaagatggcatcgccccattcgccggtcgccgatgagtaaacggataccaagatgaggtggggattgggatgggatagggttgattagtattgagggtattttggtcacttcagggttgtaaatttattattttcttttttctaaatgaagtactaacagtggattgaaaacagggtcaaacggaaactttcattttgaaaaacaaggttaaataaacaaacctaaaaaaaaggtcaaattggtatttaggctttaaaacagggtcaaataagcaattatctctacacataaactatcttaaaacttatttccaaatctgtctcgagcttctcgccaaaggttggcgcggccgcaaagatgacagtggcggggcttctcgccaaccggctcgagcagccaggggagtcaccctgggtggtggtggcagcaaccaccagatccataccgcctcggccggatctggcggggtggcggccggcagcgaggaaggcatcgtcaacagcggtggggatggcgacgacgacggcaatgtctcggcggcaagaggcggcggggatggcgacagcgatggggatggtggcagtggcggagaccgtagatccggcggcagggcgcttggatttggcacccccacgccggatccgaccggtggcggcacgagcgtgccggcgcaacctggcaagaggatggcgcagccgtgggtgacggtggcgacgggccggcgcgacgcggcaacgcggccagggagactcgtggcgatggccgcgacagtcggcagccgacgggaggagcggcgcggcccggctggccggccggcgccggcggaggcagtgcgcacacggaggcggcggcgcggcccgagagactcgcggtgacagtgggcagccagcggaaggaggagcggcagatggctggcctactggtggcggtagaggtagcacgcgtggaggtagcgcgcgtggtggcgcagctggcgacggcggaggtcggtgaggtgcggccagtggtggccgcggtgcgtggaggtgaggccgaggtgctggtgcagcacaacgaggcttgttggtgtggagacggtggtcggcgcaacgagtggaggccagctcggtgagacgtgaccagtggcagcgcgtggagactggctggcggggggcactggtgcagtggtgcccacgcgccggcggaggttcagatggcggtggagcaatggtgcatcagtggtagatcggcaggcggtggacgtcgggtgaaaacccagggcgacgatgatgttcgagcgtcattcccatcttgagggcgttgtcgtgttgttccacccctcaagtgtggttgccgagcgaaagcgtagtctcggttctctttgagaccttgatggacggcagcggcggcggtgttttcgtcgcttctttccttggagatgtcgtctaggcaccctcttgccgaaacccccaaagcaattggtgcaagcctggtctagattcatatcctcttgtgtcggcgtcctagcttctgcaagttggccacgttggaggtcctaggggagagaggtgttccattcttctctctgaccctctccctaaatcccaacgacttggatagagtggggttttgcactggttgtaagggtcgggttttgggcgatctcaactgtgttccattgttggcctagcggtggtcggtcacgctaagcggcggccagtcggatgctagccttctcctaggtctgtgattggcgctgtcggtgtgcggatggtggtatacttttttcgttttccttattacaaccttacagagttgtaatcttatatttttttctgctttatcaatagaacttcacgctgtctatcgttaaactttttttccaaatctgcctgcagctattggtgcgacagtgttgtttcagcctgcgagactgggtgacgtgtcacgtgtccaaaagattcaaatttagaaatgacttttggatttatttttaaaatttaaagtttgtaaattcgctggtggtgttcaaaagcagggacgatatgcataatgcatgatgtgtgttgggggtgggggagggggtgatctccctcttctttgtcggagaaagcttacccgagaaagaggagggctcatcggagagacaggagagagctcgcaagaaagccatcgtcgcttgcggtgaagaagacgaagagaggtggagagagagcgccgctagtctagacctgtgggagcagctgggaacgctactccaagggacaaattgtttttatttatttttgaacattttattttttaaaacttttaacaacatttattttcaaatctacactttttttttgtcacattagacatgataaaacaagactattacatcactctgactgatatgataacgttattttgctacgccactctagatgacgtaacagtgctgttttactaaaataagataaaatatcacgtcaactattggtgacgtgacaatattatttcgtcatatcagatgggatggcgtagtaaaaaaaagattcaaattcacaaataagtattgagataatctattattaaaatccaaaaattaaaaagttaaaaaagtaataaaaattcccggtagaccccccttgcttcccaccgtttctgctcttcaggcagctagctaagttcgtcccagttttgttcctactgaattttggagtagaacaaatctgcacgaatttttttttacactcgtcagtcgtcacacaatagaatggaacttaattatccgatcttaaactgatcgatactacttttttttccctctgaaagtgaccaatgcaataattaattaccaaaaggtgattagcacataatatagacgatcgatggacgcctgatcttcaatcgttatcgtgcgggctacctgcataaaataccttacacattggctgtttatctgatcaaatattcaaccacactagagaccttatctgtgagcaattcgagggcctgataattgtcaaagctttacagagtcaaaaagttcaggcgccaattttcctcgtggcgcgtagtgcctagcaacaaccaggctagcatgcgttcctccatgtcagccaaattatcagagcaaatttgataggattactattagcttcaaatcatatattcatatatagctaatctaatagctaattgatacaatagttaactataaatatatattacaccattaatacatgattctacctcttatacacataatatatattacacatcgttttccttctctctcctctcttacctcctttacacgtgttcatagctggcttatagcctgttattatatttcggcaactttgcaaaccattgaccgctagtctcaacagaatctgcaggaacaaatcgacaatctcttcgtcaggttga

SEQ ID NO: 14342 - DNA, 1036 bp, Oryza sativa
gtgcttcttgctcgccgtcgccgtcgtcctcgtcgctcatgcgacggcgccggcgccggcggcgtcgtctcggctgcctctgcctcctcctcctgctgctgctgctggtgatgtctccggctccgactccgaccgccgcgcgctcatggcgttcaagaagctcgtgagcggcgacccgtcgcaagccctggagtcatggggcgacggatcgacaccactgtgccggtggcacggcgtgtcgtgcggcgtcgcggcggggcgccgccgcggccgcgtcgtggcgctggacctcgccggggccggcatcgccggcgaggtgagcccggcgctcggcaacctcacccacctgaggcggctccacctcccggagaaccgcctccacggcgcgctgccgtggcagctcggccgcctcggcgagctccggcatctcaacctcagccacaactccatcgccggccgcatcccgccgccgctgatctccggctgccggcgcctcaagaacgtcctcctccacggcaacaggctgcacggcgagctccccggcgagctcctctcctcgctgcgccgcctcgaggtactcgatcttggcaagaacacactgacaggaagcatccctcccgacattggcaaccttgtaagtctcaaacagctcgtcctagaattcaacaacctgacaggacagatcccatcacagataggcaaacttggcaacctcaccatgctaagcctcagctcaaatcagctgtcaggctccatccctgaatcgatcggaaacctctcggcattgaccgccattgccgccttttcgaacaacttgacagggagaattccgccattggagaggttgtcatctcttagttaccttggtttggcaagcaacaaccttggaggcaccattccttcttggttagggaacctctcgtcactgacagctctggatcttcagagcaatggctttgttgaatgcatccctgaatctttaggtgaccttcagtttcttgaggcaatttcactggcagataataagcttgagtat

SEQ ID NO: 14343 - DNA, 453 bp, Oryza sativa
ctgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgacttcacatgacatatatcttatatacagaaaattctaaagactctaaa

SEQ ID NO: 14344 - DNA, 14847 bp, Oryza sativa
ccctttttacttaattagaaaagatatataaagacattcttttgtaaccgaaagagtaattgctcaataaccagcacaagaaactagcactgtacctgaatcattggagcacactaagagggtgtttagatacatggtaaagttttagtgtgtcacatcggatattatatagggtgtcgcattggatgttcgggcactaacaaaaaaaaactaattacataatccttcagtaaaccgtaagatgaatttattaagcctaattaatctgtcattagcaaatgtttattatagcaccacattgtcaaatcatatgaagcaattaggctcaaaagattcgtctcgcaaattagttataatatgtgcaagtagttatttttttactatatttaatatttcatgtaggtgttcagacgtttaatgtgatatggtgtaaatttttgtgtgggatctaaatagggcctaactgaaccatcctctcaaaatgtgtactcaaatatatcgatgaaagtgactattatttgctaggattttgtggtgatgagtccttttttagttgtttttgtcagcataattgattaattaattgagtatcgaattgatcaatcagaggctatggcccccatcaccttttgcttattttggtttaacaatgtccaacttgtgtcatggccttatgagttggctgaatttggcgaattgcatcatgtccatgagatcacaacgcattatgtatgcaaacatatatgtacaaaacctctttagtttgatagcaacgttgagttgcagacacattggagttgagtcagtccatggcagctggagtgttactagtggcgcgcacacacacactgacattggtgaatttagtggccaccattagtggactgatcatgtaagtaactaagcacttttaatcgatagttgtatagcattatatcacttcatctttagctttgatgtaattaaatatagtggagtctgtggtaatttgtgatgtggtagcaggttaactgaactcttgacctcagctcgataactttttaactttttttttttgcttattgtcattactcacagtcactggatttatccatccaacatggacatgcatgctatctccaatcataatgtcaatttataggccattgttgcctcttttttagtctttatattactagacttcagagcaagcttgtgaaccgtaatattaacaaagttaagttgaagtgctatatactcccttaaaaatttgagcgtattgaaaccaaaggattattaaacaatcctttgacttcttttacattatagtgacatctccattaaaaacaagaaatggtggtgcgtttatatgatgagaaaaacaattcaaagcatggcaccgtgctactgcatgctatagtaggtcagcacattaaacgactacaaattgagttgaaatatcacaaaattttagttcagttgtaaacatcaaagacaaattaggagatacttttagagatgatacccctgcaactgtttcaagcaagcgacaactgtcagcagctctgatgaatgtggcacaggcgactgaatgttcagttccaacctgatcttgaaaaattcagaaagaagccaaatgttctactgaaaaaaagataacattgcaaagtttggtcagagtagaaattccgtcacagaaaaaagatggtcgtcagagtaatctcggataggcagaggcatctctttcttaattaataattaatgacaaaagagccaaatctttcatgaaaatccgggcgacagctgacaaaattatatctatctgaaggagaagccttggaaaattgaatggattaagacttcgaattattaaagattgcatcaaacacaactactggaagatcaattcatgcatgatggcacactgaaaaagattactttcatacttaaaaaaaatcttgaattatgggactagctaattaactaagaagaacagttcagagcgaccgttcttccacacgtctgcatcatctaatatcaaaggctggactggtcctgttgctcttattacagctgacagtgatggaaggtagaagaaacgtcatgaacttatccaagagatagatagatagaaatggtgatggatcaagagatgatcacaaaaccgaaaaaaaaaaggcgaagaaatatgaatcctagcttggagatggatcagggaccatcaggtagaatatatctgctgtgatgtccaaatccagatatcagaacgaaaaagattgtcaggttccgttcttttctctaacaagagttggatgaagataaagattttcgtggcacgcttttcaaacagctaaacggtacgtttcgtgtgaaaactttctatatgaaagttgctctaaaatatcatattaatatattttttaagtttgtaataattaaaactcaatcaatcatacgttaataccacctcgttttgtataaaaaaaaacttaatcttcatcttcaggagaaaagaaaaccaaataagataaggtttcttctcgtacgatttaaatttcactgagattttgacagccagaagccccattggtcagaaaaagatttgaagccatgtgtgacaataacacaatctttttgggtgaagggagaacaaaaatctgaaaaagagaacagtgagttggaaatttggagagtatgacaccatgtcacaccctcttaaccactctagagtcttcatcgataaacacaagcaatggtagggcaaaaaggagatcacaatgatggaaaagaaaaacctggattcagaatcttgtaagcctcaaacatcatatttgaatactcagggacgattacatattcctcgcagaaaaaaaagggacgattacatattagaaatagactactattacaagaaaatttactgcataacacttaaaatggacacctaaaaacccggtaatttgatgaagtacatcatcgtcattattttattatttatgcgccatataaagagaaacaattagaaaggacaagtttatccctcggaccaacaacttctaacctaactgggtttaacttggaccagacccaagccactttccctccctagatcccctatttagaaccctagaaattggagatgcccacggcaagcagcgacagaagcagcgatgagaggtgtgaagcaaagtatgtctgaacccgctacttgctaaggtttttgagagagagggtgagcatgttaggagagagcagatcaatacccatagctcgtcgccgccgtcgtggatgccattgccactatctccaatttctatggttttgtagattggattaggaggggggtggcttagttggtatcgctagggttttggagaggggggattgtcatcggcatagaatgtagctcgggtctggttgggattcatgacgctggcccaaaaaccatttccgttcaagtgtactatagcaaattttgtcctatacaagggactttcttactactctctttcttcagaaagcaaagattagttttatcagaggactaaccaaatctgaaatcacaatttgaggtggatacggaaccaaccattgagccttggccttggttcgatgctcatgatcaggccgataagtgtgggccaacgtgccgggccaacatatcagcccatcgtagcccactctgatgttctttaccgtttcggacttaacactactaacattttttccattacatggcaaacacacacacatctctatctcttctcttctctactattaaaagtttaaagtgtttttgcttgaaaattttgtacgtcgtccgatttgtttctgttgtcgtatcggtttagttcggcacgattcagtcgccgttcgctcgctcggactgacaatgaagattgaatctagctatgtaaagaaaatgattattttcttgctttatgtgtgcaaatttaattgggctacagaaagctggccgaactgacatatatgggttgtatacttgaggggaaggaataagtctattctacctatctcctgttttgtctatgatcaaatggcatatctcaacccaaaaccaggtataatgcttctctcaacttaaaaaatcggtgcaaattagctcagctccattaatggtttagacaatggtctatgctaagtcagtaaaaaaacttttaaaaataatagtgggacttatatctcattccttctctatctgacacatatgtgtttgcatcataatttggcatttagttagtatatttgggcaggccaaattatttagaataggttgctggaattatcatgtggtctgcttgagagtacttcgaagttcgaagtatatatgtgcaggaacttatcatgcattgctcggctgatctgtgtaagatgctggggagcggcagccgtttagttggcttgggctggtcacatgcatgcagcagtagcataggagagtgagatttggcgactgagatcaatgtttgcatggtgattttactggcagctggctgcattagtttgcgaggcggttgttttgcagggtacacaaatgcaaatggagttgtgcacaggagggtgatcaagccggtgctggaatttgtgcagatggatgcgtggcggcgtggctcgtgttacactggaggtgctcggtttgatccacgcggggccgtgccgcaggtgacaggcgttggaggactaccgaggcgagtaaatttgcctacgataagaccgtcagcgaacgagatcaaatgcagttgctactaggactgcacattaactgctgtacacaatctgaaccatctatgtctgaatctaacggccaaaaaagattcggcacagtaaaatcagaatagtaaatcgctacagtatttgctacagtatttatccaccgatagatctgcctcaattagagccgtgccaagacgtccatacttggtgtgaaatgatatccaataaaaaagatgtctctaagaaagacttgtgtaccctaattcttcttctggttgtttgtgagatctaaaaggagagaaatcagcgtgtctcagaacataaggagactgtagaccctaaaccgttggccaaaataaaggaataagcaagaacttgggttctggctaaagaaaaaaaaacttagagagtttctttcttcacacgtatagttatgtatagcatttttttttctatttccctattggggtcgtacttttctctcgctatatttaatgaaatagcaccatcttatactgattcgattaaagaaagtttcgctaactttcagagggacatagatccttaatagatagcgttaccaaataaagcagaataagttctctaatttttagagggacatgaatctttaacagataggagtcactctcgtagactcatgtcagggacacccatcagttagaggagcctctcgcaaatcaagctgcaatatacgcaaatggctggcaatggatcatatacccccttctgaactttgaacatttgataaatgaattttctagcattttgaaatccgaatcgatttattattgccgacaaggcacacacgagagaggagcacgcggcggctgatcagccgtcgaggcgggcgccgccgccgccgtcggtgtcaacgaagagcttgacggcgtgcatgaggtcgccggaggcggcggaccaggggtcgatggtgaagaagccatgctgctgcccctcgaactccagcgcctccacgggcttccccatcgccgccagcctcgccgcgtagtccagcgcgcggtcgcggaggaggtcgcgcccgccgaccaccaccagcgtcggcgcgaactccgccgcggcgaggtcggggctcgccggcccgaacgggttggagaacgggtggtccgccgtggcgccgcccgccggcagggagagccgccagtagcggtcgttgaggtcgcggttgaggaacgcgtcgtcggggcacgccgcctccgacggcgtccgctccacgccgccgaagaacggcatgagctggacgtagccggcgacgcgcgcgggcgccagctcggcgcgcccggaggcggagccgaaccgcacggcgaggtggtgcgcgatggtgccgccggccgagtcgccggagacgaacacccgcccgaagtcggccgcctcggcgacccacgtgtcgccgccggggcgcgcctgcgaggcgagccagaggagcgcgttctcggcgtcctcgaacgccgcggggaggcggtgctcgggagcgaggcggtagtcgggcgcgacgacgacggcgcccagctcggccgccaaccggaggcagtagttctggcagttgggccaggtgcgcgacccgatgcagaacccgccgccgtggtagtagaagaacaccggcagccgcccgccgccgcgctcccgcggccggtacaggcggacgccgagcccgcgcgccgcgtcgaacaccgcgtccttccactccacgctcccgtcgtcccgcaccggcgtcgcgaacccgggcgcggccctgcgctccacggcgccgtcgctgtacacgaacagcacaccgcggcactcgtcgaccaccacgcgctccgccgccatggcgatggatggatggatcgaagcgggaggagatcgacagtgaggtggaggtggaggtggaagcgtgacgtgtggtgatataggcgcgtggagtggtggaggtggttgcggtatgagatgagacgagacgagacgagacgagaaaggcgtggtgccgtctcggccggcacaagggtacaaaaaccgttccaggagttctttcgttgcatgtacggtcggtctgtctggcacctgttgttgatagtcaaatttggcatatatgataataaaagtttatatggtatgattcggctgttaatcaagcaaatagcggtaggagaaaattagttagtattgacctggatagagagctaattatatttgtcattaattaaattagatgaagcaatttagccgaagctaaccaatattgaagatatatattagggattatctggtagcagtgaaggttaaaagggcgaggtatgatgcgaagtaggcacagaagatctcggtgcacactatattcagaatgcagcaggcaagaaaagcttccaacagaaatccgctggattgcctaccgtcattagataattgtgtttcctaccttcaatcggttaaaataatgacgcttaatttactcccagtaaacgtggaacatgccaaagaccaggcgccctacatatggttaaggccgattggagagattcccctctccaacccaatcaataaattcattatagttcttttttacgttcttcttttttgctttttcttcttagaagtagatcaattcaattttctttgccgattagcttgaaaatcggtcgctcattgccgcgaaagcgtaatggttatcttgttatcaaaatttgttcttgacgaaccgcgtgttggcgattttcgacgccaacatctgttttttttctaacgaattaccgacgcttagagtgtaccaatttcattaaacatagtagaagtaaaaggtgtgtataagtatgaaaaaaactgtataagaaaaaccaaagctaaagatgaattctgggagtcgtttcccttctgctagggtattggttttgacctccttcatgatttttcaccactatgtctggcagactggcacatgtgatgcttaccaaatcggcgttctgcactgcatggctgtgtgcctgtgtgtaattcatgatttaccgcttgtcatttgggggttggggctgacccataaaattaccagagctagacaaatttactgatgtggaaagaaggaagtgaggagagagaaatatgtaataagtggcccgtaaaactgacagctaaacaaatttactggtgtggggaggagagcgagaagacagaaacatgaaaggagagtgattttactacgggtaggggaaagagaggaaggataatataagaaaaacaatttagttaattaccaatgtttacagtttttttttttgcgtctcagctgatatatggaatggtctctatatgacatgcatatgatattaatgagttctaaatatctctaactgaatggttcaaataatattatagcatcaacaggtgatttctacaaaactttcaaatgaaaacggtatgctgctaaagcagtcaataaagatcccctaccattcgattccatttccagacaattcgaaaacaaaacaaaaggtgggtataaaaggaaaacgatagccggacagaaaaatccataacattttttaccctactccaagtaactcacgcaacactcactggtctagtatatcatagacacatgagtgacaaatcatattatcagctctaacgtggcaaatcttcaattcaccaaacatctactactacgttgtttagctccaaatatttgaaatagcttagaattttctatcaccaagcctatcatagaatcactcatatttcatatagcaactggaacgaagttttgctcatttattcccggtatatgaatggctcagagtaacagttctagcgttcacgtttatttttgcattcaactcgtgtataacagtcctgagtcttcgccgttcaatgcgcattcagtggtaacgccacgacttgccttgctggactgggagttgagtggaagtcactgaaccagccagtgagtcagccagcaacttgggaacgtctgtatcatcaaatgcagacttgaggtggaatcagtttccctggattcatgatattgttgggatccaacgcagcctttattcttttcatcgtccttagcgactcgatgcccagctctttctctaggtactgccaaaatgcatagaaaaaataaaagtcagtaatgggggtgatgacagccatgagcaagacaataggaggtcctatcaggaaattcaaaaataaagtacatcttgataacccgtagggtaacaaatttacaataggcagcaagggaaattgaagttttgaaggtacgttctgggccagatactcatgaacttttaatctgttcaaccatcatgaatgtactggtatagcctcttgcaattttcctatcttaagagaatggttagtgattggcacttggcggttgtgccatcactttgagaatcgtatcagcaaagatggctcttgtatctgctagcagaagtgcagaacataataaaagaaaacaggtgatagacacttgccttcattttccctgtacctacaccatgctctcctgtacaggtacctgttcatcatcagagtcaatattaatcttttcaggcagcttttacatgctggcttggtcagtttttcattgtaccttccatagagagagcagtatgaaccatgaaatggtttagcctctccgcttcacgtcgttggtcttcttgactagggtcaaataggattattgtgtggaagtttccatcaccagcatgagcgataaccaaactaggaacgtacaaaaatcagaggtaaggaattcatgattaaaaaaagatggcatgatgtcttattggagccattgcgagataataacatgcttgatgctactttatgcatacttcaaatattagataatggagcacatgactatgccttgtattagatataaatgagaacataattttacacagtggctttgcataataagagagaacgtgtaccaagtcaatggtgatgcatcaagcttttcctttgagacagatatgcattctgcaagtctagacaaaggaacacaaacatcctgcataaataaacatatatgtggcattagatgacttgatagagtcagtccactgaaaattgaaagcttgtaagggtatgatgattgtgacgacctttggacgatctatataagcatatgagataaaaaaaaatcagaagggggaggggggatccattttatgccattgagttgtccaatctatagacgcacatgatacgggagccacatgtcatcctcacagtgagtagcatattatggatttatcctataaatatggtgctcacaagatttaaatagaccagcttgctaatggagaagtcctatcttgattcaaagaaagagttgagatacaagaccaatcatatttacatagccgtaagcatgtttggttgccaattgtcctcctgaatgcagcacttattttgagatcataattgttctcacatttatgaagaggatgataactacgaaggaagatgctgagattcacaactacataatcaaacatcaggtagcatgatgtgtaacatcaaagtacaccgactatgcttgatcaatatatttttttgttcaaaaaaatatatgttgacaagttataagtaaacagaccgttatcatagcctcatgatcaggtttcatggcaaaaccggcccaaagtgcttccttcctaatctgcacatataagaataaaatgctatcataaatatgtttcagcaaaaggagaaacacatacttcagtactgccactgccactgttacccagatataggtggatgcaaattgatagtttgataccatattcaggcatgtgtaagattatgcagaataaagactactttatttactaggaagtctacaatattcagatgagtactaggaaatctacacaagttcagatgaaaaaattggctgaccttccataactcctctttagcatccagctcttctacaaaaacaaaatcagatccatggtgttctgtggcaatcttttgaaccaatagtgtttgttcaagagcataggcttctgggtattcacgatggaaatatattagcaaataaaaaaatagattgtggtattcaagctgaaaaaaatagttgcatcttaagaagttttttaatgagaaggaactttgagtttcgagtggaactgctcaaaagtggataacaaaacccaggtattatattactcgaaatgtgctggttttgtccctaagacaggaagatcacaagcccagacttgtatgtcactctttgaaaccaaacttgactacataccgactgctatttaatacgtactattcaaaaagttatcttgacagaaacagtgtgcacagtaaatttagttttattcgagagttctttactcactaccgttgatcatcaaccaaattcataaacactaattgacggtaaaagtataaaactgtggagttgcatttgtcaattatagtgtcaacatatctagagaaaactaagatattctatgcctattggttcctgttccatcttttatttattatttgaacacttaactctagaggactcagtactgccaaacatagatgcacaatacagtataaagtagacttttttgtcaaagttcagtgtgaagtgttaactattcaaataaaaattaggttacctgtccctatgaattcgaacatcaaggttggtacttcaggtaagtttttaccatttgccatgttaattgcccttatctgaacctcatccaacaattccactcttgagacctggtcaagcagaaaacatacaagtagtcataacctacaacctttttaaattgcttactgaaacacctgcagaagttctatgaaagcatttcaatatttatagttcatagaaccaaatttccctagttagttaacctaacacttgcctatggagacaagcggatttgctcaatctgaaacagaggtgtaacaatctcatatattttttgatgtaagaaggtagagctaccttatagccatttcattgatcgaaatgatggattacaaagtggaggtgtgacaatttcatatatgagcttcatcagcagaaaaaagacaaacctgtaactaactaaaatcagaagaaaaaaagacaaacctgtataccagaaagcattgttgcaatagcaacatcagcagcatccttaattgtttgaaaattgcacattgcaacctgaaatagcagagcacctaggagtgtcttcaccagtaaaataaggaacaaaatagacaggtagtacaaaatagttcgtacagcaaaatgaacatagaaatccagtgtgtgtgtgtgtgcgtagatctttcaacagtattaggtttagaaatttagggagtagatcacaccgataggcttcagaccatgttatttttccagttcagagcacacagcaggtgcttagaagagaagcttttatttgttcagactcacaaatgttccccatttcccaatatgcaagataatagctatgtgccatagcatgattataaaggatttctccaaaaagaaagatctatgagcaaatgaaagtaattggtgtactacataaagccataatagtgtatatgctaacacaacaactgcacacaccaatatgcagagagttgacggcattcaagtccagtacacactgtaagcaaaacattgtttggacagtgtctagatgaaatagaagacctaccacggaatgagatggaagcttttgaagacgtacagtcacttctgtaattacccctaaagttccttcacttccaatgatcaaacgagcaagatcgtatctgacattcaacagaagagaacaaaaaacccatcattgatgccaagaatacatgtaaatcccacatgtatttaacacattaatgggcataggaaccagtgaaataatgattcactcccaagatacataaaaagaaacttattcgggaggggatcttgcatacccagctgcactctttcgggctcgagaacccgtcttgacaacatcaccattaggtagaacagcctgcagtactgagaaaattttactatttgtatgtgaaagtcaattgaaaatagctcactcaaggatagccaaaagaacctggaggttaatcacattgtcccgcattgttccgtacctacaaactaataagcaaatcatcaaagccatttaacagtaaatcataaagataaccataaaagaatgcaccatcacgtggattacagttgtacattatttttcgatggggtggaccgtttcactataaaagctcgaaagtaccctgagaaatataaggagaattacctcacagctagtgaaccagaacagcgagtagcacacattcctccaatagtggccccaggccctgcaaatcagataagaatacttgagctaaaccaccgatctagcacaaaattatgcttcatatcatgttaccaaatgcccaaaaggatgggtgaagttggacgaatatgctgcatgtcatgttatcacaggcacaaagatgtacatatcacccaaatgtctagacgatgcaagaaagttaaacaaaattatcagaaactaaatttagttagcagcaaccaaatgacatccagtacaaattcatactgttttatgtcaaagttagtggacagattatgtttcacgtaaacaataaacaatggacttgcctgggtcaagagggaaaaagaggccatatggtttcaggtactcattcagctcaatccatccaactcctggttcaacaactacatccatatcctcaacatgcagggatttgattttctgtgaacgatttaaagcaaactacaaattagaagaaagtgaaattaacagagaaacagctttgtatcgtctcatctatcctgcatcaagagctcactgctagtaacagttttgtctgtttggcatatggaagtagtatcaaacaatcaaaccatggtaaaaagaaattgatggaacatatactgaagcaccttttaaggattagaaacaagggtaattaattcagaaagatttaatttccacgaaattattagtgcctacaactatatggtctctagttacatttatcaatgtttaccttcatcaaagacatgttaatgcaaacaccaccatgaggtgccaacgtgtgaccctcaattgatgtagccccaccatatggtacaattggcacctgtctcgaagaaaaaggcatcatcattcagttctatagtggaaccctcatacaagtaattagccatcatgaaaacattgggagacatccacactgtctgctccttttatagactattgctggagacagcaaatgaaggtaaagaattcctttactgagaatatggcattctcaaggtgaaaattgatttccaattttctaaacagattttaaatggcacgtgtaacaaagtacaagagtcagacgagaaaaacgagaagccagaaagattcgttacatcacacgtgattagcagcagtaccaaggtcatgtaaactaaaacaaccaataaaattagtctgaaatctgaaatataaaaatctagctcagcatagtgtgatagaaagtggattttcacaattcacacaatcaaatgtagtaaagtctagcagacggataactgatgcggctctttctaaagaaaaatgcaaaagattcgcaccgtgtttgcattaatgagacataccttgtacttgttacaagccatcacaatcttctgtacctcatcctgggacctgcaaaatttgatttgggccggcattacaatctctgagagaaggacaaggtcaacacataaccccacaagacgaactttggtatcaatcagtatctatcactattcagtaatcagtactactgttagatcaggttatacctcgggaagacgacgacatcgggcacattgactgccttgtggaagctgttctgcggcgtgccatggtagtgcctctcctcgtagtccaccgtcaggttctcctgcgaggacggacacttagcagtcagctcagctcagctcacctcaacggcgaaagcatcctcactgaaaaggccacgagctcatcaccccgaggaaggaagcgagctcgtcgatgaactcgttgggcacgcgcttccgctccccgcgcaccaccagct

SEQ ID NO: 14345 - DNA, 5364 bp, Oryza sativa
agggtggggtttgggagtgggagtggtggtggtacggggcgggaggcgggaggcgaagaaaggaaaaggggaggagcgggcggcgggagcgggagaggcggaggagcgcggcggcggcggtgcccatggcggcggaggaagtgggggcgagagcgaggcgagagttcgcgagtgatgatgagaggtatgtatcggggcgcgcgtgggtgggtgggcacgtgatccatctgcgtggccgtggacgtcgtcttgtggtggagggtggcacggcatcgttggaccacgtgccctccttcaaaacaagcactagaaattagtagtatgacttttgaataaaaggcgtttgtagtccaacggttaggataattgccttccaagcaatagacccgggttcgactcccggcaaacgcatttttgtaattttttttcattttttgtcaaacacacacatatcttttcttttcttttttttcattttttgtcaaacacacaaaacacacatatatcttttcttttctttttctcttaaaggtatctctgacttcagcaataaccactactccctccatcaaaaaaaaaaaacccaattctgaatttgaacctgaacacattgggtttttttgggacggagggagtatctcttagccctattcgtttttctcttatattttaacatgcattgtatgtctatggctagtttaacaccacataacatttcaaatatgaatatttctaatacatacatttcaattgaatccaaattcacaatttcaaacacaacaattcaaatacaaatttaaaattttcaaacagtacagaggtgaaaacaacattagctctcaaccttctttctttgcttataccaccgccttcacaaaataactcaattttttcatccatcccatataggggatgcctacctcgcgcagacgcgcaagaagggtaggtcgagcgcacttttttcttttgttgtattcctagcctagttcgactccgtaacttttcggctcatacacgcgtggcaggctggcaaccgcacagcctagtgccgtagagctaatgttagcgctaacaaggagtaacaattagaattaagtagtcctttataatgaaataataaataaacaattgagttgaaaattttcaaaaatttaggtacatttgttttaagattcagattgaaatttttgaaatttcaacttgaaatttcaaaaattcaaattaaaagttttaatttttgggttgaaagtttttgaattttaagttgaaggtttttgaattttggttgaaagttttcgaattatgacttggaagtttccaatattcaaattgaaaatttcaaattttaagttgaaagttttcaaatttgacttgaatttttttcaaatttcgagttgaaagttttacatttttaatgaattttaattttttttaggaagttttatatttaatttgaaagttaagaaaattttgtatagattttcaatttttttattaaagaaaaaagaaaaatctcccgccaataaaaaaggaaaggttatcttaatttagtaactactacttaattaaactaatcatgatctatcctatcaataaagctagccgaatggcattccccccaaaaaaatcatgatcttttcaaatcccgttgtaaacgcatgcacgtggcagcttgttggctcatcggacggaataggaatcgcctatagctggtggtccagaaatgcgtatgcggccgtgggcctaaaacacgcgccgcggcggcgcgcgtgagaattagcttttccgtcccatatataccaataaacaaactaaaggactagaataccctccactatatcaaatccaaaggcaatagtccttcagtttatctagtaccaatgtaattgtctcttattttatctaagtcacaatgcatttgttcctactttcactgcaaatttgaacgatatgataaaacccccagacaatatctacagaaaatttttcactgcaaatttgaacgatatgataaaaccccagacaatatctacagaaaattgaagtgtacagaagagccaatatctacatacatgttcaactgttcaagctgcacaactggcattaacttcaagaacttgtagagaataaacaactcgaaagagaaaacaaacttttcaattcttcatgtttactggaaggagggtgcaaacatgtcacagatagccattgttattctgctcaattctgatatctgggagttcaatatttcaggaaaatacaattgttcatcaatcaacaacttccaaattgaatcaaacaatatttgggacggcagattgggagcgctaccttgtgaagtgatttacccggagttgggggatccaattttaggcacctgtttagagaaattgttggagcctaatttttacttggaggctcaaaatatttgcattgggagctatattgggtatatgggtatgctcttagtttggatttgttttttaaaaagatatgcagttgcacggagatttgaaataacataacattctggacaacaaagatagttactcctccaatgataaaccgcaattttttctacacaattaatttacacatgaaaaaatctcaataaactggaaattatgtgtattcttccaccgcaagcttccttcaaggtccatttcaacgtcaaagtgaaacaaactcaaaacgaaccatttcgcctcaatggagctttaatcccagatgtcaagatcacctaattaacaagccggaacgtttggtcttatcaaactcaatccaaaatggagataccagccggtaagctggtacattttcgacatccttacgtgacacatctgaaacatgaacgacgttacggtggtctgccttgcagagatatttcatggcaactttagatccatccacaaagttgaacgcctcaagaattgccattctcgaaggatcacaggctgctataggcctcggatctatgttcatggcttggagcacgacagagttcctgagaatatgatgtgccaactccagctggtctttctgaccgtaaaatcctgcgatattgacctccttgagatggtagtgggggcatggaggaagagttcttagtttaccatgagctttgcgataccggaggtgatcacgacaattcatccacatctataaatacagaccaaaaaaaatagaccttgtaagagcagcatgttataaattaaacacacgagcatgatatatgattatatgatggtcaggccaatatcaggatcaaattagatgcattgccaattgctcaataatcagtatatgtaaaggtaattcataattcaatggagctgttcatttcagcatccttaatgacaactaatgaaaagcatttataagttcactgacaatttgtcggcaaaatacataatttaagacttgaaacttacatgaaattcaagcttttccatcaagggagcagcctccaagatgcaggcaaaatctagaatgtcagcatcccatttccttgggccagaaaatgccaattccaatctcagatgttttagataaataaatttgattggtttgtctggcaaagtaatcctctgaaacatgcacacaaataacaatgaacaaaaatagtgtaacttgagttaacctgtaagatggaagtctacaagtaaattgggaatataaagaagtgatgtgtctgcaacctcaagttcacgacattgcaaagtcagcatctcgagacgtggaagagtgctgggaagttcggtgaaaatatactgaagagaatcagaaatgtccaatgactttatgcgtaaatttgtaagcacataaattccaggaggtgctaaaggtatcaatggaccaatgtactcgagtgttgtcaggccagagtttaactctatctctttgagacatgggcattcatagacatacaaatgcttaagctgggttgaaagatgagtagtccgtaagcttgtaatcaatttacagcaatatattccaagaaactccaaacagttgcaattggacaacaaaagttgtagatcttcatcagtaatgcccacatctagtagcttaagccttttaaggttctgaaaacccttaaaatctgcaggtggcttcagagaaatggaaccaagtttcaaagactgcaaattttccatgttagcagcatcaaaaatctgaaatgcaaagttatatggctcatctatgggccagtggaaagatctgaaatcaagaacaagttgctttgtcttcgatttgatggcgaagttcacccatccattgatgtgatacgcattttcattttctaaaagtcctataacttcgattttctcaacgcctccaccgttgtgctgctgcaagattgcgtccaccctcctgataaactcttcagcatttagcttcctgccttcaggtcttatgtctctttcgatgtagcgccttgacattattgatcgataactaaggtttaggtttgtgtggctgcaccaagtgcggttccattggctagataatatgctcgttctagcagcttctcttaacggtaattttgacacgatagtgcagagaatatcctgcagtaaatacaaatagattaaatatacagattagcgaatagagatacggagaggttcttctactaaaggcattttgcatcatctttttgccgggtcggctgaaagattaggccgaacaaatacaacatcatcttgtgaggaccaagatactaaatatctttttgccgggtcgactgaaagattaggccgaacagcgaacaaatacaacatcatcttgtgaggaggaccaagatgctaaattcgagatcgatatttcatacctcgggtaggttgctcaactgaagtctccatttcttcctcttcatcatttgtccatgcaggtcttcttttgaggctatcctctttctcttttccattttagctacagtaaaggaacagaataatcacataacatggatacaagcataactgcataagagcagtatttttttttctccttgtcatgccacttctataattagcttatcattattttttttaaatgaagcgcgccatgactttaacctttttttttttttggctgcgtggggtttggagcaacttaaaagttaaaaccgaagctcatttccagtaggacaccaagcaaaatagtcatatcgaatcggttgtaacttgtatcccttttaccaaaggcctgtttagatcccctagcaaaatttttcaccctatcacatcgaatgtttggacacatacatggagtattaaatataaacgaaaaaataactaatttacacaaattgcgtgtaaattgcgagaagaatcttttaagcctaattgctattccctccgt

SEQ ID NO: 14346 - DNA, 34277 bp, Oryza sativa
cggcgtcatctattaaaaaacggaggtagtacatgatttgataatgtggtgctacagtaaacatttgctaatgacagattaattaggcttaataaatttgtcccgtagtttataggcggaatctttaatttgttttgttattagtctacatttaatacttcaaatgtgtgtccgtatatccgatatgacacgtaaaaacttttcacccctggatctaaacagggcttaagtttatataggacaatgtgtgtatagcgtctgaattcaaatgaggactcagaagatttgatgtagctagctgacatagttcagacttcagagggtcctaactgtgaaacaaattacagagcacttacttctctagattccaatcaagccaaatcttgatcttattatctaatttaattaattaactgcagctaatccaatctaatagtagaacctattcaacttaggaatcaagaatcatggtacaagcagatgcgaaaggtttaccttgggtctcttggggaggaggcgggaggtcccctgccgccgccggcggcggcgagggaggctgtgcgccttcgacggggacggcggagttgcgccgtgctgacgtgctcgccggagtggtcgcggtgccacagggggggggggggggggcgttttaacgggctctcgttgacacacggagtacctaaatcctaatatgatacgaaaaatcagaaattagcctagaacctgctttatctgaatttcagcacgttgcataaggtaaggaaaagccaaaacttttccaaaaaagaagcaccaaataatctaactctaatctaatactccctccgttccttaaatatttgacgccgttgactttttaaaatatatttgaccgttcgtcttattcaaaaaatttaagtaattattaattattttcctatcatttgattcgttgttaaatttacttttatgtatacatatagttttacatatttcacaaaagtttttgaataagacgaacgggcaaacatgtttaaaaaaatcaacggcgtcaaatatttagagatggagggagtataatctggagtatctatctattactccctccaattcatattataagtcgtttaactttttttttctaatcaaatttctttaaatttgatcaaatttatataaaaatatagtagtattttcaatgcaattcaaacatattatgaaactatatttaaatttagtgtttcatattttagatattgttaacttttttatataaacttgatcaaacttagcaaagctttactagataaaatgtcaaacaatttatagtatgaaacggaggtagtatatgttatcgccaccgatgtggtcatcctccgtagagctgcagcttcgcctcctccaaaaggccatgttctcaagtgtttgatgaaattaaggccctgtttgtgggagtttgtcccagctgcagcttttcccaaaagctgcttctgctagaaactgccccaaacagtccacaacttttgttcttaaaaatgaactaagaagccaaagctggagaagctgggttttaaagcttttcagattctcagaagctggctatcaaacagctgcttctcagaatctaaagcttcctcaaacaggccctaagtctagggatgccacaaaatttttgacaaatttttatgagctttggctgcttgtgttacctttgttttttactcctcaggttcacgtccgatagttctcttttggaagtttttccccttactgccagttgacacttgacagtcactagctacatggattatgctaatcacacaatgttcgagttcttggttgcaaccagctagacaagaaggacgggtccctctgtattttcttcattgaagagtttttaagatcactgcaggtcccatttttacctgatgatatgtgaggatgaaaagaattcctgtctagaatagtggtggttggagtgttggacatgttaactagtgtcacttaattaaattcgagaaaattttgaattaagagaaaacaatagagaggataacataacaataatctggtgaaatttgaatgctacagctagaccaacattggtggcgatttcttttttttttgttacaaatgaattcaaacaggcacctgctccacctttatgaaattatgataaactctgcaaatgccttggttattcttcctgtgtgggttttctcctgtccaatgttgtgtgcaaatactcctactgtatcacaaggaatttcacaaagtttacctgctgtattattttaaagttgggaaaggcccgggatctttctagctagcaatgcaagctgcgagctagctggtccgggttcaagactcaccccctccttaatttaaaatcaatatagtccttcctatattggtctttttttttcaatcacattggaaattgtgaatctatacaaatacgtgtaccgtgactccgtgagatgagttgaatccgaaggactatgaactacccaaactcagatatctactactgtaacagtctgctcattacgagctcagatgtacttgactactcctaattaaacctttacctcaaagtcgaaccactgtttcatcagtatatcatcctgtagtccgaagcgtaattaaccagccccaagatctgtcttgttctgctcagcgttagcctcgagctcatcgagttgatctttcagcttctgcccccatctcctcttgcggctgcttctttatcttgagcgcatccaggttgagctgccagaaggctcgatcgttgtgctttctcatcatcagccttctgcgccttggtcagcttgtcagatttcatgggaagacctccgagatgatacggtgcgattggcatgtcgccctgcgattcaaacatggaatggaatagcattttgtggaatcaaacaccaagcacaacaaccacactggggctcctcgatcgaacagtcgaactcgaaaaacttgtatacataggctaaatgaatacagcgtaaaaaacgtggttaacaagctgacggtaagaaaaattaaccaggatcctggatgcgagcgcagttgtcgcacggtgtgccgccgcgccaactcatctaataccacttatagaggctcactcttagagatggggcaatgggaaattcaccgacgggaaatacatcgtccctatgttgaaattataagcacgtaatgatttaagttattccataaataaatcatgacattatatatgtaaactagattgaacgcatcattagatctacacatgtaaactaagcagtaaaatatgaacagatcaaatatgcgcaaaatgtcgaacacgtaccgaggtggcggaaagaccggttgctcggcaggaactactcgcggttgcgagcgtcgacgaaggcgcgaagcacgcgagcggagaggaaggcgagccgtcgcggacgaacagagagctgtcgcgcgaagcgcttcccaagaaccttattgccgccttctcccggtgcaggacgtcgaaggcagaggttccggagacctgctctcccgatcgccggtgcacgccggcgagcgggatggagtagtctacgagtgacggcgcagtacagagtaggaggcaaaccctagattgatttcgcgtgtgttgcgtgaagacggcggctcggtttatatagagatagatcgcctgatcagggcgcccgcgtaaaccgaaccggataagtcgcgcgtaacctatccggactccatgccgttttcacgtaccggatttttcggaatgtttccaaaacaaaacaaatccgaatttcccgcagcaaaacaaaactgcaaaagactccatgccgttttcatgtaccggatttttcggaatgtttccaaaacaaaacaaatccgaatttcccgcagcaaaacaaaactgcaaaaggaggctgcatctgcgcaagggtgaggagccaattttgtagaccattcgacgcgtacgtcgtgcacgcgcgccgcctgccctgccaggcgaggcgaggcgagcgcgcgcgcgtgtttcccctcttctcttcaccacacatgcttcaagtggctaggagagcatcctcccttttaaggaggtccccctctcctagaataagcaatgtggtactaaactccacatgcataccatcccatgaggtgggcttttgtgattttccaaagaattaatcttcaaatgggccttagcccatctattaattccaacaatcccctaccaaatctcaaaatcccactgagatttgccttttccaatgtactgtttatataccaacggctcgatagagaccgattaaggttgaacatctatctagaactccaagctacacttactcacaacttgaacaatggactacggcttggattgcaagtcttgtgcaagcaagtttcactcagagtcttatctggtattagaccgtctgtagactacccctcgggtggagcgtataagttatactcctaggtctttagtaagcttcctagaagattcacccaaaatctccatagactgcgaccaacggtcaagcttacaaaggtgagttctttcaagaatgctctgcaggacagcgtcttcgctaattaaagccaacagaactcattaaggcatagccaacctgccttgcagctcacgagagtacatgcatcttcacttagggagggtatagattggtactctcctctagtttactaatggtttgttcttcacaggttctaattcacgggatctccgatcacatagactgagttaccaccatagtataactcacacgggtctcaaacccatctccttcgatgcattatctatcacatttcgtgataatcccttcgtgaagggatctgccaggtttctagctatttggatgtaatccaacgttataactccggagtttctcaatttcctgacagacttcaatcgtcttttcacatgtctaaacgatttcatattatccttagaactattcactttgacaattaccgtttgattgtcacagttcataaggatagccgacaccggttttcaacaataggcagatccattaatagatcatgcagccattctgcctcaacagtagcagtatccagtgccgtcaattttgcttccatggttgacctcgtcaaaatggtttatttgcaagacctccacaaaacagcaccaccacccagtgtgaagacatatccactagtggctttgatctcatccacatcagagatctagttagaatcactataaccctccagtaccgcaggatacccagtatagtgaagccccaatttcatagtacctttcagatagcgcattactcgctcaagcgcacgccagtgatcatctcccggattagaggtaaatcggctcaacttgctcacagcaaaggagatatcaggcttagttgcattagccaggtacatcagcgagccaatgatttgggagtattctagttgattcctagcaattcttttgttcttgcgaagcaacaagttaggatcataaggtgttggagaaggcttactatcaatgtagccaaagcgattcaagatcttctccacataatgggactgcaagagtgtaatctcattttcacctctaattagcttaatgtttaagataacatcagctactcccaaatccttcatatcaaaattttgagacaataatgatttaacctcatttatcacctcaaggtttgtcccaaatatcagtatgtcatcaacatccaagtacagaataactccctcacccccaccatggcgatagtacacacatttatttgcctcattgactgcaaagcctgcagatgtcaatgttttgtcaaatttctcatgccactgcttaggagcttgtttaagaccatacaaagacttcaacaatttgcacactttgccttcttgaccttcaactacaaacccatcaggttgatccatatagatctcctcatccagctctccattaagaaaagttgtcttaacgtacatttgatgaacgagaagaccatatgaggctgctagggaaagtagcacacaaattgtggtcaatctagcaacaggtgagtaagtgtcaaagaaatcttcgccttctttctgagtatagcccttagcaacaagccaagccttatacttttcaatagtaccgtcaggcctaagcttcttcttgaacacccacttgcaccccacaggtttacacccatagggtcgctctgtcacctcccaagtcccgttagcgataatggaatccatttcactacggacagcctctttccagtagtctgcatcaggagatgcatatgcttctaaaattgacttaggagtgtcatccacgaggtacacagtgaaatcatcaccaaaggacttagccgtcctttgtctcttactccttaaaggagcttcactgacatcctcctcagagacatgttcatgtgtatgtttagtttgttccggtggtgtgattgaactggaaattatttcagagggttggctcgaaccactatgtgtatccttcattgggaaaaagctctcaaagaaggtagcatcatgagactccataattgtaccaacatgcatgtcaggtacctaggatttaactattaaaaatctataggcaatgctatgatgagcatatcccagaaatacacagtccacagttttaggtccaagtttgcgcttcttcgttattggtacattgactttcgccaagcacccccatgtgcgcaaataagaaagtgatggttttctctcaatccatatctcatatggtgttttgtccttatttctgttaggaactctgtttaacacatgattcgagataaacaatgcctccccccaccatgccgtaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacaatcagacctaagcctttttatctttctgtcaagttgattttcaacttctgccttataaattttaaaatagtctagaacctcgtctttcgttttcaacaagtacacatatctagtagcatcatcaatcaacgtcatgaaatatcgttttccacccttcgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaatcattagcctcatcatccacactgccacaaatatggttcacagacttattgcagaaatcagaaagggaaaagcggaacatgcctccgcactcataacctttaccaataaaatatccatgtttagacacgactaatttattagactcaaaaaccaacttaaatccgtctctagtcagacgggagccactaataagattcctgtcgatagaagggacatgctgcacgttcttcagctgcacgatctttcccgaagtaaacttcagatctaccgtgccaacaccatgagcagaagcatgtgacccattccccattaggacggtggaaccccgtgcgacctgataagaagaaaacaatgagatgtcgcacaaacatgtacattggttccagtatcaacccaccaattagtagactgattaactgaaaaaacagtaggtaaattaccatacccgcttccatctccagtgttgccaatggtcacattagcagacttagaagtctgccctgcaggtgccttcatccccttgcgccgtggaaacttcctagccagataaccaggttgcccacacacaaagcaagtcctctcatcctggttaggattgttgttgttcttcttctgcttcttgaagttggtggtctgttgagttttgtatttctccttgctcttgttctgggccttgtgcacaacattggcactggactgcccaccatcgcccttagacgcggcgtctttttcccgagctttctcctcaacatcaagagacgctatcaacccctcaacggagtattcatgtctcttgtgtttgagtgccgtaccgaaacttctccacgatggaggtagtttcgcaataatgcacccggccacaaatttgtcaggtaagacacacttaaggagttcgagtttcttagccatggtttgtatctcatgagcctgttcgactacagaacggttgtcagccatcttgtagtcatgaaactgctctatgatatacagatcattgctagcatcagtagcaccaaatttagtatttagtgcatcccacaactccttaacgtcgatcatatgcatatacacctcgaccagacgatcgccaagaacgctaagaatgcatctcacaaagagagtagtggcttcctcgaattgcttctgctgatcagcagtaagaattcctttaggtttgccagtactcacccagaagcatttcatagccgtcagccatagagtgaccttaatctgccatctcttaaagtgcacaccggtgaatttatccggcctcagtgcatcggcaaaaccagccatagtaaaatcacaacgcctataataaggtttttggattgttgaaattataagcacataatgatttaatttattccataaataaatcatgacattgcagatgtaaactagattgaacgcatcattagatctacacatgtaaactaagcagtaaaatatgaacagatcaaatatgcgcaaaatgtcgaacacgtaccgaggtggcggaaagaccggttgctcggcaggaactactcgcggttgcgagcgtcgacgaaggcgcgaagcacgcgagcggagaggaaggcgagccgtcgcggacgaacagggagcagtcgcgcgaagcgcttcccaaaaaccttattgccgccttctcccaatgcagtacgtcgaaggcagaggttccagagacctgctctcccgatcgccggtgcacgccggcgagcgggatggagtagtctacgagcgacggcgcagtacagagtaggaggcaaaccctagattgatttcgcgtgtgttgcgtgaagacggcggcttggtttatatagagatagatcgcctgatcagggcgcccgcgtaaaccgaaccggataagtcacgcgtaacctatccggactccatgccgttttcacgtaccggattttttggaatgtttccaaaacaaaacaaatccgaatttcccgtagcaaaacaaaactgcaaaaggagtctgcatctgcgcaagggtgaggagccaattttgcggaccattcgacacgtacgtcgtgcacgcacgccgcccgccctgctaggcgagacgagcgcgtgtgtgtttcccctcttctctccaccacacatgcttcaaatggctaggagggcatcctcccttttaaggaggtcccctctcctagaataagtaatgtggtactaaactccacatgcatgccatcccatgaggtgggcttttgtgattttctaaagaattaatcttcgaatgggccttagcccatctattaattccaacaccctatccccgtccccgcgagatacggcaggggaattttggttcccatccctatcctcacacggggaattaatccctgcagggtcttcatcctcgcttaaaacaatatatacaatattaaagcatatatacaatgtatccagacggagatatgtctcttcccatttagttccgtatggagaaccaattctaacaattcctatttcctaaaaggtgaatttcccatgatgagacggggaacggagccgttgcaatctctactcactctaaagaggtagagtgttttaaaatctgttaagagagtacaggggactgctgacaaaacaaaccaccgcaaccttatttagtattaggctcatagcatttggagcccctcattgctcctcgagattggaaccagcactttggtcgttgcttgaacttgctgggcattctgtgcattttgaactttggcagggccgccttggtaccacgtacgaatatatagtgcacaatgaaaaaagtcccgcaaaatacccggtattaattatgttaaggagcaatctaaaatctgccaaatcgctgttgaacagaaaacaaaatcagtaatgtttctacaaattcaatttacatatagccacatcttaatattatctgaccaatttgtgtagtttaagaaggcaaaacaatgacaattttatttcaacagtttgtctagtgaaatgttccaggttcaagagggtaaatttatatacagggtctaaaaaaacacaaacacaactgattctttttatgttccaagtagacaattcacaattagttggtttagggcctatttagatcgcatggtaaaatttttcaccctgtcacattaaatgtttggatacatgcattgagtattaaatatagtaaaaaaactaattacatagattgcgtgtaaattgcgagatgattattttaagtctaattgctccatgatctgacaatatggtgctatagtaataatttgctaatgacaaattaattagggttaataaatgtgtctcgcagtttacagatagaatctgtaatttattttgttattagtctacgtttaatacttcaaatgtgtatccgtatattcgatgtgacacgccaaaacttttcacccctgacctaaacacaaccttattattatctctgctgcaagtgaatatgataatatagattcatttcgtgttcaggtcaaacttgattcagcaagtttctacattttacattttgcagttctctacattttaaatgtggtgcacctttctacattttgccgtttctcagtgatggatgatgcgacatgatccgatgtagatacaaaggagagaaaatagtgctgctacttactcacggacaattggggtgagtcggtccttgacagttgtactgtataaagcggttgtgttggcatctctagcacaacccaggggcttgatcaagtgattggtgtgatcaacagagggcagcccagtggttgggcagtttattttaagcttggggtgagcacttggaaaggtgttgaagttcctcgatgcctgcattaggtgggataaaaaatcaggacggtcaattgaggcaagtatattctttgcaagtatatgaaatattatactattatataattttttggcgttatttagcactccatccattctaaaatataagaacataaaatcagataagatatttctgtccagatttatagtactggaaaatgtatcatctgatactaaattcttatgttttcggacggaggaagtagtaacaaaaatgtaatggtactgtcatcttgccacattacgaattagcgtcataaactctttataactaactacttatatattcaatttcattgtctaataaaaaaacaatactcaattgaatggacggatgggcgtgtggtgcacgaacctcagcggttctagggaagaggcttcttgttgatttagaagacagatgggaggccaatttaggaaacacgaaacggccggccatgtcgacgacgtacggctatcgatctaatcttcaaaaccagacgcacggacagattggattgaggccctccctgccgcgccgcctgctcatataaaagagggggccaaacacgggagacactggaaaacctattccgttccaagattggaacaactcggaatacatgtccgattccgaatgataatcattaggaaaacaaaaataaataaatccaggatagtagagaatatcagagaccatctagcccatactaataatcttgttaaaaaatatgtaataagtccccgaaaataaaaaaggcattgtcattagcaactactaattacgaacatcggtgaagccagctctaaggctggttaggtattgcctaggctctacatctccattgtgtattggcgtgagaaatatcaggagtcttctggctagcttcacaaggtggtgagctagacgatctgggttcgaaaccttaccccttctaattatttgatattaggtcattccctaatattcacgtcttttcatcgtgtattggcgtaaatactcatcaaatatcgtcaatgatcgagaaatgctctttaattaatcagcatgttttggcaacatcaatcataagaaggaaacatatcctatacatataagcttcccgtgcacacaaactaacaaatgtcacaaaatattctaaaaaaaattgaacatttactcctaatagtattacacatatatgtaaagtctcatattcaaatttattatatttagcagtaaaaaacatgaaaaatctaacagttttgagggtaaaaatctattatgattttgtctttttttttacggctaaaagataaaatttcatatgtaggtgtatgtcttttttttttttgtcttttttcacagtttgggctttgctcgaagcgagctacggataatcggttcgtttggtttttaagctgagccaagcccgagctctttgtccacccctacccgtgcgcgagttcggttcctagcgcgtatgcgcgaaataggagtagcattcctgcgtggggttcgtcaccctcccgcgttatccatcctcttccaaacccaaaccccacgagctcccctcctcccctggactggatagcaatctagggttttatcccgagcccgcgcgccgctccaatggcgctcgcgggcgcctcctcgtcggcctgcctccgccgcctcaacccgctccttttttccgcccaccgccgccccgcgtggaccccgcgccgcgccgcccgcaggttctgcgcaggtaccggccgtcttctgcttctactgccctttgtttggtccgtttggttggtgttgattcggtgaaggggttggttccgttgcagctgcagttgcctcggagagagatgtgttcacctccccggaggtcgccaagtcgttcgacttcaccaatgaggagcggatttataagtggtaagctagcatttctaccagttatccactatttccccattttcatgaggtaatggaactatggctgagatgattttcccagtaattaatttgtcaatcttaaacgtgtgttaccttacattggacactcaccagtaagttaatttgtgatactcatgatacagcgagcagtttagtgccatttttccttgcagttttagactgttcgggtgattttatggtattttttgatatagcttcaaccattagattggcaattgtatctggatgagcaaaattctccttacactcccatgtagttgtgccctgtagtatttgagaagtaagcttctcacaatgcttctacttaatgcctttaagctaaacaatttcaatttccagaactaaaagtgagttccagtaacagaaaagggtatgctataacaagctttctcgcaattgattttctattatccatgttagacttgatcacttactagtgagttagtgacctgcctttgagcattgcctaatgtcaatgcaaggtttagcattacgaccgtatcaagattgaccgattaatactcttattacttgactcaaatattgtgtttttagtagattaatactcttattacttgactcagctattgtgtcgtcagttttttactgaaatagcattctaaatgcaaagtacaactctaggatctaggttgaagatagtctgtataaaggtatcatgatttggtccagttccatttttctaaagtgtgtgtgtgtgtgtgtatatatgctgttgcattagattacattgatatgattgtttacctgctctagttgacacataaaaatgtaaaaactgatgaattgcatttaacatatttaagtcaacaggtctagttttattttgctacttgctttgtttgcctgtttcacttcaagttcatgaagaaatgcacttcggtattttctggtcctacaataaattttccttataacatatatgttgtatctttgtaggtgggagtctcaaggattctttaagcctaactttgatcgtggaggagatccatttgtcatcccaatgccaccaccgaatgttaccggatcgctgcatatgggccatgctatgtttgtcacccttgaggtaggtatgatgattgaaaatttaagatttttttcctcttgttgaataactatagattgattatttctttactagcagatcataattgagtacatttcatgatttatacgttcactttgttgaatcatgacatatgagtttcatcttttttacccatttgaagtgatttgcatgttaacatgagcataagctgctatggatgtacttaccaaggtgaatctgtttcttaaagacaagaacatcatttttttaatcacactagcaatttagttctcttgcactggacccatgaaactgtgccatggatggtaaactgaatagtacttgcaattgctatattaagcagaagtgttggacagcatctgataatatccagaggttctgtgaactgacatgtttcagttaaactagcttattttgtggtctgaattcgtagatagttattggtgacagcactatgttgataatgagttatttttgtcccccccccccccattttttaggcactgtaatctttttactactaaattgtccctttttgtgtaagtactcaggatataatggtaaggtatttccgtatgaaaggaaggcctgcactttggttgcctggtactgaccatgcagggattgccactcaggtttgtagatcttactgcacatctgatatgaaatgataaattctattttgtgttcagcatgactttgtgaagtgatgggctgatttttatttactttttttttgcatttacattttagttggttgtggaaaagatgttagctgctgaaggaatcaaaagaacagatctgacccgagaggagttcactaaaagagtttgggagtggaaagaaaagtcagccctttttctgaagctagatcaatttttcttcattgtttctttatgcacctgtaattgctatatttgtttttctaatatgaagtgatcattgctaatagttacttggatttactattaaccatatatacccttgctcctacctccatttttttacgtgtttgccatgaaggctcatgtgcattacagtttattaactatcttctggtatcattatcgtgttgggtggtacctgtcataataatttgatcatctagatgaccagccttttgttattattctgaattgccagttaaactatcatgaacttgggatggaataataaatattctagttgataaaaaaaatcatgattcaagaaggttacatattttataaattctagcaatcactccaaatgatgtttcctttccaggtacgggagcactatcactaatcagattaagcgattgggtgcatcttgtgattggagtcgtgagcgtttcactcttgatgaacaattaagtcgtaagtgtagcctttattttccattgcaaatgatgcaatttgcatttgttagtatatgtatcattatagtgatggtagtcggtcgatcaacccctcaacctcaagcttatcatcagcgcttggtggtttgtacaactgatgtctcactagtttttttctttctacttacaggtgcagttattgaagcatttgttaggcttcatgaaaaagggcttatatatcaaggtaattaatataatcatttactcgctctattacaaaggaagcaaatgtgcataatcttgtgctgatattatgtgtgatagttttcagtttttaatcttttccctatgttttttctgtcagtgtaacctaattttcttggttgtagtttcaaattgactatgttaacatatttagtgttgatagatttagtactaactgattttttttttaaaaaaattcagtgtcaatagtttgaacagtagtgagaggtacaagaagttggggcatgtggtaataactttattttctatgtaatgtattatcactttatcagttacagcacaagtttcagaagtttcccagggtcctatttggaacaaactttaaacttttagccccaaactatatcaagtgcatccgtttattttgctgataggataggtctgtggtgtaatgtacatcataaatttttgaatcagaattataggatttgttggctctgagcttttttgttgcttactggagactaagttctcttatgactggaatttacaagcagagaggagcggcagcaagatttactaaaattatgtcccaagcaatttgttacttccatcgctagtatcaagatgccttttgccgtacgtttttaatatgttctggtacacacttgggtgtgttcatgtccatgatgcccgtgcttgttatggcattttctattgtgatagttgcgtcgttgaacagaaatttaggattttttcttcattcaattcttgtgtttttcctgaatttgagagtctagttttgccttatgtgaccttgatggtaaatattggttaatttattgtattttcgttcacaggatcttacttggtcaactggtctccaaacctacagactgcagtatctgatttagtatgttacaatattacctctcattttttaagaaatagctgcacacttctatctgtgcagatatataatctaagcaaaaaataaaaaataaaacttgagaataattacatacagaagctgacaaacttcaattacttcttcatggatagttgcatgagccaactccagatttgatcctgaaatggtttatctaaccaggaagtggaatactctgaagaacctggtaatttgtacttcatcaagtaccgtgtggcaggtggatcaaggtacttcttgacttatctttaatcttgtggctatatgttttatcattattcattttttaatcgatggtgatgttatcattgtccatttttgtgatgtttaaatgtgaatgagtttggatgatgcgcgctataaagtttatgttttgcattctattacaaggaatctaacagcatggtcgacactgtatgttgatgaaaattacttatatgtatttaaaacttaagcctctggtgcagggatgattttatgactattgcaacaacacggcctgagactctctttggcgatgttgcaattgctgtaaacccagaggtatcagaaaaagaaagcattccttgtgtcctgttacaacttacttcccccatcccaaaatatagcaacttctagcattcaaaagttgtcctaaaatcaaaatgtagcaacttctccacctactccctcctctcaaccaaccacaaccatcctccatttaatatcgccacctagtattcttaatctctgcacaaaacctaaaaaagccttatattttgggacgaagggactgcatcaaattgttctatttctcgaactgatttatttgaacaaccaatcttattttctttgttaaatgcaatgcaggatgaacgttatgcaaaatatgtgggcaaattggctattgttcccttgacatttgggagacatgttcctattattgctgaccgggtaggaattaatattacctgtaatatttgtatgattctaataaccaagaaagtatgttgcaacacggatcaaagtaaagcaattcaacagtaccgtattcactagatgttggcgttctcttatctttattgtgttgtcccaatggcacatctacatgcaaatgtgatgccatcgcttgtcagttcaagtcagaactcaggaaagctgttgtttctgttgaggcaaacttcactgttggcactgtttttggggctaaaatgccaacgttttgcttgctgagctgacgaaagcttttgcttgacgaatagccatacatacaaaagatgtgcattctttgtataagggcttcacacttgtatgccctcgtttgtggtttgatcttaaacatactttgtatgacttcatgtgtatctcccctggctcaagaatctcacttaatgataggcatgcattaggttgcaaacccggtttataaagaaaggtgttcttttatataatcgatagacttcgattatcccttttaacaatatatcggttttatgatctacagtatgttgatccagaatttggaacaggggtgctgaagattagccctggacatgatcataacgattatcatattgcacgaaaacttgggttgccaattctcaatgttatgaacaaagatggtacactaaatgatgttgctggattatacaggtattaattttcgttcaaacttcaatttaagtaacctgttcacttatttccctttgaatttgtttagacttgcaattttcaatgtttggtttctctgttctattccatgttgcatcataactactatctagggactgtagtttgtgctgcttataaacccatgtatcctctttgcaacacgaccagtatttatcttctattataacatggaaatttgagtatagtaaaattgctgttggaaaatttaagagattctgtggcttttagccttcacaatcagtggaaacagaaaacagtcaattcgacctcaattatttcatatcgaagagaatgtacaatatttgttcgattatacttgctccgcaggcaacacagctgcagagccctctgtatttgacatgttcttgaccttgactttgctatctttattcagtggcatggatcgttttgaggcacgggagaagttgtggtctgaccttgttgagactaacttggcagtaaagaaggaaccctatacacttcgagttcctagatctcaacggggtggtgaagtgtgatcttttctcctgtacctgctcatacatgtaggctaacgatgcttaccataaagattaatgaacttaacttttgtgtgtcactaggtaatagagccattgattagtaaacagtggtttgtcactatggatccattagctgaaaaggcccttcatgctgttgaaaaagggcaactaactattcttccagagagatttgaaaaggtaatacattaatcattagcttttctatgcaccaatcttctgctcactagtaagcacacataaaacatgtctaaagtttttattggaactgctaagcaggaatctgtctctgtattcccactttctcagtaaaactatgcatatgccaaataaagagttaatatctctggttatatcttactcctgtaaaaatgatttctttgaactgactttgctgctctccaataatttatttgtgctgctgctgcagatatataatcattggttgacaaacataaaggattggtgtattagtaggcaactgtggtggggtcatcggatccctgtttggtacatcgttggaaagaaatgtgaggaagactatattgttgctagaagtgcagaggaggcacttgcaaaggctcaggaaaaatatggaaaatcagttgaaatatatcaagatcctgatgttcttgacacttggttctcaaggtttgtcttccatctgtaaagctgtatgctcgtaatgacttagcatacatgtattttcctctccttgtccgcttcctgaagtttttttttgttttgctttgttcataacatgggcctaaaatagcttttacaacttgcattgtagagcagaaatgtgtttattaagatgtctgaataggttttagccatctccttgtattatttttcatgtacaacagtaagatgaatagttaatggagctcctatactgcagtattctttttcccttacagtttctgattggcatctgggatatctgtatgaaccttatttccatgtgctgtaccatgtagaagtataaacactttcagacacaaatcgctacaggtattaagaaaactgcatatagttttttgttgttttgacttgttgcagttgtcctgcagtgctctgtggcctttcagtacacttggttggccagacctatccagtgaggattttaagcacttttatcctgcaactgttcttgagactgggtatgttatcttcagcaacaactttatttaccttctgatctttcagtccagcgataatactgttgcgctgctctttatgttgattatttatttttccatttacctccattatattatagctttctctctctttttttttttggcagccatgacattttgttcttctgggttgcacgaatggtcatgatgggaattgagtttacaggaactgtgccattttcttatgtttatcttcatggtctcatccgggactctgaggtgagagaggagcaccttaatcactagttcctgttctgtacttttgagggagagtcgattaaacaaacttttcttgtagttgtaaaatgacatgattgaacttctaaagggcatcaaccattaaaggctcataacttggaaattttgttttcttttgagccgggattgaaccctctcagatcaaacattgcacctgattggggtctcatgctttatgtgctaattgactgtatgatgctctagtgcagctagtcacatactgcacattacctcaaatttgaagtcactgcctccttttatctgatataaaagtggtatcaccagttaaactgttaaatgagcccattgtgaaatctgttttgtacccttagtcatcgtgttcatctgagttgtttctgttgccatattagctctctgtttccatggactaattagcaagttaattttcagggacgaaaaatgtctaagacactggggaatgtcattgaccctctagataccatcaaagagtacgggacagatgcattgagatttacactttccatgggtaccgcaggccaggtttgcttatacagtcgcttttgtatttatcaagattgtttgattttgtgctgttaataccctttttgcttcaggaccttaatctctctacagaaagattgacatcaaacaaggctttcaccaacaaactctggaatgcaggcaaatttttgttgcagaatttgcctgatagaagtgatgccactgcatgggatgtcttgttagcaaataaggtatctgattgaatttcgaattgcacttgatgcattgacataatttagttctttttagaactgttgctaacaccttgcatctattgcccagtttgatacagaagcgtcacttcagaaactaccactgccagaatcctgggtggtgagtcagagtacattactatctcgaattatttgattaatgttcagtttgttaatgaagagaatacactacgatccaggtgacaggattacacgaactcatcgatagggtcagcacaagctacgacaaatttttctttggcgatgcagctagagaaatctacgatttcttttggggggactttgctgattggtaagattttttttattacctaagaatatgaggccaggccttttcattaagagcacattaatatttctgcctcaattaatctggagactatcagccctattgacaatgtaaggagacacagggggcctgagtaaccaagtgtacaacttatcatatttggtagacctgcccaccatgcagaacaaagaatttcctatttgagcccttttttatgtttcctttaatttacatagtcctgtttgtctaaattctgattgcagcccttcccattgatgggaagaaatatgctagttgtatgggattaaaagaactaaaatccttttatgtgcttaacttttgtctggttttcttaatctgagcttatatccaaatggtaaagaactgtcaagagctttagtggaaagctgaggtctttcttaacaatggagattccatgagcaatttttctaaaagaaaatgaaactaaaacatatcacaatgttagacgccatgagccccagctagatcccaaaactcccaaaactgtccctcttccttggcaagcagaaaagcacctgccaggtttgagggtagcaccataaaggacacaacaattaggatgcttccagggagtccaaacaccaagaatgttaaggacttaaggccttgctgcaccaggccattaagtgcatcgctagctcagctccactcgtcaaggactgattccccagcgatggcgacagggcagggaggccaacctgctgcaggagactcaaccaaaatcgtctaacagaaactcatgtagtgagcaggtgatggatagtctcaacgtcctgatcacaatgaagacaacaaggagggtgcggcagcctcacctagtgaagtgatctgcagtccagcaccaattgtgcacaaccaaagaaagtagtgtcacatttacctggggcccatgatttccaagtatgctcccatggctgaaatcggacagcaccctccaaaagaaaaataaaggacaacaccttggaggcttggaagaaattgtcatgtgcagatttggccaactattaccccaaagctgatagccgccaacggtgaatgtcttccacacccggctgcaacacagacctcagataaaagatcctataatcagagatctgggtattctcaagggcgccaacagaggttgcaccttgtatatccaggatccatctgtattcctttaggtcctcaagaaccgtgcgcctgttggttgtttttgtaggaaccagagcaaacagtttaggggcaaggtcagcgatccgctgcccatgtagcctcctatctttccagaacaaggtgtgcgcaccattgctgacctcaatctcaactgctatggaaaagaaagcatggacatcatcatgcatttgaattggtaatgccgactatggcctatcaggctcctgtttttgcagccacagccagcatatcctgagggcccaaccatgatgcatcatgcattgtttttagtatatttttgtgtgtcatccagtcaaccaaattagttctcttgcaggtatattgaagccagcaagacacgtctttaccactctggtgatgattcagcttcttctatggcacaaagtgttctgttgtatgtgtttgaaaacatactgaagctattgcaccccttcatgccctttgtcactgaagagttatggcaggtagtgaaacctaaccgtaaattattattccctgcaatgtagtatatcacttttaccttcaccattaatagcatatcattatcgttcttatttcaggcattgccatacagaaaacaagcaattattgttgcccactggcctgcgactgatctccctaagaattctctctcgatcaagagatttcagaatttgcaatcgttggtaaatctttgacttgagctgctcatactttaagtggtgacattgcctgtggtgaccattttgttccattgtaaatgtgataacagataagaggtatcagaaatgttcgagcagagtattctgttgagccagccaagcgaatatcttcatcagttgttgctgccgcagatgtcctagattacatatcggtgagcattttcttacattacgggtttttctttgtggcatttcatcgtatatatattgtatgaccttttttatctattaatctgagaatcaacttaatgcacatgcatgtttattaccaagaacggtaagtattattattctttttatcttgttgcaatactcgagttaaagcttttcattgctagaaaacaaagcatatgcatagttattagatgtgcaagtttcactattggaacatagaggtgcatgtgtgatactgtcttgccttttcagctctaacttccctgcgtcttgacattatgaaaaccctttatttgttttgtgaaaaaaccctttatttgttcagcatcatgatctgtactttgatgcctgcagaaggagaagcaggtcctggctttactttcaaagcttgacatgcagagtatacattttagcgagttgccgccaggtgtgtgcctataacttgtcaacataatcttccttgatgcacttggccaatataaatcatctacttctgttgctggcaggtgatgcaaatcagtcggtccacattgttgctgatgagggtctggaggcctatctacccctggctgacatggtggatgtttctgaggaagttaagcggctgtcaaagcgcctctctaagatgcagtcggaatatgattctttgctggcccgtctcaattcaggaagtgtacgcatatatttcatcttcatgacaactatattatccctttgaaaccaatttctgtatccttttaaccatgcatttctttcgtgctgtagtttgtagagaaggccccagaagaaattgttcgtggagttcgtgagaaagcatcagaagcagaagagaagatctccctcaccaagaatcggctcgctttcctgcagtcaacagtatcaagttagattcagcagtcaccattgacggtgtcaacctgccatctaaataacaattttgattagtcctgatttggacgagagatgccacttccggatataaattggcgtgtcagagtagtgagtgccattccattttcgcgtgtgcaggacattgcaactggtgcacgcatcttaccgataagttctactatataacactcatttatacgtctactaggtatgcctgtacgcctgtgcgttgtaacgggacaatagttgtacatacataaacaatacataaacaatgaatggaataaacagttgcacacatctgtattagtgaaatgtgaatctcaaaacttaacagggatgaaccacgtaatcaagaaaacatgaaccgttagattagaaaacatctgtattagtgaaatgtgaatctcaaaatttaacagggatgaaccacgtaatcaagaaaacatgaaccgttagattagaacacatgagccgttagattagagaagataaaacaaagagatacaagagccattagattaaaataaggtggaaaaaaattatactccggtcaatggagggaatggagagaagtgttgggatacacgtaggctacgatagcataaatcaaaattttctatcgcgtaaatcaggaaccatgcaagtattagatcataaatcgttaccactcgacgcactgcgcaacggaagaaggcgttaagaagtcgaaggaattctcacgaagtagcgcgcgtcgatgtagaggaagtagtcgatcgcactagctcgaccttctcctcctcgtgcgttctcctcgtcgtattcccacgccgatcagcaccgcaaaccagcggcgcctctaccggtatccacacgtacagggacggaacaccaggcgcagatgtgctagcacccccgcgcggctagggttttgctcggggaggggagtgacggctagggtttctcacgtgatgcaatccctccgccggtcacacccctcacgaatatataggatccatcattcgggcctccaaggcctgtaggactcctattcggatccctatccaaattaagctcatattggatctccatccaatccccttattccggcacattaagcgtgcgatcctgtaggttcatgtacactcggatgtaacccaaaaactccttttcagtccacgcgtcaacagctgcccctagcaaaacgtattgacccaccgggcatacataaagatcatatcggctgaacctctagtgtatacttgtatgaatccctttgcctcacgatatcgattaagctcaaggctgatatgtgccatcttctaatagctcaatcattcactcgaacctgttgatagattatataacttgtgattgactcctcaatcacctttggcatagccatgcacttccataatctacaacatcaaggggcccagcgatatctctccataggagggacaaatctcatcttgattattcatatcccactacatatttcatagcatactcaaaaactacttttataactacccaattacggagtagcgtttagcaatccctaagtaagctactacatatgttgggaaccatgataatctcaggtctaaggattcaacaccaatactaaatgagatcaccgataacacaacacatatggctcttgcagtgtctcatgttgggtctatccaacaacatgttcaccaacatgtgtccacattattaatttgatatctctatatcatgatccatgagacatgatcatcaattaatacatgtgctgatcatctaaacatatttgttccacatatgatatttgatcagggatcctttagaaatagcaacacataacataaagagtctcatgaaagaatcacatattcattaaccaataatgagttatctatttcaaggaacaaaatcggataaatatgtaaacatagtatgtgatacaatcatctctatgattgcctctagggcatatcactaacagtctcccacttgcactagattcaatcatgaacgtatcttatacccattgccctagtgtatgcctcatgcttaggctgagggagtggcctaagcatacataaacaatgcatggaataaacagttgcacacatctgtattagtgaaatgtgaatctcaaaacttaacagggatgaaccacgtaatcaagaaaacatgaaccgttagattagaaaacatgaatgttagattagataagataaaacaaggagattcaagagccatcagattaaaataaggtggaaaaaaattatactccggtcaatggagggaatggagagaagtccctcaaagcatcgacagcgcatgtcttgagggaaaagaagctaggaaaagcatcgacaccgcaggtcctggagggaaaagaagctaggaaaaaaaagaagatggaagtcgtagcactcgtaggtactgcaatcctaccagcgcaatttaatacagattaacaaatttaatacaggtgtcttcacaattactactagctcagctaatcggctatcctatatacctatacaaatcatccctactactaggaattctctgcatcctcatgcttccacgtcaccccgttttctcctagccattggatctcgatcaagcgcttctcccggttgatctgttggcaatccatcggatcaaatatcaatggttcagatgtgcagtccctctgttttcttttgctggccaacaagcccaactttacacaccatcaagcccaatccacactccttggcccaatttccaccgcatcttcccacactccatccacaccaccattcccgttcccctcctgcgtccgagcggtcgcttctccccgcgccgccagaaactgcgaccgcggcaccggcgcctcaccttccagatcctgcgtagcgtcgtggttccccgccagctcttggactgctcgcctccaaacggaaaccaccgttcacatcgagcaaactttatggctgtcatcaagatagttgttgtctcctcaacttcaagaaactatcttcttccacatcttgctcggtcgagtcctcacacgctgcccgattcacttcctactgcatcgaaaaccatagttccgttcattttccctgcctttaaagtttcagccacctcctcaccttcaagaaacctcaggggtatatattcctctaccaaaggtatgcttcttcctctttttcttgaaccataaccatatatgttcattcaatttattggcctacatttctcctttgagtcacactcgattgatttgttcatgttatatatcagattatcaacggattaaggacatacgagtattgatttggtttcagctcttcttcagatttccactgtcccaatatttatttggattcgtctcttcttcagatttgtactgtccctattcaataggattgaaatttatttggatttgtcacttcatatttctactgtccctattcaacacgactgacatttatttggatttgtctcttcttcagatttatactgtccctattcaacaacattgaaatttatttagtatgtacaatttgttaaaggtgccaattcatgatcatggtattatatgacgactctaaagatcatatatatgcatataccggttttatgtattgctgcaccttaatttgttttatttctgaatactacggttgcagatcattgctattagtagattatatactgtcgttgtagtagcagctctgggctaccgctgaggtcagtcgccatggccatccaaagcagcagttgcagcatatatttcctccgatatgaatcctctattaagaaaaatatcaacaatacaatcggtaatgtttaattttctcatcttcattcatggtcatgttttccaaatattatattatgcccacccgacgttacttgctttgcaatttcttccataagaacaaatgaacaatatcatattttctgcagactatcagggactgagttcagcaatgaacttaatttaggtaaatattggtccttggaagttttcattttttttagatgaagggcaacgccctctgcatcctatggtggatgcaccttgcatctgtccatgctaaccttctttgctatatgatgttcttacttaacatctttcccttctttcttagtagaatataaaggatgttctttgtaatagtacacaatttaacattttgtcaaacaataagggattcagcatgtatgtttctatcgacacaatctctctgccctaatgattagtatcatcaagaaagaaaaataagagagtttctgatgctttgtttagatatggtagctatacttttttcaaatatagaaaatgtttaattttttggctttcaatttactttatggtataggatggtaagggattgagcaatgttgatccaatactttatggattttttacattaatcataaaacatagattacctcacatgtagaccattttaattgaagataggtcaataataatcaaaattattttctcttacattgctataactatttgagatatttgtatctcaaacttcacctttgttgggcattccgtttatatttcgtccaacaatatactaaatattgtttgctgaaataaaataaaataatcattttccatggctatctattgcatttgccttgcatctccacatatagtcttatgttcctacctacgaatcccgcagcaacgcgcggggtattttctagttacatatacacgagagtgggttaaatcaaaaccacgatgaaattacatcacacatcagttgatcagtagagtcttctgccaggtattataggaaaaaaatcatctgttttaaaatatagcaacctaggatatatcccatcattcgtagattgctatatatttcatgacagaggtagtatacgaaggaacaaattgaacatatagtatgaagaaaggagacctgcatgcttcctcttactctcttaatattcttttaatatttctctcaaaatattcttttaaaaatgacaatattcttttaaaaacttgaatttgaaagacaataggaaaagaggtatatattatatggaaaaatttatcttactcttaatattcttttaaaaatgatactacctccatttcaggttataagactttctagcatagcccacattcatatagatgttaatgaatctagtcacacatatatatctaagattcattaccatatatatatgaatgtgggcaatgctagaaagtcttataatatgaaatggaggaagtatgatctatttgtaaatttatgttattttgattttcaaaagaatatgaaaagaattatagttaaagagggaaaatgcctaaaagatgttgatgaaagttaaagagtaacagatatcgcacaaatggggactacctcttgcaaagatgtcgtaggtctccaacactaggctagcaatggtatgctgttttgaaaggcccgcgttagttcagttggtttggtgctgagctcccatgacttgagcagtaggcgctatctcggataggatctccgctccaatgttaatagcactaaggtgttatagctcagcacataacacctaagtgattacaagattagcactaaaaaaatatatgtttttataataagtttttagcacagtctaatcttcaaatgtgttttataaagggcaaattttcacatcatacggggtagtctctcttgcaggtggtaggtaggtttgaatcccaccctcttcatcttttatggtagtgcaatacattttaaagtaaattgcacaaaactacaagcattttgaccaaattattatcacaaaactacatatttaacacttaatttataataacactacatatttaatattgaagttatcacaaaactattataaatccctagcatcattgatatgttggaactataaaaatgtagttttttttactaccttggttctaaacctgtagatttatgataattttattaataaatatgtagtttcatgacaacccatattaaatgtgtagttttgtgataattttaattaaattgtagttttacgatagtttgatcataatatctgtagttttataaaagggcaaattttgctaaagggtatcacgactttatgggtttggctgtaggacaccgcacaaactcacttttaggggaaaacactctctaaacctggttagcacaaactcactcacttttgggggaaaaacactctctaaacatggttatttgctgctggacaccgcgcacattaaaatattaatttctggttgaatattagagataaggtgaaaggtcaaaagtaccccttgccccacttgtcatattcttcctctcactcctaatttcccttcttctaatctcacgaccgaccgtggagctccgtggtgaaggcagtgctccaccgcgtcgtgggcgcgctctggcgtggcggcattcggtggagacggcgctcgacggcatctgcgagtagcagctaatcatgaaaagttgttgttcataatactcgtgagacttgctgtgtaatccattattggaaaagaaatactcgtgagactgataagctacatcgagaccttgaagcacaataaatttcaaaagagcatttttaagaacaatactccaacatcatctaagaagggaacactatagcataaactggaaacaagtattgatagcgcagattaggaaatacattttgcttgttataaaatgataatacatgtcaattcatagtattaagaaaataccagtgcagtaaccaagctacccgatatgtcaccgaattattaacacacattttgacaaaaacaactttatgaaaacattttctaggaataacaggtgcaaatagttatagcagcaaaattcaaagtattccactcaatcatcaacacattccttatatagcctttagaccttgttcctcatttggttttagctggcaggttggtataataaatatctgcatgccaaactcatttgactttagctgctagattggtacaataaatatctgcatgccaaaaaataactttagacatataacaaaatatttaaagaaaaaaaagaggatagtgaagactgaagggtaacacgtgactcatccctatcttgtcttattgaacatggaacaaaaaagggggtgaattacttcatttcgtaaatcaactagtagatctcgaagaatatttatataggaccgatataaaaaaatctatgatcatcctacgacagtacatccgcatatatggacttatccagtagaacttgtagctcattttctgttataggttcttcataagataaccgctgatgatatcgctgagtaactatgaatcaagagtcaatgttacaattaggcaagcattgacttaagaaatctagtcagtacattttcgtttgtgaatatgacataactaatagtgcaagattttagctgcagcgaaaaccaaatactgaataacactgagcagaaactagaaacaagtactggtagcgtagattaggaaatacattttgcttgttatgaaacaagtactggtagcgcagattaggaaatacattttgcttgttatgaaatgataatacaactcaattcatagtattaagaaaatatcagtgcaataaccaagctacctaatatgtcaccgaattattaacacacattgacaaaaacaacttcatgaaaacaatttctagtaacaacaggtgcaaatagttatcgtagcaagatccagagcattccactcaatcatcaacaccttccttatatagcctccagacctttcctcatttgcctttagctggaagtttggtacaataaatatctgcatgcaaaaaatctttagacacataacaaaatattaaaagaaaaacaagaggttagtgaatactgaagagtaataactgtgatggtgttacccattcctatctggtcttcttaaacatggaccaaatagctagtagatcttaagaatattcatattgttctctaggaccgatataagaaattggtgatcctcctgcgagacatcagcttatatggacttatacagtagaacttgcagctcattttctgttatccgttgcagctcattttctgttatccggtactttataggataaccgctgatgatatcgttgaggaactatgaattaagagtaaatgttacaattaggcaagcattgattatgaaatgttacaaaagtaatttacatactaggggaattctatattttgaatcgtcgacatttagattaggaccttcacttttgatcttatatatcaagctcttagtgttgccaatcacttgctgaatgttctcagagaattgctcaagctcatgtaacctacatagttttttttttactaaatcaccgggagagcttccccacccgaatttgtcatttcattgaaatggaagagtagaattcatagttttttttactaaatcaccgggagagcttccccacccgaatttgtcatttcattgaaatggaagagtagaattgctcaagctcatgtaacctacatagttttttcttttactaaatcaccgggggagcttccccacctgaatttgtcatttcattgaaatagaagagtgcaaggttcattacattgaattgagagattggggggggtgatttctttctaaatatgaatttgtcatttcattgaaatagaagagtgcaaggttcattacattgaattaagagattataggggggagattttttttttactaaatcaccgggggagcttccccacctaaatttgtcatttcattgaaataaaagagtgcaaggttcattacattgaattgagagattggagggggggagatttctttccaaatatgaatttgtcatttcattgaaatagaagagtgcaaggttcattacattgaattgagagattatagggggggagattttttttttactaaatcatcgggggagcttccccacctaaatttgtcatttcattgaaatagaatagtgcaaggttcattacattgaattgagagattggagggggggagatttctttccaaatatgaatttgtcatttcattgaaatagaagagtgcaaggttcattacattgaattgagatattatagggggggagatttctttccaaatagaagagtgcagggttcattacattgaattgagagattgtagggggggagatttctttctaaatggttgcatacaggaactccatgcctgtaatgacccgcctctcccaagctctcccaggccgggcccgcttacatcggtcatagactgccctcacagaccaacacatgtcttttctacacactttgtcctctctcgggaagaatttcccgatcggccacccatcctgaaattgctcggggccaagcacgcttaaccttagagttctttcgagatcggcttgcggaaaagaagttgcagcttgttgatatgagtattctattaatcctattaagccctgggctggatgtcacaataccccgtcttcaattgatgaaacagatgcacatcctaaattgtcggttgcactcctattttatcctagaaactttttgcaaacgggcataaaaaacaaaggtggctggccgtttttgttccttcattggagatgtcgcaggtgctagtgggaacaatgtttttcttctgtaaatttttctttgtggataggcggtgcttgacaaggagccacacaaacaacttcactttcagtggggctctgcatttccagatagtatctcatagtggagagacaactccaggaggtagctgatgcattgatgataaggtacac

SEQ ID NO: 14347 - DNA, 39417 bp, Oryza sativa
  unsure (1)..(39417): unsure at all n locations
cttatcaatgcatcagttgccttcaccttgcgggagatagtctcatggttaaacaaaggtcaggccaattccatcctgcggtggagcgctcggacggagaggacttgaaggacattgacccgtcgttgaaaggctgggcctttggcttctcccagccaatgcagggggctggggcatacgcgcgggtcgcagggtaggccgtgcgaggtggagccgaagcagaagccgccgccgacgacccggacgtgttgtccatcacaagtgagccggagatagagagaccttgaacgctgccggcgtggcggcggacttgttgggcaacggtccatcgaaaggcatgtccttccgcgtttccgatgaggaggacgcagtgtaagcccaaggaatgtggcaccgacgccgacgaggacccgttgcccgtcagcccaccagtggggaggtcgtacgctgacgaggaggacggtgagaccgacgggtaggcggaggagcgcggcacccacgaagaagctgatgcagacgaggaccggttgcccacatttcttggtcctcctcgggggcgttcatatgccgatggaggaggccgacgaggaggagtgcaggtgcgacatctcgattgcggcgacaagggcacgttgagtgaccggaggagcactggactctgaaggcgcgcgtggggagttggatgcttggagcgtatgtgcgtgtgttggggggatgactgaggagacgatggggaggaggcgcgaagtggaagaagagggggagacgagtcgggggctcgggccctttttagcgtgtgctattgcattccttgttgcgatccagtccgcttcggtgttagggtttcgagtcctatgcatccattggtgcgggtgcagacgccgcagcctctgcaccaccgccacgcatctaacgacctcatcttgtttatgcttatcaaccaaaatttaacttttcaataaagttgattttgagatttttttaatcatagtttatttttcagcctttgcttgtaggttgttaaagacatgtatataaaagtttcatttacaaatatgtcatttcgctttttcctcaaattagtcaaacgatggggctgtaaataatctcaaccggtcaatatgccagaagcaccacatcctaatagttgatccgcccatcgttctctcaattggctgaagatctggcaattcaggcggtgtttgagatgaaagattaagttgtcgcttgtaaaacggaaaacctattagcacatgattaatttaagttttaattattgcaaacttgacaaatagatacatttgatattttgaaacagcttatatataggaagttttcgcacggaacgcaccatttagtagtttgaaaagtgtgctaacgaaaacctagataaaatttgaatcttaatgaggaaagtaattatgtttataccttgtcttgctcatgacaacctttttctgtacgcgagtacgtcgtgatattggtggacaggaatcaagctgaacacaacctgccgagtgtgtaattggatgagaaccacgtacatttatatactttatatgcaagaaggtgatccatggatcttcatcaaacccaggtagagttagagcaatgtatgtcatgtaggggagacggtaaggaaaatttggggtattgatttcaaattaccgacaaaaatctttgtttagtttggagatggtggtcggctcgtaacaaggccaattcccgaatgagagtggagagtacaaagccgaagttacttatcattatgtgcaagagtttgacaaggtttagttgccggttggattccttcgacgcttgatacatatagctgaatgcgggtggatcattccacatgactactagaagaggaggacggggtttcatggcgtgtgaccacaagcgccaatttttgaaagccggtgttggtaacgtccttagagcatctatcgttctacacgccaatgctttgacaacgcctattatgattggaacaagctgcagagtgggtatgcctcgtggggtgcttgaaacatattccctcctgtatcaaatatattgatgtttgtgggttgtgccctttggatgcaaattattgacgttttggtatttgattgtcactttggactgctatatccttgcatgcatgcaaggcttgtcttcagtagctcatcaactatagcaaggctcccaacttcccaagcaatgacacattaactccagctttgaaactaaaggctatagccacacaggtcgtatgggagtttttgataaaagagctacacagaagtttttaataagggtaaaacaagaaataggcaacctaattgatcacttcttggtaagtgagatctgtccaaaacatcaataaaatcgaaaccggagagagtatgttgctaatatggaatgaactctcacatatgcagagaatccagagatggatggaagtccaaagcgatgcctttgccaatacaaatgctaaaattcaaattttagcaacgaatgataaggcaacaagcatacagtggttaaaaacatattatttggcaatgcaaaacaattgacagaagatatataccctaagttacgttcagcgagatttgttgtaatggtcaactaaaatttggatcacctaatatctaatttatctggataaaaaaagtgtagtagacgcatacacatggtgatgggatttattcggacatgatttgatcaattcttttcaaaaactgaacattacaccggtcgggtcccgtctcttggtcggtcgttcccgtccacgcgcgcaccaccgcaccacccagacaggcaactgacggaggcataatatcctagccgtccaatcatcccgaaccgctgcatcctggccgtccatccggacaccgtccttgtccctgcaaagcttcttccgctcaagaccaactttccacgacccaaaaacctcctcccccccttctcattctctctcttctctctcctccacctccccacctcctcgcgatctccacccccacaccccacccccaaccccgcgacccactcccaggtgggccccacatcgccgccggcgaccgcgactcatctcctcggctcccgcgccgccgcgtccgcgcggccatgacgacctctcccccgccaccgccgcccgccgaggtaatcgcgcgtggggttgcccctgcccttcgccccctcatcctccctccgccttcgcgcttcccgctggctcgtgtgtgtcccctcgccgccgccgcatcggacggcgatgcgggtggcgtggtggacgcgggccggcgggtggtcggctgctgtaggtcttcgggttggtttctttgtccgggttgtgatgtggaatgtggggatgggcgtgtccgcatacggaattctagggtttgtggttttgctggctttgcctcgggcttggtagtgtggatctgaggcgagtctcccatgtttattttttgcgcagcagcagcagcaacaggaggaagaggaggtgctcgtgccgcgccaggagttgcccaacggaacgcagccaatggaaggttcgattcggtcatttcgcctcacgattacctgtacatgcttttgtctttctgcgtataaggattattatttggttagtattttacgttctcagaatttgtactgtgtcaaactactgatctatgttctccgcggatgcacaattccaacatgtacgtttgtgcacatacatgatatatttcttttgctatgtcaatctggttttatatgagctttagggtttgctaattttgtttgtttttaatgcaaacatgacgacctcaaagcttgctctcattttgtgtggtgggttgcattttactgtatctgtatgcagctgttggtatgtgtaggttgagtaaaataatgttcagtaatgccctttgtttgccatatctgctgattacacttaatggatctcatgttgctctgaattgtcatgccagttgtgccttctgagccagccgccactgtggaaaaccagcagattgaagatccaccaatctctagatttacttggaccattgagaacctatcaagagtgagcacaaagaaactctactctgaaatttttgttgttgggggctacaagtggtgagtgcctactgcttcttttgtctgagtttgcgtgctatgttgatttctgcccatcgaaggggttactgtcgggtgattgatggaaagtcattttgtttgcaggcggattttgattttcccaaggggaaataatgttgaatatctgtctatgtatttggatgtggctgattcagcagtcctgccttatgggtggactagatatgcgcagttcagcctctctgtggtcaatcaaatgcacaacaagtttacaataagaaaaggtgcattcatcatctatgcctttttctttatttagtcaattgggttgcgaaaagtattttaatctgaaattctttcagaaacacaacatcaattctctgctcgagaaagtgattggggttttacttcctttatgcctttgggtgatctctacaaccccagtagaggctatcttgtaaatgatacttgtatagtggaggccgaagttgctgtatgtaaggtggttgattattggagctatgactctaaaaaggaaactggttatgttggtctgaaaaatcaaggtgctacttgctatatgaattctcttcttcagactctgtaccatattccatatttcagaaaggtacaaaatgtagttttactggttatataattttgtacttaatatatttgtatggtgctaacagtagatagtgcttgtcaggctgtttatcatatgcccacaactgagaatgacatgccttcgggaagcattccattagctctgcaaagtctcttttataagctgcagtataatgacagcagtgtctctacaaaggaactcacaaaatcttttgggtgggacatgcacgattcattcatgcaacatgatgtgcaagaactaaatagagttctttctgagaagttggaagataagatgaaggtttgacatctgtaaggtctttccttttatgtattcggtgttgtttttcgagtagtgtaactctgactgaattatgcttgtaaattttgattcaagggaactgttgtggagggcacaatacaacaattatttgaagggcatcacatgaattatatcgagtgtatcaatgtggatatgaaatcaactagaaaggaatccttctatggcaagtgattgtgttatcgcatcatggtcattatgtccaaacatgcccctttgacctgattggtgtacactccaatgcagatcttcagcttgatgtcaaaggttgtcaggatgtctatgcttcttttgataagtatgtagaggtggagcgcctggaaggagataacaagtatcacgcagaacaatatggactgcaggttagatttttgggagcttctgatagctaaaccaatttacgctagagctacactgtcattctccctctctcacatatatgcacacagacagccacacatcatgtatgttatagtacaatggtatctgtatgtgtatgtttaggttctaggacagatgttgaaatgaaaagactgttaaccagatgaacatacatttttttatttcatagcaaaattagaatctcggtaaccttgtttgaataagaattaacatggtttcggagcaactcattgtgctcaacttaatagcacaaacatcaaactcgtgattaatttctcaaagcatagcatggaagttgaaatgaacactattctcaatatggattaaagggatcttgggaatttcaaattcaaagaaagaacatgatgggaatctatttagtgtttatacaatctttgggcgcatttggaggcctgtctggatgaacaattcatgttatctggcaacagagaaaaacatggtactgtatgggctttttattcagattttttttcttggtttcaggatgcaaagaaaggtgttcttttcatcgacttccctcctgttttgcaacttcagctaaaacgctttgaatatgatttcatgcgtgatacaatggtaaaggtttgtatcagtgccatctgctaagaagttcccttcatccattattgttttagtggtgaaatgaatgaacagttttgtggtaaaggaagtgcgttcttcttgcttccttttaatgcttatccttttgttcctaattctctatcctgctaagagtgtttatgctccattctgaacttcagataaatgaccgctatgagttcccgattcagttggatcttgatagagatgatggaaagtacctctctccagatgcagataggaatgtgcggaatctttacactcttcacaggtcagttagatattaactattatttcttgtgtacctgtgttccatttcgtgatttaaggtttcaaggttcttcatggctgaactgccaacaattatagagatggacttctggcctcaccattttacctatcctggactttatttaataatgatgcaattctattacaatttttatgtcactgctgtctttaacagttaatttcttgcagtgttctcgtccatagtgggggtgttcatggtgggcattactatgctttcatacggcctactctttctgatcagtggtatgattattttggttatcattggttcttttgtatataaacaacatgatcttatgtatatctgtgtcattggctatgcttttgtacaaaaacaacaatatcttaggtatatctttcatatgattggtttgtaaactttgttagttggtactaactgttatcaaccagttgctgcttacaggcttacagctagtgagattagccatgactattttagtatttttctgtgattgtgctccttactaatcaaactctcatgatttgaagtggccctttgagtacttttgttaatacatttatgtcttcttttgaaataccttttcagttcactgtaaatgttaatttagaccttacactgatgggttcttagctgagttcggtagagcttcttagctctgctaatcagctacccacaaagcgagatgggtaattagtgattaattaagtataaattactataaatttgaaaaatggatttgtttgatttttttcaaaaaaatctttatatacttttctttttcacgaaacacaccgtttagcagttcaggaagcgtgcttacagaaaacgaggtagtagctcacctcataagcccttccgaactcaccctgagtccagattagcaagtaggaacaaatacttgctctataagcatgatgcatgtcagccaccttttcattacatatttgtatgcttcttggatggcttgttgctacttctatgtttattatttgctgaacaaaacgtttccaggtttaagtttgatgatgagcgtgtaacaaaagaggatgcaaagagggcattggaagagcaatatggtggtgaggaggaggttcgttgccattttgaagtctgagtgcttatgtttgttgccgtagaaacattgagctgatcaatttccttttgcagctacctcagactaatcctggtctaaacaatactcctttcaagttcactaaatattcaaacgcatacatgcttgtgtacattcgcgaaagtgacaaggacaaaataatttgtaacgtggatgagaaggacatagcagagcaccttcgagtaagttgctacctaaggttttttagttattcaattcttcattttagtttagtctaattcttctgccactttcagattagattagaaaaggatcgtgaggaaaaggagcgtcgaaagaaggagaaagctgaggcccacctatatactatcattaaggtgtttagtcaacacgctgggcatgtcgaattgattgtttttcctcctatttccgttggttttgttttactttctatttagttatctaacatgttttggtactgtaaaggttgcaagggatgatgacttgaccactcaaatagggaaggacatatattttgatcttgttgatcatgataaggtcccaagtttccgcatccagaagcagatgcctttcactcaattcaaggtaaattacatgggttgaagactatttgcttgttgtgatgatggcatctttccatattctaattgttggaattgctacacattgtttgttgtcctgtacaaaactatatagttcaaggacccaggtgtgcctattagtgtggcacgctgttttgcaaaatcaagcttttatttattttgagtagatcaattgtctttttgtattttacaagttgcaagaaatgcaagtaagcttaatattctgcagtctatttattctccaagcagtttgtttgcatgccttcttctcaccctttcatgattagctgtacatgctgagcatgtgtatcatgcatggtttttagtgatataaagcagggatttctttcttgagtcttgacgcagctcatgtgcacagctatgttttagtttttttctttgtattacttgtcggagtagagttttgcagttgccaaactgattactcatatatgaagtgctttacaggaggaggttgcaaaagagtttggtattcctacccaatttcaaagattttggctgtgggccaagcgacaaaaccatacataccggcctaaccgtccactgactcctcaagaagagacgcacacagtaagatgaattaatgacatattgcgttgattaaatgatgcacagttgtagttgatgctcttgatttctagtgctcattcgtgtctatgcattgtgctgtgataatctgatgacgaattaaataagcaggatacagaaaatacaatggcattttctgtaatttatgccaagttcagttgctttgctgatatattatatgcttttcatggtggttcctgtttgtatttgtcatggtgcttctcttggatgctaaaattgggaatttctaagtatgatacctttagtctgtgccctttgaactttgattgaaacatcccacaaatgatgcatatttgagtatcttaattttgttgatccagctaacttgctcatttattatttcatccgcatgactaacacaccgcagtatcttttatttttcctggcaactgctatgtaatttgttttttattgatcaaggttcaccgttccttgtattgttaataaggatctgcttattcggattcgacactgaagttaagatcatattattatgttgctgtccttgttaggccaacctgatctgttttgggatttcttgtcaagctaatacttccttgccttcagcatatatttaagcagtgatctaattctgtgtaatggtaaacatgtggatagtaaggtcaacaactttgtgtaggttggacagctaaaagaagcagcaaataaggctcataacgcagaactaaaattgttcttggaggttgaacttggactggtaatagccttttccctcgcgcttttctgcatttctttctttattttcttatgtttggctgccaatctgttcatctactttcaaattgtaaagggagtctgctttaaatttttactggcaatgtaggaccttaaacctcttcctctgcctgacaagaccagagaagatatattgcttttcttcaaactctatgatcctgaaaaggaacaactgcggtacttctcataatttcaaatagccaactgtatcatcattgatttgtgttgatgttcttacttataccctgaatgagttcttcaggtatgttggtaggctctttgttaaggcttcgggaaaacctcaggacattctgccaaaactgaggaaaatggctggtttttcacaggatgaggaaattgaactttatgaggttgctttctttatcatgtaaaaaagcttgtctctgcaagatatgcatatcattctggatcagcatgtgaccttttttcccctttcaccaatactaggaaatcaagtttgagcccaatgtaatgtgtgaatatattgacaataggcttctatttcgagcttgccaggtatggcgtgatttttttttcttgaaccaataacattcttgtttctatgatattatctttacctggaatcttttgcgtacagcttgaagatggtgacatcgtttgttttcaaaaatctccaaagccagatactgctgaccaatatagataccctgatgtcccatcctttctggtgtatatacggaaccggcaggtacttgagggtgccccattcaccaatcctgaactttatgctatttgttatttacatttcctcaacttctcgctgcaatgttgcagtgaggaattattttacctctttgtccatgtttaattacaaggaatttcattgatgacagttcaatatttctcttcccaaaaaggaatgttctgtgattttttgcttacttttcttgttgtcttgtttgccctatttcatataaattttcttcagtagtcttgctctatatgcattgtgatgtccatcttgacagcatcaccatataatatttttgcattaataacttctgtgtgattcttcaggtagtccattttcgttcattggagaagcccaaagaggatgatttttgtttagagatgtaagcatctcgacatgctatgattagtgaatcttaatattttgtattaccactgatattttttctttgctgttttctgtataggtcgaaggctttcacgtatgatgaagtagtggaaaaggtggctcaaaaacttggtgttgatgacccaactaaaattcggcttacatcgcataactgttattctcaacaacctaaacctcaacctattaaatacagaggtgttgagcgtttgctggacatgctgattcactataaccaggttgttactctgactctcatctttgtggtcatttgtcgtttaatcactaaagcgaagaactgaagtgtgacatagctgttggcatctcttgtacagacttctgatattctttactatgaagtattggatataccactcccagaattacaagctctgaagacattaaaagttacatatcatcatggcacaaaagatgaggttattttcttgataccttctttttgtggtggaaaaacttaacaataggttgtttttgctttttaatcttaaaacatgttttaccaggtgtcagttcacagtattaggttgccaaagaacagcactgtcggtgatgtgctaaatgatataaaatcaaaggtatatttttgtaccccttatttatggtgtgtattccacattctccagttattctatttgttggttttacaaagtttaacttatgccctatgtgtgccttcggctattaccaaaccaggttgagctgtctcatcctaatgctgagcttagactacttgaggttttctatcacaagatatacaaggtgacacaaacaacagttctttttaatgccctcttagttgcagttggttccacactatatcatcgtctaacttgtatttccttcagatttttgcaccgaatgaaaagatagaaaacatcaatgatcagtactggaccctgcgtgcagaggaggtatattacctttgtgtccggttttacaagatcaattttcatttgttaagaggttcaatccctcaatccccccaggaattgatggatgccattcctttttctttctaggttccggaggaagagaaaaatcttggtccttttgatcgcttgattcatgtataccattttaccaaagacactcaaaatcagacggtaatggaattctgctaataatttatctacatatatagcttaaatggataactgcatatgcactgctacaaaattttagccactttgttgcctgtaattttaaattagtcgctgacagaaattcatccgagttaggtgtgtttattggattcgactctcttgttttttgtttctttatttcaactgtttgccagcatcagtatcatgacctatacattttattcaagatgaacttgaactgtgttgtggcttgtttaattgagtgttttttattatatatctgtttactatctaaacttcagcaggctctctacatgtcaaatcatctgaacacaagtgtagccatgtgttctttttgtgtcgagctatggatgtttccctttttatttttaattgtttgtagtacctttgtggctttgcaaaacgattatattttgcctatgaacagcatatttttcatcttcactttgttatatttaactaatcttcactgtcaaaatgattaaaggagtccttacaaaatcaatactcctatatccgtaggtagcagaagcccggttaagaagtatttgtaagaagcagcatcaggctcctgtagtcctgctttcgtcatgtcatactttctgcttttgtgtcgagttatgcttgtattttccattttcatatccttaaatgaatttattgaaaagaatgttataggctttataacacgatagatagtcagcttttggacatgggcgtatttcacttgctacccagcataaatactggcactgatgggaacacaatattgttagccaattttagcagttctgcatctaacagcatacttctatatctagtaaaacttatgctgatatttatcctgatttctacagcaagttcagaactttggagaacctttctttatggttattcgtgaggatgaaaccctttcttctattaaagaacggatacagaaaaaactaaaagttccagatgaggatttctcaaaggtactctatactattccacacttgtagataattttaaatttatgatttcctttatgttatagcgttctcctggaatcttatagaagtgatgtaattggaacatgttacctgccagttgtttatttgcctaacaccataagaacatcaattagtgtcgttcccaagttctctgcttctatccctagttcgcctcagaagtggcgcatcagatgcatcacttggttttatttttattattttgttgacttccgtttgatcatgaaatatactgagtggcctacatttttgtcatctggcggtcaacatgctagtttgatctctctaatattcggtttaaatgttgcatagaaagaatatgtttaatgaaacactcaactgcaactgcagtcctggtacttctctactttggtgcattcagataatgaaagttgtattgcttgatatcacacaaacatgatatcactctgctcttttagaaattcctataatatgttcgtaattgcctctattggtttaactgtttaagagcttgccatcagacacaacctgctgctgacaattttatctgttagccaaatgaacaatgttagttaataggtagagcaacctcaaatgtatttggaatgactgatacttctctaccatcgttagtggttaattagtgggaactgagctctaaattgaatagtgtacaatatatatttttttaccaaaatctcttcccagggtaattagtagtccttttacgtatctttggtgctgattgtgattaattatttggcttgtggcgggtggtctatggcaaacatacatatgttatttcttgcgtgcttttgctttctgatggttttctgcttgtgaactgtgacagctagtgtaatgcatttccatctttgatgtagatttgctaatgattaatgtggttagatcggtttgagtaatgtgtttgcttaatgtaaacatgcactgctaagcaatgttctcatctccttttgtagtggaaatttgcctacatatcacttggtcgcccagattattttgaggattcagacactgtagcttcaagatttcaggtacaatattttcttgcttgctaaacaatcactgttagtgcttaatttggttcacatttaaactttttttgcttgcttatttagcgaaacatgtatggagcttgggagcaatatcttggactggagcatccagacacggctcctagaaagacacacaacgctaatcaggtacatccttggcagattaatacggatggtcatgggatgtctgcccctagttggacaaacccgagagagaattgtaacctaccactacaactatttcttttctgtttctggaatgtttgctaattgcatgttcttcatgcagaaccgccattcatttgagagacctgtaaagatctataactagacttgagaaatttgagtgacgtgccgccatccaacaccaagcaagggcctgaaaagtgctggcttgaataaattgtgtaccataattgatggtaggacgggttgctcaggtttttcgatggagctagaaagcatgcatggtgtttcctgaggagacgttttttagtatctgaggcagtttctcatcttccgcaacttgccccagatatataaagttgtgcagagatgacccatcgtctttcatcagtagataaggcggtattttccagtagtcatacagttaaaatagctcaagttttcttcgttgatcacatggttctgcagttgtactaggactccgagctgtttatacctgttgccctgtaaattatccatgtacaagggtttttcttgctctgacggcagtcaacacggtattgtaattccagctataaatatattgttgcctcttatatacttttatctgattggcagttcgctatctcctgagatcatttggagtacatgagagctttcaggaatcaggactggctattctgtgaacgaccgctttttaattaaacaaacatattcctaagcctcgtctttggacatttggggctttagtctcttacctcgttttgattgacctcaattccgactgatacacgtgtgacaagtttgaagaaacccacatttcggccttgccaaacaaggcttatgtggccttcaattcgaacgaggctttactcttatgaccttccaggctccaggctggacttgttttcttgggtataaagcctcgacacagcgtggtgagaaatttcgtatgccgttctcttatgtcctacactcctcgctttgtcatccacatttagatttttttttttttacggaggttgttaacagatcacatcgtagctgccgctcgtgttgttcctgaaattgaccaacgtgtactctgacgtggacgtgggtccaggattgcagctagagattgtctgctatggtaaatgtgactactatatttaaatttatccatattattcactaataaattaagagtcaactcatacaatatgtcacatctagtaaaaaataccaatatctctaatactttcacaccattcttgaaatttgtgtggaggttatctcttgatttagagatggctcatcatctctctcctcgcttctctccacctcatcactcaatccaatgtagcacccttaggggcagcatatgtagcattatagcacttgcccatagggcaaattcagtccacacactagttttgcaggacccatgcacaaatttttaaaaaccagcagcgtccgccctccctcacactgtcacacaaattgtcgaagctataataaccacatgcaacaaatattttttttaatggggtaagataactctttggctgaggtcggttttctgttaacttcctccgttccgaaaaaaggcaacctatgtggggatttgacaccacctaagacaaaatatgtccagatttattgtcctgtggtgtcaaatcatcacctaggtttttttttttacggagggagtaacaactaacggttgctctcacaatgtgtttagttcgattttttgggcgcatgcgtcgttttcacctcattggaatcgcccttagactcgaccaacgcactgactcggaaattgcacactgtagtattccctccatcccacgtgaccatcatatataattttttaggttatccctaaatgatattagtatttattcgctaaatctatggatactgatgtatgcatccatgcacatgcacataacgtgttacaatcaacatgcaatatcttggtttgctagtagctaggaagtagcgggtatggtgcatgtatcgagtttgttaccggagtaaatgtagtacgagagagttattagttttccctaatcttggtgcactcttataatgtgatgatcaattaggacagagggggtagttttatccttctctatctctacggattactttagttcccctttgcatctttgataccaccaccacactgcctattcgccaacttatcaccctcgtccccgagactactgctgcttctctgctctgtcaatccccaaatctctgtatcccttcacgaattcttcgcacattaagcaatatgattggggatgtaacacttgctctgtctgtccataacaaagtagtcatctcaacccgccaaaaccccatcaccgattgaacaaagcagccaaactgaccggcctctgtaatttagccccaatctgctcggccatgcttagcatgcccctcctccataccaccagcatgatctacacgaagaacctcacagccggcctcccggatccgtcgctggacctgctttaccccggtgagctcatcggcgttgccggcaactaccaccaccaaagatgagtgaagcagttcattgggtaaatgtaacatgtatagctgctagttggcactaaaagaatcaactgatcatttaccaatagtcaaggcaagagcacttcccttctttcatatgatggaacctactaccatctctcacaataatctccctctgaaaaaccattgtcaccatcttactgaactcatggcaatccccacagacacgaaggttcttgacgatacggattgggctgccagcttcaagaactatgaagccataagcaattgccaatcgctcgctgtgcaccttgaccgcgtgcaccttctcttcctccccaatgtcatgcaatacagatgacacatccggtacataccctgcctctgtcaaccttttgttgatcatgtcaagtgtatcatagatctgcacagaatccttgtgataagtgtctcctactagaaatttgtgcaccttcccatgcgcttccatcaagctccagccggctgacttgttggtaccgcgactagacatcaatttcctgacttccctgacttcatcccatttgtttgcctttgcatatatacctgagaggaggacataatagccagaatgagttggatccagttcaattagcttgttaccaacagaaacccccaaatccaccaggccatgcgtcttgcaagaagagagtattgtgccccagagaactggatcaggtgcaatatgcatcccttcgatcaattcaatggcttccggaacaaggccagcacgacccagaagatcaaccatgcagccataatgctccatttctggctcaatgcgatatttctccactatcagtttgaaatagcgtcgcccctcagcaacaagaccagaacggctacagccattgagcacaccaacaaaagtcacatttgtaggggacagaccctcactgataaaccgctcgaagagctccaccgcatccctccccaaaccatgagcagcaaggccacagatcatggcgttccacgcgaaaacatccctcctcctcatgccatcgaaaacctcccttgcaaccgccacacacccgcactttgcatacatgtccacgagtgccgctcctacattcatacacaccggcattcccgacctctgtaccacattatgcacaaacttcccatgttcaagcaagcccaaccgtgctgctgccgacaatgccgtcaccactgcagcctgattcggcctcacgccctgctccaccatgttccggaacactcccagcgccacctccagctcctctttcttcacatacccgcccaccagcgtgctccaagaaatctcatccctcactggcatttcgtcgaacacctcccgcgcaacggtcatcatgccagctcgcacgtaccccgcgagaacctcgttccacgtgaggacgtcccgcacgcgcggcagctcgtcgaacaccctccgcattgcccccacgtcgccggagacgccgtagaagtgcaccagcgcgttccgcacgaacaggtcgcccgcggcgcccgccttcacggcgagggcgtgcacgtgggagcccaggaaggagcaagcggaggcggagggtcccgcggcgttgaggtggttggagatggaggcgaggaggaaggtgaaggagtgggggttgcggcgccggaagcgggagaagagggtgagcgggagcggatgcggcagcacgcggaggaggttgttggacgcgaaggcggaggtggagttggcgcgccggaacagcgcgagcgggtaggcgtagtggtcgccatcgccgccgccgtcgtcgccgcggtggcccggcttgtccgggagaaggcgggggaggacggcgaggaggtggggcatggcgcgcgaggcggcgagcccgaggacggcgagtcgggcgtgcgcctgctggacttggcggacggtggggctcggcggaagcagcgccgcaaggagctccctcgcgtcggcggcgcggcgggcctcgaaggtgggggctcgccagacggcagccgccgccgccgccgccgccggcggtggcgcgccgagctgcatggacgaatggatgccctctcgatctacctcggcttctcccttcgagaagtaaagatgcttcacatttgatctggaccgtctgatttcgatcggacggtgctgattgacccgctcgggattttattagccccttgcaatttgtaaatgtgcagtttgaaccattcagattcattcaaacggacagacaaaatgcatgagaaacacatcgtcagttgaactgatgtccctttgaatgagaataaaaatcaaactagaatacttattacttatctaaaccaaggaattcgatcaaatctccacgtcaaaataagtctagagaaggacgatgggtctgttcactttgatgtcattttcaaccttaccaaattttggtaaagttgccaaaaaaagtggctacatttagtttgctgctaaattttgataactatataagaaatcctgccaaaattttggcaataccaaaacttggtaagttttttttttcatcaaagtgaacaggcccgatgatttggaaaagtttggagttgtttgcatattgaaccaaatttattaagggcatgtatctaaacaaaggaattcgatcaaatctctacgtcaaaataagtctagagaaagacgatgatttggaaaagtttggagttgtttgcatattgaaccaaatttattaagggcctgtttagtggatgcttcgagtagctacagtttctgatagaatcagaagttccccatacaatttctaagaagctatagttgtaaaatccagaaaatgaattagaaaccaaccgctaatcagaattttgaactcccccaaaagcccaaacaacccttaaaaggtgtgtttgaactctctagcacacaaagcgaagcacatattagcacgtgattaattaagtattggctaaaaaatcttaaaaaataaattaatataatctcttaaagcaactttcctataattttttttaaaaaaacacattatttagctattcggaaaatacgcacgtggaaaacaagattggtgaaattggcaacattgactttagaacacagcccaaggcattaacccaccaacatccggggacacgatcttgagttgagtttcctactgacgacaagttaatgccaactacagtactaatcagaatctccatctcagttacaagcatggtgaagagttaatagagttgtcgtgtctccctaccacaagaactcagtgagatggcaacgatgcatttggccattcccagagaagctcataaggttgatgcagctctccctcctggcaaacctcatcttgacccgacgccattcttctgaagacagcgatctgggaagcgaagcctggttcatcgcctgatccgccaacgccactgaactcgacgctgtagttgtgcttttctgcgagtccggtagcccagtgctggaactgggatcttgtccactcgaacttgtggtcatggtttcggaacttgcaaggaccagcgttttcttctggttcttcttccttgtttggcatagctgatctctggaggatagggttgtattcatagttgggtgttgaaacaatcagcaccgtagggcagaacgaactcaagacgacgtcgccacataaacttgcttggtcctcctctacgtgctcaatcacctgcaagtagctttggtcagtcgaatagcatgtccaactaaatctaacgtttgagagatcaaagagaaatccacatcagcatttgtaaggatggacttcccactgtactactatgaacaaaataatgaatccacatcagcatttctaaggatggacttcccattgtactactatacaaatgtgattaggctatgtgattcttaatccaatcaattaatcgtggtatccatgtactagaggcaattgagaagacagcagaaacagttcaggagtaactgacctcaagacaagtgccaatgtcaaatctgtataagcgagaatcaaaatccgttatagaaccatcatagagcacagccgttggaacacttgtctgcatcaacgatttcttgctcagcttctgatgaaggctctgcaaattcagagagatgaaaggagtcattgccaagcattggagagaacaaaagggatggtttaaagggtgaactaactatcaacagtcatcaaggctctgttacgtgcctttgctgctcgtgtgagacccttccgagaaatgtcaacaccgacaactttttcaagggttgttggatgctcaagcaatgaatcaagaaggctaccagatccacagccaaaatcaacctgaacaaatttacttcaatagtgataagctaatatgcttggcaaatatggaagtaggatgagaagaatatttaccaatgtggtagcatgcagctcattgatgtaccgaacagcgaattccactctttgtttagataaaggaggattaaacaaggctttttccattctatcttctaatggttcagttacctgcaatacctttacagagaactccaagaagcaattgtctgcaaggatggttaaaacttgagcatagtgcttcagccaaattcaagctggtaatgaaaattatcagactgaggtgttaagattggacctcacctctagatatcttggaaaggtcatgagaaaactcattagctgcagcaaggatcaaatccttaggaggcaattcagctatgaaacatgcgctttgattaactgacagctgactcacgcatgattcaatctgattcttaacagccccagtccctatctcaaactcaaactcattgttgctttctagcgtatatctgtttgttttgtccttcaccaccaaggaagcagtatagcttatgcaagtcaatgatccatgggatggaaaaacaccagaatctggaccatcaatgtgtgctaaaactgcattgttttcaagcttttgttttgaggtatccatagaaagcgatccaactgtactgcatgcacttgagtcatcacctcctctgttgccataaatagataagaacatggcaaattcatgcaaaaaattatctggacatattgtgaagccatcagtgctcttagaatgagagagcttcagtacatgcttgttcggttgcttgaaataactacagaaccaaatcaacaccttcaatgaagaattgtgaatggcatcagattccttgctccaagtatcagctgtcgaatactccaataaaagctcctgcttctttgaatatattttgacatcacatttgaacatatctgggttttccttgtcattctttccatcactagcacactgattttcagcattctttagcacgtccatctcctcggagcttacaggtgatcctaacactttacaagaggcacttaccctattgacagcgaagtagggctctgctagtctgtgaaggcgacaaaatgagcagagaagatctcgtggagagagacccttccaactagaacgagaatacacagatggaagctctgccaccagaattgaatccctggatatcttgtaattcccatctggtgatttgcccagaagaatcctgagttaccaaaaagcaagttattcagaagaattagaaactaagatgagaacagaaggtgtgcctaaacaatagagaaaatcaattcaaatgatggaagagtagtagtcgagtagatgacagtgtgaagaaaaatcagatcaagatctatctacaaccagatgattcttataaaaaaaatgaagtatgcatattgaattaaactaaagtcaaaatatatctcatacaagtgacataatcaacaaatcgatacctgtaatagttggataaggtaacatcttcagtatgaagctctgagtctctccttgtatatccaacattagccaaaattgcatctccataaattgtttgaccagaaatgaaggaagctcgcttatttattaggctctccatatagccatctccaagagaagaaaccacattgtgtgatatctcagaaacaaattgcacatttggagctgagaaatatagccttatctcagaagatgctttgccaacagttctgcagtgagacaattttaagattatcagcacaccaaaaataatgacaatggtcagaagagaaggctcggcacaatactgaccttgaaacaacagcgtgggaggaatcacttgcagagagcttagacactatatcacccatgtaatgttcattatgtgataaagtaagtcttattgtcttaggttcatcctccatcatacaaggaacaaaaatcccatctacttctatgggatccgttatgccagaccaatgctgaagtgccaaatcaacagcctcaggggaataaggcttctgactccaaatccagaagttgctatcactgacagagacaccaggggattttttggcagcattatagattaatgataaaaccaagagaggatcaaactccgctttggggtcaataagtttacacagtccaatgaccttcacatcacatgcagcaattgctgacataggaatcataccaaagcggtccccggttcttctgaatgtcacacacatgtggccaataagaggatgagatgacgaggggaagttctgaatagaagagtaggaaaaaaaaaagacagacatgttagaaaaggtcggttagaacaaattaattgtttttcagttacatctgatgctctgaataataatatgattatatagccgcatgcttcaactataatcctgtattcttgtgtacacaaaatgattcagacttcaatattggtatttggtgatcatgtgacatgtctatgtaaagaagaatgtgtaccaaagcaggttgaaactgcagaaacatagaaagcaaagccttaagggaaatgttttttgtagtaagctcgatggtccggtctctttaccacatagatacccataacctcttaattccagtaatacagagtctttcttaactccaattataagagttgcaatggttatgatcatgcaaccctacgacatacacagcccatcataaggatcctatatccctattacactcctcaattgccagcagagcatagcattccactcaaatatgtaacatcatgaatatgaaaacttccttttgctgtagccttctgttgtgtgcaccttaatccctgaactacaatgacacaacaccaagatcaagtggaaaatactaacctcatctgtaaaaaaaccagatatgcgagcaataagttcatcccatgcttcttcaggagtactgggagcatttgcagtgggctgaataccaagctacaacgaagacaataaaagaaatggtaatcaccataggtccacagcatgaacaacatttcacatagtaatgatatttcatatatcataggtacatagcttatccgatagagaaatacaaaggagctaggttactgtgcagcttgatcactaacgtcgatggcattggtttgtcagaacagaaaacagagggtactatcaaaagaaatggcaacaaagacaatgagcaacacaattaggtgctcactcaggaattgaataaccaaactaaggtgagatttgactatttgagacttgagagaactccaccttgcacttgtgacattcctcaattcctcataggtgagacacaattgctaactgaatcgtgcattgtgcatatcgccgtatctaatcacaaacttaaaggctacacgataaatctctatgtatatggaagatgattttgcaactacacatgtaaagcaaaaaaaaaaaggtgaagttgcatgccaccaccacaatgctcatcaataccttgtcgagggcaatctgcgcggcggcttgctcggcgtccttcttcctgacgaaggtgcccggggtgacgacggtgaggccggggatgtcgagcgagcagcggtagacgctcctggtctgctgcggcagcgcgaggccggggcagccgccgtcgacggcctcccgcacctcctccacgctgtagcacgccttggcgccgtacttctggtggatcaccgccttgggcgtcaccgtcggcgccgccggcatccctcgcttcgatcccccgccgcctctcagccgcaacggcatcaaacgcccaaaaaaaacaaacaaaaacaaacaaacaaatgcgattggtaacgaaggggattttcgcaatcgatcgacgcaggaactgaggcggaatcgggagggggtggtcgccgaattgggggaggcgctaaaccccccagaaaaatcggaagcgaggcgaggaggattcgaggagtcgggtgaagtggggtttagggaagggaagcgagggggagtgtgtgaagggggagagaaggttttgatggcgctgcatccaataatacgccttcttgttaacgttagcggaaatgcagaatctctttcgagggtaaagtgtcccttgagaaaatctcgggcctatgtcccgtaaaaatcgattgttatattattttctgaaaaatacggtcgtttcactcgtatataaatatttaacgcatcaaagtttgaccaaactagctgggttttttaatatatgcatttgcataaaatttttaaataagataaatggtcaaacattttttaaaagttaattactaagaaaagagggagaacattttatttaaaaatttagtgcaaatatgtaaaaataaaagtcatactaaactaattttaataacaaaataggttaaaaaagtgatatttacataaatcttttgaataaggcaacggtcaaactatatggtctaaaactattgtgtcaaatggccgaagggagtaaaatgttaaacactactctatatttcacagttttttttttcaagtggtttttgcgaatgcagtatgcatatactcttgcttgattggattttacattaacgaaactgaactaacgtgagtttaagcaaaaccatggactgagatgctattgcctagttgcacatagaagttaataatgaaatactccctccattccaaaatataaggcataaccaccctaaccaaaagatcaagaaaataattattattattttgtagtttcgatcattctaataaatacaatgcatgcatccaataaaattagataacataaaagtagaggatttaaaaaaataataatttaatggagaagggatcacagttaattacctatatacatacatgttttatattatggaacataaattatgccttatattatggaatggagggagtactccgtagttctactttatagcgctgatgaataggttaagatcaaaacaaactacagatggtgggtcagtgggtgagaggagccatcaacactgccctgatctgttgcagatcaagagcatgtttagctctttaatactcttcagttcacaacagaggatcctaaacagcttggactctgtgtaaagttagctagaatcccaaatctttgagttcttccctccatgagcaattgagttcctaatttccagtagagatgcaaaaaatcaatcaagctggtttgctaataccatatgctaggcttaacataaaaaatgataacgaggcaacagaaatgaagcggtgaaatgaacatcaggatcattcgacagacgacaggatggtaaacttgactctatttctaatacaactgaacatccaatacatgtcaacaaggttgttcacaaatttcacctaaaaacacgaactaccatcttaattctccagtcaaaatttggctcggtatatgcaagctacattcagggaaccccagtcagcccactacactatggatgttgatgagatcagcagtcaggcttcagcagcaacacatttagggctctgcttcatcattcaatttttctttgcctgtatccttggttttcctcagacagcggccctcaaatagcacttcgtacagtagccttttactcccccatttccaccagaagggtcctgcccctcctgcatgcttccttttcatcttgtttacttcagtggctacacatcgcaaaaagagattatatcaaaaaacatataaatcactttactgcagaaaacaatggtaagcagaacagtagtcctcagatagtttctagtgcacataagagagaaaaactaatctaacagtacaaatcagaacaagatcaaatatcaagttatctagataaacaagacacaacataagaaagaacaagatcaaatattgtctactaacaattagaaatacatgttcttttcctttggttgtctacgcgtgtacccaaaatagtatagaaggtgttgtattttaatgcatgctgtaaatttcccttgattcctcccaaccacatcattcactcactgtattacttattacaatatcagcataaagagctgcagcgcagctataaatatcagcacaactgaaattcgtaagagctaacatggctagtctaacatgagatcactcaatcttctatctttttcagcagtggggaagtgggaagcaaattgggcaaagccaacctaagagaacgcagtagaacctttgcaagggaaggtgaactttagcgtccgtttattgttttgagtctaaaagaaaatctattctcaagtaattctcaccaaaaggaacagcgcaaaacctctttggtctcagtgagactacacctttactataaataggtctctggcaagctactgttgggaacaatatggcagatttgggacctcacaactatagccagctgcaggaagaaatggaaatcatcggttgtttaacatggaactcaaacaatattatgagaatagcatctccaccggaaaagataaatttagaatggtcagagctaaagttaaaagatcaagcatgatctttaagccttaactcagtaataaaatctaacccataatctagttatgtgaagaatcagaaagttagcaccattgccccccaaaccatgtggctattagtgtccaaaaactagcacagaagtcaagagtctgattattctaatccttgtatccacaataaataagctactgatcaatatcttaatatatctagtttaattagtggcaatgttgattgcacttttgtcactcactatatctggaaaaaaccgaccgctgcagtgccagaactgatgcaaaggatggaactaaaactggccaaaattgctgctggatactcaggacttgtaagacagtctgtatgccctcctctgatggttcagttgcatctgtatcataaacaggactatccccaagtaggacctgcaagtgtcaaatatcatcaagatgggtcaacgacagtatgtcaacattaaaaccataacaactctcagctgaaatgaataaagcagctgcccgtatttcgatatctgcattatatcatatacataaaatgctgaattgtctgcaaatacaataatgcagttaattgaataaaaatggttatataactgcagaatgccatccatcatgttagaattttatctgcctagcactaaaagaaagaaaatcaaaccagttgcaacatatgtgttccttgagcttttgatatccatagggagttaggcaacaaaaaataaattgaatccttgactaatgccacaaacagaattttcattcagagatattgggacaattgctgccaaggagagttacgatgctaacgcagttgatcatacatagcttagttccttacctccttatggtatttataaattccattgaacaagaatgagatgttactgtgaagaatgcataccttaacaacttcagtagctgatgaggatatagaccgaagattgtatctgcaccaaaggtaggcaagacgaaaaaacattgcataagtgttgatgtggtattctcaaatctcaactaaatatacttgcacaaaatttagttagctgatcaaaataaaaataaaaaattaagatttagtgcctacaaatccaaaaactctaagcaggatgctgtgtatattaggtccaagatgacagcctacaggtgatcatctcaagcggatcaaatttctaggcattgcctaccttttgaatatatatttatcttaaattgatagaacatctgggtacctaccctccctcaagtataaccaacaattttccctgtgaacaagcagttagcatggacgccatcctagaatatccagcaggtgtgacctattaattaaagaggaagttggtcaaaattatcagactcagactgacatggagtgcattgaaatatcaaacaggacaaaaaaggcacacagacaagaataaattagcaaacaaacacgaatagtatcgaagttgagggttgcatggatgatatagttcagtctaacttgtgagaacatcagcatagttatcatcttcatatttgactaagctctagtatttacaaacacatatgacaaaccaaacagaacagcaatgcatctcacaaccataccagtgtaccactgactcaatgagtgcatccctaaagaagcaactgtgtatgagcttgaatggcgtttcaatgtggtccaagaaaaagtccatacatgagttgtgcagttaaaattagcttctaaaggagcccaaataacatgtaattttcctatatgatgtcatatgaaaggttagcctaagtttcacaagaagaaaatcctctgcaaagtctgaacgttcatctctaagaagccagttaggaggtacaagcgtacaccagaaatctagaatcatcaaagatttctaaaatgatgcaaaaatggaagtggaaaaaaacaggttcatgatttagagacaacaatcatgtgttagtcttacgaacttacatcacaacaacccagagggtcacccctcgctgcatcaaatcctgcagatatgatggtgatgtctggagcaaattctgcagctgcattcatgaaagaaaattcattgaaacgagaacatgcaatagcaatatacaaaaacgcaagcgggtaatataaggtattaaggtaataatgtaatctacataacaaggtgcctgtgacccaagtactttaggcagacatgttttacccaaatgaatagacaccctgtttgggggagctggagcttctgggagaagctgcagctgctagaagctcccccaaacagggcataaacaggtttttgttccaatgtgtcaatatattttgtctgtgccctttctaacaaggatctaaagttctaaaatgctaagtctcacagaagacgaagcacaaaaaaaattcaaaggagtccgcgtgagctgctcttgactttacaaattaaagataggtatgttccgggggacatgtccggtgaaaaccatcaaataagtgaaaactcgtgaaaaccatatctaaaagttttgtaaattcatgaaaaaaatactagagataggtatagacatgaaatacattcataccaaatctcaactcatttgaaagaaacaaaatagacaaatttgaggtgaatagtaacagaacactattcacccgaaatttgtcttttttgtttctctcaaatgaagttgagtttggacttaaaatttggtatgaatgtatttcatgcctatacctatctctagtaattttttcatgaatttacaaaacttttaggcatggttttcatgggttttcacttatttgatggttttcactggatattccccatgtttacgttgagaaaatattgttattagcaactttaagttgactagcacatatgcaaatgcccctattcaattattacctatcggaagcaccacatgcttaaaagcaaatatgtagtcattgtctccaacaccaccacggctccaaggtatattgactgagaatccttggccatccataactcccacctgaagtgatgcccatgcaagaagttacaatataaaacgaatcatcttagaactcaagtttccacatgctaggtcagaaactctgataaaaagagtcatgcaatctgtcaaaggagatgccccaaatactccagattcggttagccagcatcagttggctcaaataggatgtagttcactagttcagagttcagatgtagtgttgtataaattatcttcaaatgttaaagaaaatcacctcatttgctgccccagttccagggtagaagcttccatcctcatgccgatgtaatgatatgtacaagacctgaaagaagaagaagaaaacttatccatgtaagaaataaggactcagggaaagaaggtcaattggtggccatgcatatggaagtatagtaaaggactgcaaagcaattagcaacacaaaaggaagatgataactcacagaattgtccccatcaaatatctcctgtgttccattgccatggtggacatcctgcaacaacaattgagcaccactgatgagatggattaacatccatttgaggcactatctttttttgggggggtccatgatgccaacagaatgcaatggtataagttcaaatgcaaacttgtaactagcattacccagtcaactattaagactttcttggcaccagctctttgtgcagctaatgcagccactgctgcattattgtgaagacaaaaacccatggcttgtttcacccctgcatgatggccaggaggtctcacctgctctccggtagacacagtcagtatcaacatgcaaagtatatcaaaataataactctcaggtgtctaggtgtactgtgcaaaaaagaggtcgagaattgcaaatataagatgatatgcacagtaccattgcaaatccattgcgaacacgcccagatactatcaagttagcaagatcagcacatatccctgctgcaagtttggcagcacatgctgagtgtccatttgcataggtatctgaagtgaagtaactacaaatcgatcccaaaatgacgttatgacaatgcaaatctttccagcaagactagaacacacaagcagcaaatataatgtcattagcatgcaattaattatactaaaacaaacagtacagtacaaaactaaagcaaggtaattacaagatggcttttaagtatggaataaacacagtacctgtaaagcatgttctttgtctgctcaacactgtcaatgtgatctgaagtatggacctagaagtaagcacgattttgaatgtgttaggattatcgaaaagattgtactaaggacaagtatactgggggaacatagggcagcaaaaataattaacatgccaaactcttacatacccttaggagttcttccttagtgatttctcgaggaggtaccatgacacattttgaagggaagatacctgagatattggaaatatgagttaaagtaaaacttgataagcagtggcatagcaaggctatttcatcaacccatttcaattaacatggttgacaaggaaacagttttgtggatttgctacagcacaaatcaactattttcagtgtcgattacttgattagctaccatatgtgtttttggaaaacattgtataaatctgctagagcacaagaagtaacaaattaaagtctttgctttcaacaagatcagatacaccttttagattagctatccactaccatatatacttttgggttacattgggcaacacggttgcaacagtaagcaatcatcaaaacatagacagtctttgctttcaacaagatcagatacaccttttagattagctatccactaccatatatacttttgggttacattgggcaacacggttgcaacagtaagcaatcatcaaaacatagacctagattaaatatttaaacaagatcagacaatcacaaaagtttgtagaggtattttttatcacagttgctttcactgaataactaaatagaaaagatatctcaaagttaatgatagagtacctgcagcagcaagactggcagcgattgcacgaaggcggtcaggcctttctggatgtggatttggtttaatctctatctgataacataggaaatgtgagatgtcagtccagaattacagtggctctgtgctgatagagaaaattaggaggccaaaaaaaggtactttcaaaataattttttttggttaaatgcaactagttttgagaaagaattattttaatctatgttcaaagagaatataattagattatattgtttagaagcagatacagaaacaagaaacacttcaatattgtcatgttatacgaaagcacagaaaaggaatatttatttgattccaaattagcaatgtaaatgagcttgcaattgcaggtttctgttttgttctccaatgggattgaacaaatatctctcagatgaaacaactcataagcaatcaaacaagaaggttcactgagcacactaaggagcaattaagatttatgcgaatccttgctattaaacaatgggagaaagagagaaaagcaatggccaattttgatgtaggatgtcagatccaaacatgtcatatggtgctagtttatacaacataatcggaagttcattgcttacctcactatggagcaacattctttcatcaaaaccgacagctgtagatactgatggcagcgctgcataaaatagtgagattgtgacaaattaagaagttgttggatacacataacatatgaacaaccgatgtaatgggacacattctgtgcttcaaactgcaagtgtaaagatagctacaagtgtaaagaagaacctaaaccctgagtaaagaatgtaaagaagcacctgcgtcagcagataacaaagctgcctgtgcaagatgagctttgaaagcatcatatccaactaccacagatcccttaagctcatcgcaattctagagtatgagaataaacatcaagaaaaccaaaatcaaaataatgtcactggatgatctgaactaaaatttctaagaaatcatacggcattcctgattacactgacaaagtaataacctttacctgacaatgtgtaaacccctccatgtttggcactgtacagttcaagcaaaaccacctgctcaaagcaaggcgagcagagggttcccagtcactgtcatcatcctcttcatcattaaaggaaaatagatcctccagtgtacccccaggctgttctttgtcagactcttgaagcagatcatcacaagccatacagctttcattcttgacatgcagacaaccatcatggcctgaactgtcaataagttccgaccttgctgtagaaactttggtcccatctactgataaaggattggcatggtcggaatttaaattgcatgctccagagttctctttcaaaattttctcatcattatgactcccgctcaacgaggaaactccatttgctttagcatgtgatggttttccatcattgccgcttttgcttttgctgtggcaagcttggtctgaaactccacaactctgtcccttttggctgttgagtgacctcatatcagacgccatcagagcatgcaacgcaatctgtaattgtgatacgacaagatcagcataggaaacacaagagtggataagaatttggacttccgacagggagccctaagaattattaatagctgattatcacatgccaaatctcagtagcattattgataatcgattactacatgccaaacctactcacgccttatccaaaaaaattgccgttacgcacaaaaccataagaaagcagttaatgcatcaacatagctagccgccaaattcaacatctcctcatgaagcgcatcgacaatcctagcactaacgctcgcagaggtactttctataaatggggatgcggcgaaatgcatctcctgaaactactgcataatctgctcaaaacccttccaaaacctcagcgctcttccatcgcatctactgattctgcagcgcaatatcagtaccaaaacctcaccgcaaacctcacctggttcttcttcctcgcatagattcctcagaacacaaaccctcccaaccccatccccccaacaccagaaacaacccaaccgcacgctacggctaccctcgcagcccggacggcaaagctaccacgaaatcaccggattgaacatccgggccgcgcaaaactcggatacaaacgattcaaccaaaccctaacccccaccatccaaaacctttttctcagaaaaaaaaaatcctacactccccgactagctctccccggaacggtgaaaccgcgggcgaaaatcgaagaatccgacgagaaatcgccgtggcgacctcgggggcggaggcggccgtacctggagggcgatcccggcggcggcggcgctcgcctctcgcgattggatttttggaggggcgcggcgcggccacgggatgactgtgaagagcggctcgtgcgcttcgtgctcggctcgagtgggtccgtctctacttgcctgccatttttgtcacataaaccctaaactgtcacaaaattctatttagatccctaacttgtcagtttctgaactgggccagaacacttagggatcttattgataataacgttaattttaggggccttattgaaaaagtttcgcctaacccaagtgcgggtccataggttggcgagcaaacgcacgcttatctctatctggcatgaacacgatgataggcccagctccgtctccggcagcggccgccgccgcagccgtgtcgccgtcgtgttacgcgtcgccggcggcttcgtccgtgcgaagacgcggcgtcgtcggcgtcgtccggtgcgcgccggatagcgggcgaggtggagacggcggcggcggcggcgggaaaggcaagctcagggtcgggtctcccatcgtcatcgtggaggcaccggtgatgctcaagaccgccgcgtcggtgccgtcgctcaggcacaacgccggccaggtcaaggccggcgacgtcgggaggtagaactacgattccatccgatgcttattgtgatatgctcttctatgcattggaatttggaagtataatttcggaccaccgcttcgtccctgcttgggcggctcggggtgcgaaacctagccgccggagcgagcctccggccaaccgtgaggcgagacgggatggcggcggcgagttgtctcgggcgcggaaaaggtcgtcacaaggaaatcgtggtgacggttggtcaaatactttggctgatcagccaaagctacctccaattctgccaaaattcaatgcaaattggttagcttattttgcttaaatggctgatcagcgaaagcatttgccatccgatggaagtaggaaatccaatgcagtagtagtgatttatttcttgaagcttgaaaataggaattttgggcgaatatcaagagagtttcacaaaaatttgaacaaaacgaagaacatgacacagaaattcaatgcttagtgatactccctccattttcaactcctaaatgacaacggtgactttgttatttaaactttgaccactaattgctcttaaatagttgaactaaagcgaacaaatgtttcatgattatgactaggacataacacattttaatactataacatctcttctagtgtttgcaaatatttttaaaaacgaatggtaaaagtttgaaagcgaatagtgtcagttgtcagttatttaaaaatgaatgtagtttttttttgtttttttaaacattgaaaataggaatttgcagcgaacattaagagaattccagagaaatttaaacaaaacgaagaacgttactacaggaatttgaattacactgacatccatgtgcaattgtgcatacgtcgagcagggtgatggcgcggaagccgaaggacgtctgggccgtgcggctcgccatcggaacctacctgttggacggcaagtatttcaagacactggacgtcgacgacgacgatactgcatcaccagatgagtgagctgcaaatgcagcagcattacagctacggcatagcatgcaagattgtttgttagacagaggcacagctgcaatgttgtaaaagatccaggaattcacaatttttgttgagactgatgggaccattgtttcacacataacccctggcgtggtagattgcacaggaaatctggtatgaagatgaatcaacctgcgcctaagggcaaacgaatctcaatctcatcatgttgttttgttaagcatacgtacaggggtaggagggaatcggagacacaactacacatattgcacaaacagggaaaaaaatatatcccacgatcttctttttccaagttacaatcaagcacccttcttccatggctggatgacggcgacgacaatgatcaccactatgatgagcaggaggatgatggcgtagcacatccacttcctggagttcttctggagcttcttcgcgttctgtagagcactgacgccttgttgtatgtggttggtagcatttgaaaccttgaagcagagaaaacgaaaataaggtgaattcttggtgatatacagtttgtcttgcttccaagaacatgtataacttggtgcaagagtgggcaattcttacatgtgtctctatgttgttgatcatgtctccttgagcatcaaccaaaactgccatatccatgaatatctacaaggcaaaaacaaggaatggagtaattaggcacattaactcgagctcacaagcatatggattaaatcagattagtaaataagtgcttatgtcaaaaaagtcacctgctgcaactccagaagcttcctctctagatctcttacagcatcgtgacgttcctgtatctctgcaacagtgtccagtatctggaaagacaaatatggttgagattttagtactgtgaacaggcagaaccgcaaaaatgtagttggtccccaaaaaggcattatcccatacagaaagaaatgcatatattggataacatacttggcctcttccctgctgttggatagcttcttggaaaatttgctcacttcttccagtctctattaaattgtcaactgtctacatagtacaaagcaacaacatgagaaatagtgtaaatcgaagatcatcagaccacagatcaaaattttcactgtaaagcaaaggcatgaagaaaacaaatttaaccaaaagtcagaactgcagagatcctgtcattgtatacctcttcatcaggacgactaccagttactgtaaacacccttctttcaacgacatcacgatactcctgccggattgcttctctcaaaacctacatcagagggtaaaggggcattactcacaagtcaccactttaggggcattgcactagtcctagcaggtgttcatagtgactaagaattgaatcatagcagcagagacagctgatgaaagtacaaaccataacatatttcaccaatgtatttttttcctttttacttcaagtagatacaggtatcagtatagacacccactactcatgaaatgctatacaataaatcttatacttggatagcttctagcaatggaaaaacaatgtgttttttctctgctgctcaaagaagcatgtctaacagaccgagaaaatgaaatatggcagtagtttaactgtgtaatgatcgttgacggaatagcagaatcaccccataaatggcaagttaggtgttccagataaggaaactcagtacctgaaaatcatccatgcgctccttcaatttctttttcactgctctgtagaatttagcaagcatagtggatgaacaactattcatggctttatgcactctacagaaccaggaaaaaaaaacaaatcgccagtaaatttacccagtagtctgttctcttgatcgatctaccgcagatcctttcccacatccaggcttttgtctgtttgataagttctgtttcacatggcagcgaacagtgagagacaactcaatgttgctattgacaaatgacactagcacgtgagatggcttagtgaaaagtatagcaaatcctacaatttgttttaggggcactactaaatcataaccttgtgatacaagttgcagagaatgctcttatgaaaatataatgcatacgttggatagacatggtcaatttgttacttactgcagtgctatatgactgttgatgatttatatatattgtatatagagtgcagacacatgaaataaaaacagaatattacgcagatatggcaaattaatacaatgccattagctagcagggccaagtgacatacatctttttccaattcatcaacttttgtctttgccatgcgagcgattttccccacttcatcaatatctttctccatcctctgtttaattgctatggaaaaataattgttgcatcaacaataggtaaagtgggttatcaaaagtgtacaagaactttttagacaaggttaaatatactaaactaagtactcacctttcatgtcccttgcttttgtaaccgctttagattcctcatttgcagtctacaagcaaaagtaaggtgtatatgaaaattcaagatgctaaatgaattcatcaaaacttagacacaacattatatttctggtactacgaaaatcaatatcatcagaacaagacaaggaccagaaacagaaagaaatgaatggaagtgtgagataaataaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14348 - DNA, 2589 bp, Oryza sativa
  unsure (1)..(2589): unsure at all n locations
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacgggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 14349 - DNA, 358 bp, Oryza sativa
accacgctttatgattccacccggatcctttcatttaagacttggatttttattttatttaatccctttttcatttcttcaatgattaattgaacttccaattaatcattttggttgcctgtttttacataaataataagtaaaaaggcagtaggaactagaatgaacaaggcagtagcaataaatgcgagaatattgacttccataacctcttttttttcgcaataactcgggatgtaatcccatggagaggaaaaagggtatcctgtaaattcaaggggaggacttgcatactgataatactgactcaattcaatattatgaatatcggatcaatcaaatcgattcatggttgaga

SEQ ID NO: 14350 - DNA, 498 bp, Oryza sativa
acctagagtagctaagtgcggaagtaaaatcaacccttgttcatacatgggtttttctggtacgaaagggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtgcaaatagcataaagaaatgtaacca

SEQ ID NO: 14351 - DNA, 354 bp, Oryza sativa
atatttttactaatgtaatctccattacgagagggacaaatattcttatccgcatatctattcaatgccggaattccgcctgctattaatgtgggtatttccgtttccaaagaaagatccgctgctcaaattaaagccatgaaacaagtagctggcaaatcaaaattggaattagctcaattcgcggagttacaagcctttgcacaattcgcctctgctctcgataaaacaagtcagaatcaattggcaaggggccgaccattacgagaattgcttaaacaatcccaagccaattctctttcagaggaagagcagatagctactatttatatccgaacaagaggatatcttgat

SEQ ID NO: 14352 - DNA, 1227 bp, Oryza sativa
cggattgcacttttacccaatttgggaagctgcatctgttgatgagtggttatacaatggtggtccttatgagctaattgttctacacttcttacttggtgtagcttggtatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcgggtccctattcagtgctatgcatggatccttggtaacctctagtttgatcacggaaaccactggaaacgaatctgctaatgagggtaacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggattttgtatgtaaataggtatatgttcctttccattatgaatcgcgaatgtatggccaaccattgcgggtagaatgctagatgcccgggaccacgatactatagtgactttctcctccttcatattgaccttttctatttttgcaataaatgatgagctacaaaaggattccttttttttcgtgtcacagctgattactccttttttacattt

SEQ ID NO: 14353 - DNA, 13067 bp, Oryza sativa
ttctcatccagctcctcgcgaatcaaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagttttcttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagttaaatagatcctctttagcagaaagacgtatattccttgctcatcacttattcccaaacctcgtatgggctaatcgtttcatttaccatctaggaaaaatccttttcgttccgcttagccctatcgggtattttagtgataggttctataggaactgaacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctac

SEQ ID NO: 14354 - DNA, 8896 bp, Oryza sativa
aaaaagtagtattgaaaataaaaaaccaggttcttctttctggaaagacaatatttctttcatccttttgcattgaaataccaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagtcttatgttatatatggtaatcgccccgcctatagcggtaatcgccccacctatagttatagtacccaaattctatcttgaacttcctatttttcaaacaaaaatacaacgtttttttatttgaaaataaaaaaagaaaaataggagaaaaaaaaatatgacagaaaagaaaaattggagagaaaaaaaaaacccgagagaagcaaaaattactttcgagggtttagttatggaagccctacccaacggaatgtttcgcgttcgcctagagaatgacaccatcatcctgggctatatttcaggaaagatccgggctagttctatacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttcttttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtattctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtccccgcttagaaaaggtcaagcggataccgttggtattgccttgcgaagagctttacttggagaaacagaaggaacatgtatcacacatgcaaaatttgggagcgtgccgcacgaatattctacaatagcaggtattgaagaatcggtacaagaaattttactaaatttgaaagaaattgtattgagaagtaatctctatggagttagaaccgcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaagaaaaacaaaaaaagaattccattgaattgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaataaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagaaccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacacacaaattttcaacggatattagaaaaaaggttcaaaacttcatcagccactgggttgggtcgatttgccttgaagatatgaaataagaaaaatccagaatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttcttcgaataagaaccgcttgatgatcatttattgaatcggtgtaatgactcgacaaaatcgagagaaaaaaagttgttttttgggcaaacaaaattggaaggaagaaattttctttttttatttttattaagaactacttgaatttttttcagtctggttgcgaggtctgaatagttaatatgaatcatagtttcatttttttttcttgatccactctatctatttcgtgttccagatactagaataaataatatccgacgaattagaatcatcttgatagagataacaggtgctttctatgtattatcaataggagcaaattctaacaagtcacacactcatattccagagataccgaaaccaaaaaattccacggtcgaactaccagaatgtctagaaatgtagagcttaaagtagaaaggctcttttggatggaaaaactatgacttcgtagttttcgttagtagaaacctaattcattaaaattccgtccagtaaaacggaagaattataaatttctaaaataatagataggaataccgcgaataaagccattgcgacccccataaaaggagtagtcccccaacccggagctactttcccatattccgaattcaagggtttcaataaattacctacgcgagtttgtcttggtccaggtctagaactatcttcaacggtttgtgtagccataaattccatttaatgatttgtgttgactttgtatactattccgttgtagttgtaaatacacgatcttttcgtagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacacggggactaattgaagtaagaagtctcccagatggggagacttcttacttcaattaaattatttcacttttttagtcggaaccttaggtggttctcggaagaagatagcgaaaaaaattatccctaaagtcgaaactaaaaggaacgtataaaccaatgcttccatagattcgatcgtggtttatttacaattataacttccacacctattcatttgtcatttgggatcatttcccgtataaaaaaggaaaaagagtcaaagaagggatgggagatgtttcccatgtcaaatcaaaaaagagaggtgaaagataccaaagcaatgcggcctcagactggctgtctcctcgtagttggatctccgactttttggaatgttccaaattccacttgagcatccaagtctggatcaataccagcaaaaacatctcggaacaaggttctagccccatgccaaatgtgtccgaaaaagaagagcaaagcaaaggtagcatgaccaaaagtgaaccaaccccttggactgctgcgaaaaacaccatctgatttcaaagtagcccgatctaattcaaaaatttcccctaattgggaacgcctcgcatatttttttacagtagcaggatcagaataacttactccattaagttcgccaccatagaactccaccgttacgcctacttgttcaacactatatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgctgaaagtatccctgatcccactgataacgagtaggcccaaacaattcaattggggtagttgctgacccataccacatagttccggcaactacgaaagctgcaaaaaaaacagcagcgatactactggaaagtacagtttcaatattgcccatacgtaatcctttgtatagacgttgaggtggacggacactaagatggaataggcccgctaatatgcccaatgtacccgcagcaatatgatgagaagctattccccccggaacaaaaggatcaaaaccttctgcaccccacgccggatttacagcttgtacttttccagttagtccataaggatcagacacccatatcccaggaccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaaccgctaattcgtataaagccatcgagccagcccaaccagaaactagagctgtgtgcattatatgcaccgaaagcaatcgacccggatcattcaatacga

SEQ ID NO: 14355 - DNA, 9757 bp, Oryza sativa
tttcattccattaaagataagaagccaattctgttcgtaagaagaaagagaagcagatctattctatactcgataagtgccatatgcaatgggcagcttggcttatttggaaaaaacgaagaatagatccctatctctttttgtttagtattcgaatcacccattcttttttctttattcaatctgtcttatcctacttatatgtataatctttcaatctatgtattatttcaatctacgtattaatagaatctatagtattcatatagaataagaaaaaaagtgaaaacaataaactgcggattctttctttctcttccattcttacgtttccatattaaagtgtagttttcttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgaggtcacgaatcatattacaggtctcatggtatatctcagtatagaagatggaattagcgatatttttttgtttataaactcccccggcgggtggtaatctcaggaatggcgatttttgatacgatgcaaacggtgacaccagatatatatacaaaatgcctcggaatagccgcgtccatggcgtccttcattctgcttggaggagaacccaccaagcgtatagcattcccccacgcgaggattatgcttcaccaacctgctagtgcttattatcgggcaagaacaccagaatttttactagaagtggaagagttacacaaagttcgcgaaatgatcacaagggtttatgcactaagaacaggcaagcctttttgggttgtatccgaagacatggaaagggatgtttttatgtcagcagacgaagccaaagcttatggacttgtcgatattgtaggggatgaaatgcttgacgagcactgcgatactgatccagtgtggtttccagaaatgtttaaggattggtagtggccagatttcttgtaaatttatttcaaccctaaattcgggttttatgcaatttaatggaaatacttcataatgatcaatcattcaggttaagatcgatctaaaccaatccattttttctatatacatacgacatgccaacggttaaacaacttattagaaacgcaagacagccaatacgaaatgctagaaaatcggccgcgcttaagggatgtcctcagcgtcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaactttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgttaaaagggaaccatagaaacgatggaacccactattttttagtatcgtgcgaaataactgaagggagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgcgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcggataaacgcagcaacgcggatacataaagtattcgataattatagtaaattaatacacaatctttacaagaaagaattgattcttaatcgtaaaatccttgcacaagtagctgtattaaattcaaataatctttacacgatttccaataaaataaagattatcaattaaagggataaaaaagtaatatacaggaataattaaaaaagaattcccggagaggtaactccgggaagatacaataaattaagattaagtggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattgttgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttcttaattctaattgtccgggtgtattgtggcgattcttttgagtactatatctagaaatccctgccgactcctcattggccccttttcgaacacaactcacacattgcaaaataactctgattctaacatctttccccttggccatgaacctcctttcctttttggattgacttaacttaattcttctacttattcttttattcctctattttgaaaccgaagaggaagaagaaaatccattagaataaaaatttttggaaatttttcaattaagtaataaaaaatagagaaataattaaggaatacaatccttgtcaaattagcaaggattttgaagcaaaatcctttcattttagtagccaacccagcctctttctatgctctgatttctgaggcctgacttagcttggatactgcttttaattgaatttcttttttcaaaaatgagatttaccaaatttttcatgactctaaggtccaacccaatctatcttttctttctttttctttcctatactaaaaagggattgaaaagtgggaattttttatcatgtcacgaagaactctattcctcacatagcaacaactagaatgaaaaaaaggggaatgacaaagcatctggaaataaacgattaatttctatcaataaacctgctaaagccccaaaccatagagtacttagcacgggtgctacagagagatatgtttttatatcccgcattgaaaatcctccttccttattggaatacgtatatgatcagatattattgcccaagatcatttgtatttcttttgtttaggcgaaattccgaactaaaaacgaaaaagacaatcccttcctatagattaccaaggaatagtaatctttcttttataggtgaaattagattggatttagatatataccattccttgattatatgagaccaaaaagaagaaatgacacgaggattctctatagatagaaaaagacaagaaaattaggatgtggaaaacaagataggaattgtgtacaatgacattgtacaacaatttggaaaagggatgtagcgcagcttggtagcgcgtttgttttgggtacaaaatgtcacaggttcaaatcctgtcatccctacctattacttctttcttctttataggcagtagtgaggaggtcgattaaagcgggtataacttgaatttgtggatactatacgtacgtgagacacattaggagtagaaaaggatttgatttttgaaagcgctcttagttcagttcggtagaacgcgggtctccaaaacccgatgtcgtaggttcaaatcctacagagcgtgattccatctatcttatgtcgaagcagggcaaaataacttaacaaaacaaattgcaattccaatttgacctcctccagaccagagaggagggcaatcaaaaaagaaatattactcaatcaaagatccaactgatccccacgtctgtattgcaaatacgcagtcacgaataatcccgctaaagtaataggaattaggcctaagacgattccaaatagaaaaacttcaatcatttcgatttgttcgaggggataaaaaaaagaggtacgatttatccctaaatagtagtctaaattatccacgaatctcaatgaccaagaaaaaaagaattggtaattagtgcgtagaataccaggaatccaaaagagagattttttcttttctgccttattcattcaattcatttcaaataagacgtatcttgttcaagccaataaatagagctagggttagagttaaagcagccaatagaaaaccgaaataactagttatagtaagcatgaaagggttaaattccattttttttactacactacatatgttggtaaagcacttacctaagttatggaaaattcataattcatcggttattttagataatactaaaaaacaagatagagtgagatacagaagtgtaaaagaaaatggattcatcagatggggcatgagtccctaattccgaatcaagagatttgctgtgtaatctgtcaattgagtaaagtcaaaatattaagaactagatcagctaaccccagtgaaaaataaagaattgaatttgaaaaagttctttctattttggtctttttcaataggatgatttaaccttctttttggagcgaacagtcgaatattcccctattccttcttattttaattgattgtattccatatggaataagaggagaagaaaagcattccacgacccctcgagggtctcctaaaaaaaggaaatctttcctgaatttacttttttttaattcctttttcgaaccccaatcaaagtcgattcgaagcacttctttttccattacactatttcggaaacctaagaactggcaaagttccacgcttgcagtttggtcaagaaagttagtaaacaaggcaagggttgattacgaatcttgattcttcaaagaatgttttctctctttcataacagattatctactatttgattttctatttattagatattatattatgctaaccaattaaattctttaaggggaaaggttggattcgaagggatagctttcgcatctacttctctttgtattgtgtcagtataagaatatctttcctaaattctttatccaaacctgttgatcattaacttagattttcccaagatcttgagccctattccgaattattctactattccgaagccggtgaaaattaagtaggaccctcaaaattgaggttttctattgatgccttgaataccatatagcttaccctatagacaaggaacaaagaagagaaaaaaagaattctgtttcgagaccaagcgaaacaggattgctgtgccataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtaagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtatt

SEQ ID NO: 14356 - DNA, 23390 bp, Oryza sativa
  unsure (1)..(23390): unsure at all n locations
catttttgatctgtaaattgagttgttaatgaatccgctttattcgctgactctatatgatgtttctttttctttgaaggaaaaattctataacaaggtttgagaccgtgtatctattcctcttttttctacactagtagatttcattgcattgagttctttcttagatctagatggagtggaatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccaactagatactcctgtaaaataattggttagatacattgactttctattcaaaaagtatttgttgatccacttaaaaaaactcgctatacccggttccgcatatgcatgcatttatgctcgtagcctatatccgcatccataatccccatccatagcgggtttgcatttgtgtgtagaaagagccacataacataccatattatattacttacactacaaaagatccgtattatgatcctgtgtggaaatacattgagaaaattcggtcccgtcggttctagacaatcttatttttctgcacataaagaaataaagaagccattgcaattgccggaaatactaagcctactaaaggcacgaaaatagagggtaagttaaaatccatcatagaataggtgtctccattcaaatttactatttctatctattcgatttgatctattcaaaaaatatcttaagattcttatgatataattaagtatatctattataacgaatattgactattgtatttttgagtttgcaaaaaaagattttttatagaatactttttttttagaatactttagtattctaaaaaaaaagtattctaaaaaaaaagaatcgaatggattatataaataataagaaaatagcaaaaaaggagaagcaattaaaaagatttgatttttcttttccgatcctcgcggcctttctatccttctaatcgaacttgaaattggattcaaagtacgacttagtcgaatgcgcctatttcgaatccaaaatctttttcgtctacttccttccacatgcaatacttattcaaccactctcggaccccacaaatccgctgtaaggattgatacataggacttttagttgattgatattgccgtaaagttgaaacttttttaggcttttttattaaactgtaatttcctctctgcatacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaaaacttcgtcatctagttctaccattttgaaaatcaattctcttttcttacgagcatttcgagtcacttgttgactcacgattgtgcctgttaaaagtttcaaaatgtcctcttttttgaaagagagtcttagaaaggggtctaacttccaaactctgtcttttttcattcattctcctttagtttttttctctatctagaagtggaatagaataacccggttaaagggtaatgatcatacgtctgtaatgcattgtatgtcattgattctttcccaataaatgaaaactttttctgtaaatactgcgtatttgattccattatcatatgataatactctatttgtatttatttattgtattatacctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttcaacttatccctttcaacttggataccatgaggcggaccttggaaagtttttgaataagtagggggaattcgcagatcctccagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaatatgtttcattcatataatatgtttcattcatatataatgggtacaccctgtgtacattctatgctataggaattctactataggaattcgataagaattgagttgttgttatggtaagttaacatgcttcgttattaaaccatggatttgattcaccaaatccatctttattgtatactctttaatagatatagcgcaaccccaaatcaacttctaatccttattaagttcttaatagacccccttttcttattttgagtggaaatacctaaatactacgaaaattctctgttgacagcaatctatgcttcacagtagtatatattttgtatatcgaagtcctagataagaaagtagagtaggcacaaatcgtttacaaaaggcaaaatgtatatgaaaaaaagattgattgaactttccgacgggctcattccatgagtaaacgattgaatgggattcgtttgggcaacgaaatcaagtgctggtccccttttctctcttattgaattaactaattcatttccttttgacttttggatttttggatatttttttggtgttgatttggcattattcaacaagaaaaaaatcaaaatttcgataaattccttttttttgaaaattatgtgataattatgagaaccaatcctactacttctcgtcccggggtttctacaattgaagaaaaaagtacagggcgtatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnnnncaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaaagtgaagcgagagagttttgtttctataagaattatgtctccaccatacctaaatagaaaggaaatcaaaaagaaagggggtcgggattccattggatgaatctttaaagaagacgtggcaaagaggaaacaaaggctaaactaagccctttggtttgagaaaaaccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtgacacgaggattttcagtcctctgctnnnnttacaaattaagctatcttgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgtttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcggataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctatttttttcattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaataccctttcgtatttgtatggatttctggaattgatgatcgtagaagagccctctttaccattctgtataaatggactattctatttgtatagatatggtagaggggcgtattcaaccccccttttatccactagttcccctctctttagtttaacaggatagaacagtttggtagctgacaaggctcataaccgtggggttgcgggttcgattcccactacccgctccatattccttctttatgatatatgcatcatacatttgtatatgcatttgtttttctttcctaaaagagttttggtctaacagttttttctcttggtccgataaaaaatgaaaagaaagaagaaaatatgaaaaaagcgtccattgtctaatggataggacagaggtcttctaaacctttggtataggttcaaatcctattggacgcaatcttatttctatctattctttaaataactatactaaaaactaagaaaacttttttgcatgattcaaatgaaaaatctttctcaacgatttctcctctactacttctactaacaagagtagacgtgcaaaatttatgtttgttcctgaagggaaaaccgttcgagttgttcctgaatagcttttttcaaaaggatatccgcttcctcggtgaatgtctcgctagaagatataatttcttggaatcgacgtttagtatcttttaggtgtttacgtaactcatccagaaatttctttacctgtcccatttctaaggaatcaagatatcctcttgttccgatataaatagtagctatctgctcttccactggaaaaggatttgcttgggattgtttaagcaattctcgtaatcgtcggccccttgccaattgattctgacttgttttatcgagagcagaggcgaattgtgcaaaggcttgtaactccgcgaattgagctaattccaattttgatttgccagctacttgtttcatggctttaatttgagccgcggatcctactct

SEQ ID NO: 14357 - DNA, 3347 bp, Oryza sativa
gagagcagaggcgaattgtgcaaaggcttgtaactccgcgaattgagctaattccaattttgatttgccagctacttgtttcatggctttaatttgagccgcggatcctactctggaaacggaaatacccacattaatagcaagccgaattccggcattgaatagatctgcggataagaatatttgtccatctgtaatggagattacattagtaggaatataggcggaaacgtctccagattgagtctcaactattggtaaagcagtcatacttccttcccctaaaagagaatttaatttagcggctctttctaaaaggcgtgaatgcaaataaaaaacatcccctgggtaagcttcgcggccggggggtcttcttaatagaagggacatttggcgataagcttgtgcctgtttggagagatcatcataaattattaaagtatgccgttcgcggtacataaaatactcagccagggctgctcccgtataaggagcgaggtattgtaatgtagcaggggaatccgccatttcagctactacaatagtgtattccatggccccctcttcatggaaagtagttactacttgagctacggaggatgctctttgaccgatagctacataaacacatattacatcttgccctttttgattgagaattgtatctgtagctactgctgttttgccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagccagagcatttataccacgacccaagtaagcttcgctcacgggtatctgagcaattcttcctgttgcttttacaaaactgccctcttgtatcatcaacccatcgcccattaatacaatcccaacatttttggattccaaattcagagcaatacccctagtcccttctgcaaattcgactaattcgcctgacattatttcaccaagacctataatacgagcaatcccatcccccacttgaactacgcgaccgatattctcaatccctacttttctattatattgttcaatacgttcgcggagaattttatgaatttcgtcgactcgaagggttgccattagtgtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcatattattggtctatagagaatcaaagttgatttgatttaccaataggtcgcgaaatgctatggttctttcatatgatttctgcatttattcagaagtaattcgtcgagatcgtgcacccttttcttatttattcgaaaaatactaaaaaatattctaaagtgcagccggatagatccaatctattcttgaaatagacaactcgcacacactccctttccaaaataaatcaatacaccaaccactacagttagatttattagatttgttgctaaaatatcggtattaagcccgaaactcccagcggatggccagtgagctaaaaaaacgaaagaatgggttacatttttcatatgctctcctcttatagataggacgaacaaagaacaaagtttttcgatcacttacttcgctcgccctttttgatcggtttttttaatgcaattttttttaatagaaatagattcaatttagtaatttcttttagattaagtcttagatctcgtttgacctgtgaaagacctcctttgttgaaatgttcccaaaattcctaaaataaaaggaaaaatactttccactgcccttaacaaagggcgggaagcaagacggcgaacatatcctctaaattgatcatcctcaaatcagctattcctggggtggggtattgtctgtccccataaatagaaaactctaagagttataaattaggagtaaagtattgatataattggaattgcagaagcaaataccaatttacttaaaaaagaagaaagtatctaatctaaaggactcggtttcttttttagcattaaacaaaagggttcgcaaataaaagcgccagtgacacaactagtcaataaattgttaaagcttccataaaagcttgactaagcaatatagtaccgcgtattttcctttatgtttctggctgtctcgcaataccttgtacagcttgtcctgcatcagtaccttgaccagctccaggcctatataagcaagacctgcggccaatccaccagca

SEQ ID NO: 14358 - DNA, 21027 bp, Oryza sativa
  unsure (1)..(21027): unsure at all n locations
atctttcattccatccttctttctttcctcttcgatatccttgagtttctattttttcccctatcatctaattcataataaaaggtgaaatagaggaagaacccctatggaaatcgacctaatccagatccaataggaattaaatcaagatatccaattgataacaatatgctgcatcgaattggatatggaatccgattccatatatcggattagataatgaatctaacttgggaatatataatatcccatatcaatttgtttcttctattttgtttgtgtattttctcattttctattgaatcggattcaaaaaaaattccttaaagtggaaacccatacaaaagatgactgaacttatagacataaaggatatagatctagcctgactccgcccctccctaatgcctatatactttgtttggcaattccgtaatatagcctattctctcttctacaactctagattgtatattcatacgcaattctaactattttgttttccaaccaagcgaattttccgcaaccatgcatgaattgagttaagctaaaaaaaagactattttgaaaactagtcaattcaatgatgaccctccatggattcacctatataggctgcggctaacgttgcaaaaataagagcttgaataccgcttgtaaataatccaagaaacatgaccggtataggaactactaaggggactaaagaaacaagaacaacaacgactaattcatccgccaatatattcccgaaaagtcgaaaactaagcgataatggttttgtgaaatcttctaatatgttaattggtaaaaggattggagttggtttaatatatttctcgaaataactcaatccttttttgctaagacccgcataaaaatatgccgctgacgtgagtaaagctaaagcaacagtagtatttatatcattcgtgggcgctgctaattctccatggggtaactgtataattttccaaggtaaaagagcacccgaccagttcgaaacaaaaataaaaaggaacatagttccaataaagggaacccagggaccgtattcttctccaatctgagttttgcttaagtctcgaataaactcaaggacatattcgaagaaattctgaccatcggttgggatggtttgtggattgcgaacagctatgataactgaacctagcaagatagtaattacgacccaagaagtgataagtacttgggcatgaatttggaaacctcctatttgccaatagaagtgttggcctacttctacgcccgatatatcgtataaccccttgagtgttttaatggaacacggtataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagtttttttttttgaatttcgaaataaaggttcttgttttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccagaaaagatttttagttccgtatggcttttttttctcttcactcgaaccaatccacccagccgacttcttgtattttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaaccctttttatcttttttgtatcgtgggtcgtcaaaataagcaactatagtatttctacgtaaaacacccataaagggtatttcaatcgaaatcccaaaacaggatattggttctttctcttgttcttgatgatactgtaatggaatggcgaacctatttcttcgctttttcgctaacaaatcaaaattattttgaagaatagaaggatagacaaaattccaatgaccattggacatgattcgatccggcgttgaataatcaagaatttccctatcttttttaccaaaagtatccaacagtctatgtcttacctcatcatcagccatcgagaggccaaagatctagctgacgctaacagaaaaggaagtagtactcatttgatcttggtccttgcggagcgaaaaagaagctatactagatctgcacatacttactgacaatatccataaatggcttgtttttggtaatcgacgaagattaccatattgatattcgggcgcatgataaacatcggtactccagtgcatttccccatctgattcggaataaatatgtttttgtaccttttctttaaaatgcaaagcggacgttccggcacgaatctccgcaattacttgttcggattctacatattgatcattttgcactagaatcaagctttttgaaggaatagtcacactatgtagaatatcctgactctgaatagttatatgcaagtctatataacatagaaaagcaggctgcccatgacgggtacgtgtggggtgaaccaaatccccattgaattggatttttccatttgaaggggatcgtacaaggtcggcagtaccccctgtgaataccccaccagtatgaaaagttcttaatgttagttgagtccctggctccccaatagattgacccgcaataacacctacagcttcccccaattcgaccagatcgccatgagtgaaactccgaccataacataattgacagatccaagatgtgctccggcaagtaaagggggttctaatatatattggttgtgctcgaaatggctgtgctcgaaaggtggttatgaatcgattgactaacccaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgttgaactacttcaacaagtctacgtgtaagatatccagcatccgccgttcgtacagcagtatctacaacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccttttaaataccacacatgagtcacgggacatgcgagtttgatgtatcccatttgatatcttcgtatccgagaatcaacaaattctactccgcatttttggcaaaatctttcgtcttcgttttcagctccgctcgctcgagaatttccacaagcacaaattctgctttttatgggtccaaagattctttcgcaaaacaatccatctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcgttttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggattttttgtttgtttactggcttcatataattctgaaaacacaagttttcttgaagcctcttgctcatatctctcatcaaagggtgctattctataatgtttctttagcagatcccctgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtgtcttccggctactttatccccaactttgatttcgcgtttttgtaaaatatatacacgaaccattatgtcgaggggatccctctggatccatttcacatcgataacgcgtcctcttccacctatcggtagtttgagagaagtttcttttgaagtggatacctcaagaccaaatatggcccgtaataatccagcttccgcgatataggacgattcgctcgctatctgaggcgttaatttacctactaaaatatcgcctgtttctacccaggaccccaacttcacaactccatttctgtccaaattgcggagtaaatgttcttctagatgtggtatttctttagtgattttttcagcggagccttggcttgttgtatccgtctgaatttcatattttcggatgtgaaaagaagtataaatatcctcatataccaaacgttcgctaattaatactgcgtcttcaaaattgtaaccttcccatggcatataagctactaatacgttttttcctaaagcaagttccccaccaaccgtagcagccccctccgctaaaatttgtccttttttaatggatttaccccgcggaacccgaggtttttggtgcatacaagtatttttgttagagcgccgatgggtaactaaaggaatacttatagtcttcccactacttgataaaaggatcttgtgactattagtagaaatgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacccccaatagaaaaatattggaaaggaaaaatacttctaacatgaatctgttcccatgcaatagtcaggaattcttgacggtatctagctggaacaacctgttcttcctgaataccccgattcaaggacaaagaatttcctgctgctatcatataatactcatctctatttggtgataaataaaccacctgtctctctttttttttctttgctttctcagatatttcataaaaaggactctctacggatccccaccaatgatcaattctcgcatgaatagctaaagatccagtaagtccaacgttgattccttcggacgtgtcaattggacaaatacgcccatagtgactcggatggatatctcggctccgaaaacttgcagttctccccgtcaatcctccaggacccaaacaactcacttttcgcccatgaaccgtttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatgaatactctacggatagttttttgaaccgcatgttgtaaacgaccaagagccagtccgaattgatcttgtaacagatccgcaaccgaacgaatacgtttatttttcaagtgattcatatcgtcatcgtcaagtatacccgtttcaaatttcattccaatcaaatgatccgtagcggccaatacatctcgcggtaacaagaaggtgctgttctgaggtatatcaagattcagtcttcgattcatatttcgtcgaccaatccttcctaattcacatttttgttgaaaaaatttcttttgtaattcctcacataaggattccgaaaataccaggtccccacctacacaagcaaattgttgataaaactccaaaatagctttttcttttgactcaatcctcttcttctccttagcattagggaaagacaagaaaatttcagggtaggaaacattatctagaatttcttttagatttgaacccatagctgatgatagaactagaatagatatcttttgttttctactcacgcgagcccatatcctttcttttttatcaattgctaattccgatcttcctccccaatctgatattatagtcccggtgtagatagaaattcctttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatcgcgcggatacgtataattcggaagaataggtgagtgattcatacacagcatccctttcttttatcgaaggttctagcaattgatatcctttcgcaaataattgaaatgaaatttcgtgatctggatctttaattgttggaaacttctcaagttcttctgccaagccttgattaatgaacctacaaaatccctcgaattggatctgactaaatccgggtattgtggacattccctcatttccattccggagcatcttaatcttaagtttcctgtttatcgaagaaaaattccattatcagctcactcttcatcaatccctacagatcgatctagcaattatggaatctatattctgtttactaaatcacatgaaattctcgggaactccacatacgtatttcatatatgtatttcatacatatgaatagagacaatttcaacgaaagttcgaatttcccaggggtccaaatggaatgaaaatgaagtgataaaacattcctagaacctcgaaaaaaattctgccacttacagtttatgatattcttagattggacggcaaagatttctcattttttctcctttctatgaatgggataaaaccaaaatataataatttataagcactagaaagtttgactttagttcgattgagaatagcacgcttagtttaatttcaaaaaagaatttgaaggttcttttttgtttcgtagtagtagaatttctataaaatataagatataagatttcgttgtagaatcctaaaataaagtaagtacttttttaagtacatgccaatctagttctggacctccacatagcaaagtcaattttcttttttttattcaagatatttaatgcaatgaaaaattaaagaacgattctccacagagatatgtacataagggggatccatagataataatgctgttcggacctggagtttacctatatacggattaggcataaatccattgtcttttattatgacattaaatggcaggcgggagagaataccgaaattcaaaataaaaagagaattctagttaatggttccaatttgttcttaattttgtagcttgtgactagaaatccacttttctcctttttcatttcaatagaaagaaaagggaagttttctagtgttagcaatgtgtgttttaagatagaatcctttgaggagaataatcgaaactggatccaaaaaaagcatgaatagattttttgaaaaagattggaaaaaagtaagtagaattagatttaagataaaagaaagttagttttagtaagaaacgtggatgaatacttgctcttttctcgattttagatcgtattttttggcggcatggccaagcggtaaggcaggggactgcaaatcctttatccccagttcaaatctgggtgccgcctgatcaataaaatacttaggcttatagtactgatccaaatcgacaaatttgcaccccgcataagttggggcaagagaataacaaggctcggcgatactggattttgagaacccaccgttctttcctcaaactggggtttgttttagcagtagtggcccaaaccgataccaatagggatgagatagcgtttccttattcttttattaataagaaagggctatgtatcatatttatacttaatgctccccaattctaccagaaatactctaagaatttgttaagagtaaattctttgaactgattcatccatagccttaggtcagaacccctttttgactctgtacccttgattctactatgattattcatcaatagtagaataattccttcatagaaataggagacataatttacatggatatagtaagtctcgcttgggctgctttaatggtagtctttacattttctctttcactagtagtatgggggaggagtggactctagggatactactaattgattgagtagtcgaattgttgtatcaactcttttctttaattgaccgttttgcattaatcattttgccgaactttattctttctctctttctttaattttgtttcactcctgtaagaaactcttgtaagaaagagtctttctattctttctatttctatttctatatagtagaatagaaatagaaagaatagaaaatagaaatagaaagagcggtgagagcaattcataatcgctactagaagcgacccatggttaaaaaagttctatacataagaactttagattttcttccgcggagctattcccaacatatcgcacattttccatttgttttatattcttttcttattcttagttcttaaaataaattttatgctcttttgaaacatttcgcgacatgtttaagcatgaaagattcgctggttttttccttttactttttttcttttactatagtctattctcatattatttttctctccctccatggattttttcattttgacttgattgaaattaagtggatgcagtgaaaaaagaaattgaattagactactatttcaatctagtaatctattctatgtagattcaagataatataatagaaagactctaaagtgtggtagaaaaaactatatgtaggtttttctaccacactttatgattccaaccggatcctttcatttaagacttggatttttattttatttaatcccttttcatttcttcaatgattaattgaacttccaattaatcattttggctgactgtttttacataaataataagtaaaaaggcagtaggaactagaatgaacaatgcagtagcaataaatgcgagaatattgacttccataaccttttttttttcgcaataactcgggatgtaatcccatggagagggaaaagggtatcctgtaaattcaaggggaggacttgcattctgataatactgaatcaattcaatattattgaatatcggatctatcaaatcaattcatggttgagagtggaatagtataacataggaggatcccttccacgtatgatatgtatgtctttcgctatcaaccagaagtagtgataaaaaaattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccgcagcttccgccttgacagggcggtgctctgaccaattgaactacaatccccgcggggcgtatggcatacttattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggattttttttagttgatggttaggttaattcacggatcatcccctactttttagggaaattcgtttataaaggatatggaataagaatagattaataaaagggattctatattagttcagtacgggtagtgatttgattgatctaataggaaaaagagtccaatttcttttttggaatttacacccccctgcttcgcttagtgtttaaactaaaaatgcatgcatctcgcactaagttatcaaattcaataaaaaaagagaaattttcaaaaagaaagaaagtgaatgaatttagtagaaaagtactgtatcggatttgaaccactgactcacgtcttaccgcggcattactctaccactaagtaaaaaaagccctttatcggatttgaaccgatgacttatgccttaccatggcattactctaccactgagttaaaagggcttcttattcaattccaaaattagccactttcatttcccattataggtctactccataatgtacattatatctgtatatatcgagatatataagtctattcatggtcaggttcaaaaaaatcttaagaaaatcaagaaaaataggaaaatctttcatattctctcttatcacttgcacaaagtatagggttttttatctttaggctattgacttttcacatgctcagaacggtctgaaaaattagggacttttttcttctattggctgatcttatcatgaaaactttctccatttatgttttatttcctctaattgggtggggtataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttgtaaaaggcgggcagtagaatttatactgctcctggttcagggttttccgtttccgaaaactagcaaaaaaggagggttctggaacccttaaggttcgatggtatatggatatggaaaatccaacatgccccatcctaataggaaaaggaagggaacagatacccaatatgattattgggaagaacttttggtaatggtctcgggcctatatgttcttttttgtgtgttcttagttctattcatcttctttgattcttttaaacaagaatctaataaactagaattgagtggaaaagaagagaagaaaaagttaaacggagagaatcgactaagcagagacattcagaatcttctttacatcaagtaaatccttcggctcctatgtgcctttttctttaagttatttattgtttctctcaagccatagggaaagtgtctatgataaataaaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccatttcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccctnnnnnnnnnnnnnnnnnnnnnnnnnnnnnnnnnnnnnnnnnnnnnnnttctgtataaaataactattctatttgtctagacatggtagaggcctgtattcaacctttttcgtccaccggtttccagcgctccagagcggagtagagcagtttggtagctcacgaggctcataaccttgaggtcacgggttcgattcccgtctccgcacttagcagtctgtataaaataactattctatttgtctagacatggtagagggctgggtggttgggcggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggttaagatagtaaaggggtacggtactagactaacacctattactttaataaaagtagactaaattttttatcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaataaaataaggattaagctgtggagagannnnnnnnnnnnnnnnnnnnnnnnnnnnnnnnnnnnntatagttctaggaactatcgagggttcgaatccctctctctccttttgctttcctctctcttttcttttgcgtattgaatacgtttgtttctttatttgttttttttgttctgtccccttatctttctttcatagaaaggaatgaatggctcggctagatagaatacccgagccagaacagaaaaaaccagtagaacaggtataaataagaaaatcttagttaagaggggtcatgtaaagaacaggctccaaatcacgatcgattcccttttcaaatcctgctgcagcagcccgggctcttcttgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggata

SEQ ID NO: 14359 - DNA, 741 bp, Oryza sativa
ttatttaacagtataatatagactatataccaatgtcaaccaagccagccccgacagttgtatatccatacaacaaaatttaccaaaccaaaaaattttgtaaatgaagtgagtgaaaaatcaaaactcagattgctcctttctagtttccatatgggttgcccgggactcgaacccggaactagtcggatggagtagataattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacagagaacatttcagaatggaaactgtgaaagttttaccttgatcatttatcaatcatttctagtttattagttttggttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaaga

SEQ ID NO: 14360 - DNA, 6619 bp, Oryza sativa
ctaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttggatcagagagagagaaatatttcttggtttatcaaatggtgatacatagtacaatatggtcagaacagggtgttgcattttttatacaaacccctggggaagaaaaggagtctaatgcacggatctttttccgctgcttttctatccaattgggttatgtctgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggattcgatcctccgagtaacgggaccaaaacccgctgccttaccacttggccacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttatataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgccaggcaagaatttctcgctattcactatttcatattcttgatactagatgttctataggaataagaagaaatcgcaacccctttctgctacacataaaaatggatttcgaaagccaatttttcttttcaatatcttaacttttttgcagaatccgatttttggtcttatacccatgcaatagagagcgagtgggaaaagggaggttactttttttcatttttcccttaaaaaatacggctttcttggaaataggaatcatggaataatcctgaattccaatgtttatttctatagtataagaaaaactaattgaatcaaattcatggatttaccacgacctcagctgtgaccccatagataaaaatgcaaaatttgtatctt

SEQ ID NO: 14361 - DNA, 100 bp, Oryza sativa
atgctactcgggtcagagcgtaagctagtgatgctttcggctactggactttagccatctagggtgcggcactcaaccgcttcgcctagcagccaacgct

SEQ ID NO: 14362 - DNA, 1660 bp, Oryza sativa
cgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacagcgaatcctctttagtactactgtaattttgaaaatgaacacgcaaatacccatcaagagtaagtaaatatatccgaaacatataaaccgcagttaatcctgcagtaaaagaagctattattccaaaaaagggtgaatatacccacctattactagggatttcatctttggaccagaagcaagcaagaggtggaataccccaaagagaaagggtaccccataaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaatttcaataacagaccaaaatcccctacacgattagttacaaaagctttttgacaagcactcgctgcaattgggcgtgtaaaccaaaagcctat

SEQ ID NO: 14363 - DNA, 965 bp, Oryza sativa
aataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttaaccgccatggtgaaattggtagacacgctgctcttaggaagcagtgctcaagcatctcggttcgagtccgagtggcgccagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaac

SEQ ID NO: 14364 - DNA, 8002 bp, Oryza sativa
taggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagaccgaggagtaggctattctttttttgaaattgcgttggccacgagaagttgaagctgcatagattatttgcatcgctcctattattactaaccaaggggaaaatagataatgagcatgaggtaacattccatattgatccgaatcaatccgtatgctcccatctttaataggattgccgcttaaagcatacatgtactgtaatgcgcttgcccatgggtatctggtcaccacgtatgtaagggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcttaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattgggtctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacattcataattatacgaattgtatatacgaattcgaattagccaataaattggctatcgtcttttcaatataaattattgcaatattcaaattggcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttgttggcagtagatgagttttactaaatcaaaattgtggttctttagtgatttattttagatttgaaattcttataattttgactcattctaagtatttcttattgccgagccatagtaattgcacctattaaagaaactagaagaattatggaaatgagttcaaatggaagataaaaatcggttgctaaatgaatcccaatttgttgaacgttatttatgagaccctgttctactatttggtttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagtagagaactgttacaaataaagaggaaactaataaatttaggtaagaaacaagataaaataaaccatatttgataccagaatattcggtttgataacctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataccaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattctggtgcatttaccgttattgcttctgtaaacatagtagctaaataatcccaacgtgttacataaggtaagtattgtataatagttcggtttcccgccatttttgccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttctttcttaattcatattccatgaaaatggattattccatg

SEQ ID NO: 14365 - DNA, 3352 bp, Oryza sativa
tcggttttccgcgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatttttctgatcaggaaaaataaaaaattatgtcagttattttgaagttattctaatctcgtacacacaaaaatttgcaattattcatctactactggaatttggatttattttatcgatgcaaattggatttggatagaagggtacattcttttattttagatagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggatagagatatggtataagaaataggctattaagtaactctaaatgaattgtggatacatctgtatccttaacatactgaaacaactgccattattcgtatcaaaccaatagcgattcatacaagttaaatcttctaatcaatggtgggccaataatgaatttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagtagctcagtggtagagcggtcggctgttaactgactggtcgtaaggttcgaatcctacttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgct

SEQ ID NO: 14366 - DNA, 1276 bp, Oryza sativa
  unsure (1)..(1276): unsure at all n locations
actttagtctctgctcgacgggtgagtcttgcagtcaagctcccttctgcctttgcactcgaggaccaatgtccgtctggcccaaggaaacctttgcacgcctccgttaccttttgggaggcatacgccccatagaaactgtctacctgagactgtcccttggcccgcgggtctgacacaaggttagaatccgagctcttccagagtggtatctcactgatggctcgggcccccccggaagggggccttcttcgccttccacttaagctgcgcaggaaaggcccaaagccaatcccagggaacagtaaagcttcatagggtctttctgtccaggtgcaggtagtccgcatcttcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgccggcttcctgtcatcagttcacaaactttcttgaccttccggcactgggcaggcgtcagcccccatacatggtcttacgactttggcgagacatgtgtttttggtaacagtcgcccgggctggtcactgcgacccccttttgcgagggggcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtacccctttgttgaaggtcgttcgagcttttcctgggagtatggcatgggttacatacttcagcgccgtagcgcatggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctcggtaccaacaaggggtnnnnnnnnnnnnnnnnnnnnnnnnnnnnnnnnnnnnnnnnnnnnnnnnnnnnnnnnnnnnnnnnnnnnnnccgtggacgaaccttgcggaagaaaccttgggttttcggggcattggattctcaccaatgttttcgttactcaagccgacattctcgcttccgcttcgtcgaccccgctttcgcggttgcttccctctaaagcgaaacgctcccctaccgatgcattttgacatccca

SEQ ID NO: 14367 - DNA, 429 bp, Oryza sativa
gagtttaatagtatagccaactattggctccaatttatctatagccaatctaatagcttattcatacaatagttatgtcaatgggtgatacccgtagaccagatgagtagagtactagggtacgttggtacgaggatctacacgatacgacatcaagcaagaaaaaatacaaggattatattggttcaagccccttatcagctaatagctagtccagtttatatgggattaatatggaaaaccacataatacaataggagtaggcaaattcggctgtaccgacgagatcgtagtcgatggattcgacgagattttctggtgacttggcttcacgtgctccggctttgtaggctatggtcgatgtgttggtggtgaaattcgatacccgaaacccctcccgaggtgtcccttttacaccgtgaatcattt

SEQ ID NO: 14368 - DNA, 410 bp, Oryza sativa
  unsure (1)..(410): unsure at all n locations
atccaatcagcaataaaattattaaaaaaacaatgtcatctctcccacagcctaatccttcccccctactatccctctccctctcctccctccgctcggtggccggcacgccatcccagcccctaacctccaccttgctggcccctcccccaaccttcgncacactgcaccgtgctgcccccatccccaacctctgcctcgctgctctctcttcccttcacccgatggtcggggccatccccgtcctcaaccttcgcctcaccgcgttggcccaccccgtcccccaacatccgctgtgccatcccttcctccaatctctaccgcaccatccccacccccaatatctagtgcgccggtcccaatcccaaccttctgctaaccgtgtgggcctgccctttgccccaaccttt

SEQ ID NO: 14369 - DNA, 5552 bp, Oryza sativa
  unsure (1)..(5552): unsure at all n locations
nnnnnnnnnnnnnnnnnnnnnnnnnnnnnnnnnnnnnnnnnnnnngaaaagtagtgagggctctgaagaacctcatcatcacagggaatcactttttgaagtgtttatgcagtttatggaaccattgattttagagtgtaagtcatattcggagaagaacttttctaatttaggggtcacaaagctagtagaagttcattgtatgttgaagtccatcaacaaggtattgacaacagttattgaagagaaaatctatgtacctacagaggacacatcggaaggatcttactttgagttcttgcaagatatttacagggtcttagtctcaatggccgaaaaaatgtatgaattctgggtgtcagctgtgcatttggaagatgcaaacgttaagaagatgctacctttaatgtttgctgagattgtcgatgcagttggtcatttgttagatattgaatacaaggtcatggggcgggaccttgtaaaattatggttaatgatatttgctttgtcagctactaatgcatcttccaaggacattaaaccctgcttcctgctagcctcaaagatttctggcctttcatcccaagtgatttgcacattcagtgagcttcgtcaggttggttatacaacttttcagaagttctttatgttcttatactctgctttgtggtccttaattgcctatagacctcaattctatatttgaattatctaaatatctttgcagactgccatgttcattaggttggtttgttgattttcagtatgatgctctctctccgttgaccttattaattattatgtaggtttccttctccatttttacattgtgcggtgctgtgagaacattcagagctgctgttggtactggtgttgcagcgagttcattttctgtgtcttcgttatcctcagataaatgtttggaatcactagcagcattgttaagttcccagacattgagggatgctattcgtacttcaataaactcaatgccagaaggacagtctagtcgttgcattgaggagctaacattagaccttacaggtacattgaagtggatgagaacttgtggccttttggatgttaaattggaagtgcagggggaatcatccttggttacaagggattcagtgtttggtcagagagctgaacttctaggaaggcatttatcggaaatatacacaaatgtgctcgagtcaataactgtgaccacatcaaatagtacactcgttgcaaaatctgttgaaaggttggttgatgcaatcagaccaaatttatgtcatttggtgagaaatgaatcaaatagttcaagtgagtttgtttactcagttataggaaagcatatctctaacaaacaaggtgccaactggcagaagatcccaagtttatcttggctttatgtcttcttttttcgcatatatatgtcatgtagaagtttgtatctgcaatctattggcctcatgcctcctgattcagcgatagaagcaacagaactagtggggaattcattcgttgtatgctgcgggaaggaatggaccaattcagccaatattctcgcagaaggctactttgcttggattgtccaaaattcattccctctttttgatgctatcgagattttaacacaatctctttcgagaaattgttctgggtttactctgcttgttttcatccttcatgtgatggctctgcagagactaaatgaccttaacaggcagattaatgcttttgattttttgcttgaagatgatacagatcaatttgacaaggagaatagtgaaggcactgagttattaaagaagtctagctgtctcgaggccacacaactcaccagttttatgatgagctatgtgagactattatcatcaggagaaaccggctctttttggtgttatgagattagttcttcctgggattcaagtctatgctctttagatgaattttcatttcctatagcaacttggcaactgctgtgtgaaaacattgatatttggagcccccatgcatctaaaaaggatttgaagaacttcttttctaatctgataaagtttgcttttgttgaaaagaggtcatgcaaagatgtggagaatagtggcagccaatcttctcaccgagaaattactctttgtaatgtttcagtgcagctcctttgtgatactattatttatgaccgaaaggtatgtcctctcttaatccttccatccaaagataatatagtaccatttatctatgatttattgagtatgatgacaatattgatgtgctgtaataatgatcaatgttagtctttagttctatgttttggtgatttctttcttgtgccctctccaaattgcttggtctaatgcaaacttacaacttcttaggttctgttgaagaatttggtgtcaggtttttgccatgctctgaagaaatcggtattgtcttttgttactgatgctaatgaagataatgacttgttggactcgccacctgatttggtggatatattaactaaactggaaaatgagaagttttttagtacaaattctgatgttacacacacaaatggcatagataaactatggatttgtgagaatttacttaatttttttagtacagttcctggatttcatgcaaactccaagtcattgttgcaacttatagcttacattctccatctggaaaggtaagttcgcattttatatttttgttcatgtgtactaactacaatggctattccttgtataatcatagtacaaatgtatgcacgccctttgtttataagtactaggcacttttgactgagagtagttcacaaatagttatcacttgttaatttccccaatgcataatttttcatgctatgctctatatcattgccgttaattatttgtctcatggcagtaattggagggcacaaatgtgaaacacttgagacttgagagaaagtgtccaatgtttatttgttcttatgaagatcttggtggtctttttagttgaacttcttgtttattacaacttaatttctttctttgtaaataattgtttctctgggttatttctagtggattttgtgttgtctttattgatattggggttctctagtctttttcagtatttcctttttgttaataaggcctatgatcagtttttgatgcaacgaattgtgatggtgaactgcgtgcatcctagttagtcaaaatgtcctgggaatctgtattgacaacaattttgggaaagtgcatggtgatatgcacattgcacatttcttagctgcaactgaaatcttttggttatctccttgctgagaatgacattttttcaattttcttgcagactgctgctattggcaatggtatgccatcgttatgaatcttgtaattccatggggctacttcgtctgtttgtatgctgtcgaagagcaatgaaaaatcttatcttcaattttggtaaagaatttccagagttgaagcaatactcagcattttccaaaatttttggtggctcctgtctgatttggcttttgaggtctgttcaggaacttgtcagtttgtcacacaaaatatttgaagagcacactgatgagatgaaaaatacaattttctccctggtagataagacatcagaaatattttcaacactaactaacatgaattctgtattttacttgttgggtgcaaagaaacaaatcatatcttccagcggagaaagcagtactccaaaacatgatgatcaggcattcagcatactagaaaattcagctttggagcatgtcaaaattatggctgaactgttagagaagtctacaactggcattcctgtaactgttaagggtagtcagtgtgttatcaaattagagaactgttatgacactgtatgctgggatagattattatgcaccatgtcttgcataagaggattcttgtggggtcttatttcagcactagaaggcacatgcaaagattatctatcaagcccagaggaaaggaacgtgatgtttcagtatgcctccagattcagtgggtgtgttgctaagtttgaggcctttgtagatatttgcatgcatgtcttgtttatggagaccaaggattgcgagttggctgatttaatctctgttcatcttccacaagagctggactgcgagaacaactctctgaatattactgcaatcatggatgaatggactaggcaccaacctgaggagatcggatttcactcagatggtgtactaaatatttcaactgagactcgtggttttgatctgcccaaagtacaatttgtgaaaggatttcttttagaaaaccttttaagtggtgagggtccatccatagcatttactttaagggagctctacaatgcatctgctgctattgttaagctgaagggaatcctatcatttccaagtgaggtatgtagacagatatgcagtcctttccaaaagcttccattgggtccaatggttgcgacagcttacatcgctctacacaaattagcagacatgtctaactggcctgacatgttttctcttttatggattgacggaatattaagttatcttgaagctgtaggaaacattttggcattacctgagatcaacatgtcaaaagaattgtacactcaagtagttaatgctcacttgagagctattggaaaatgcattttgcttcaaggaaagaatgcaactctgcctacccatgagattggatcaagtacaaagacactatatttgcagaatagatctggtcatgttgttgctaaaggtatcatcaataggcagaacagattaaattcactgaaatcaagacttagactatcactgggaaaatatgtcaatgtttcatcaaacatgcatctaaatacagctgtgcaagtcattgaaagagcattggttggagtgaatcgtttcagtcattcaatatatgaaataaacacaggaaattgtgatggtgggacagtttcttctgatgttgcggctgggatttattgcctctatctggttcttgaaactgtgccaggttagtagacaattttctgtctggtacttccagattcactatgtttgtaatgcaatgtggttccatgcactgcttcaaagaagtcaataatctactaaatattttcaaacatgatctcatgtgcaatagaattgtctgccaacactgagtgtgtttgacaataccacaaattatcatgactaatctgtcttttcaaatatatgctcaaacaccaactagttaatatcaggtaataagcatggtcctcataaaatatatgtaggtcttcaataattaggaatttttcacagaaatgcttgacacactccttttcatattcatggcacctcttttggtagcatattaatatgctgtcggttcttgtcagtctaaatagactatcgcgttacatggacattgtccagaatgcatgaattattctcaactgagtggagtagttgagcaattcaggatggacctacttctaccagttcacctccacctgctgaccctccaaaatttaactgtgtttgcctcgatcttgttttgctcatatgtatgcgtatgaggatttgg

SEQ ID NO: 14370 - DNA, 2064 bp, Oryza sativa
aacgtgtttttaagagaaccgtcccaggcctaattggtgctttattcaatattgtcttacatcttgaaagtccttttattttctacacagagaggatgcctgttcattacccttatttgcacccagatgctggagccattgtcctaatgtgtattgaggttataacagcatttgtggggagacattcttttcaaattgattcatgccatgtctctcagtgcttgcatgttcccatgacactttttaagggcttcaaacatcttctttcatgtcggaatatgccccattcttgcaaccagagtgaagagcaactggcagctagtaatgaatatatacttgatagacaattttcagttgacatgtatgcttcatgttgcaaattgttatgcactactattcgacaccaacagcggtaaaatattttgcctctcgtattttcattctgtagttatatattattattttcattccatattgttatatttcctccttttatgtctagtgaggttgcacgatgcgtggctgtcctggaagattcagtaaacatacttctaagttgtttggagtctccaaatcccaaaatggttagtagggccggttatttttcttggaacatggaggaatcaatgaaatgtgcttccttttttagaaggatttatgaagaggtcagtgatgcttatatttctgttatttgagatatatgtatcaatgtatactccctttgatcacgtttagtatgcgatgcacctactccaccattagccgcaacgtaggatgttagtatccaaaaaagagtatataaacatgaaccccgtagaagaaatggccctgtggacaatgtataccatatatatttaaggttggtaagccaacaaatcatatgcacactaattatccttttttgtggacaatgtagatgcgccagcaaagagaactcctaggaaagcactcgatgtactttcttgcaggttacatttctatgtattctggacagggtccatttcagacaggcataacacggtatgcccttcctaatgaagctctttcatttatgctttggatcagcaattttacttttcttacatcgcagagaaattgatgaggccttgagacctggggtttattcgcttatcgatatctgcgaggaaagtgatcttcaactgctccacacatatctgggtggtcagtaactcctgcttaaccttttcttaaaatgcttaatctatttacgaataaacaaatgtaactactataaatacaaactgatccccaagataattccttttttcattctttggctttgcagagggtccatgccgaacaacttttgcaaatctggtgcaggactacaaattacacttccagtatcagggcaaaatctagtcaaacttgctaaaggctttttggagcatttgatgttgatccgtcttattctgcataagatatccaatgcatcatctgcatgatcttgggtttgtgctgtactattaattgctgactgcttatgcactgaattttcacccttcagaacggaaagggaatatggctgttgctgaaggtttttcaatctacccttttaacttaggagccaaacaaacaggatggttctgaattctttcctttattttgcagatttaaagctcatcaaattaatctgctggatttggaacaagatgaaaaggagcaaacaagaaaatgagcttagtaatcaagatgagaaggacttggtgatctgcagcctttggctcttgttccataaatcacaacttggtaatctctagcacgtagtgttcatattctggggtaatatttaacacacttgccccccaaactaaactaattcttttggaaggtagttcaatcagactgatcctatccaggccatactccatattactaaaattgaatttgttttcaccaaaggtgctaacaatgataaagatgatacggttctaaatgaggttataatttctccgaagggtatgtttagatgggtcacaaaatgttggtggagatgtactccaacatcgtatgtattctggagaaacttattaaagataagtc

SEQ ID NO: 14371 - DNA, 7163 bp, Oryza sativa
  unsure (1)..(7163): unsure at all n locations
ctatagggcgaattcgagctcggtaccctggatgcggcaacaagatagccgagaaatggaccaaaagctggagcacacacgcgcacacagtagccactatcatcggataaaaaagagtgtctttgctaagttgctaggccacagggatgaatcagattcccacgatgtgttatccatctccctgatcatgactggacacttacaacctgatccacatgtgtgtatgcaccgcactgtgcaccaggtacccttgggattttgcttcagcttaatttcggtttgtagtctaacctctatgaagcaattggccaagctcttgtgattgatgtcttatctaccccaagcactgccttaatcattcattttgtcgaataatggttcccgtattaaaaacgtgcatatagtttggacttaatcgttaagctattcgttcctctcttttttgggttagtggaatgtgatctttgtgtcttatactttggtgccaagtatatatatattgctagttcacctggaagtttgcactttgcactttgaggacgtgctgtaaaatccctctcctgttttttgttgggaaaaatataaaagccactccaaatattatcttaggtttgagattccctcctataagacaatttgttgcaaatatctccttcctaattcccttggtttgagattctcccaattaaaccttgttgggcagtgtgatgagtctccatgcttgaacatcatggttatcggaagatgggctgttgcgcttgcctcatgaggaagggcgactggtttctcagcaaagacgacgaaaataagttttggtgtgaagctgttttgttgagaaagatgtgctaaggcctggtttaattccctaatttttttttctaaaaacatcacatcgaatctttagacatgtatggagcattaaatatagattaaaaaaactaattgcacggttagagagggaattgcgatacgaattttttgagcctaattagtccatgattagctataggtgttacaataacctacatgtgctaatgacggattaattaggctcaaaggatttgtctcgcggtttccaggcgagttatgaaaaaaaattttcatttgtgtctaaaaatcccttctgacatccgggcaaacattcgatgtgacaccaaaaattttcttttcacgaattaaacggggccaagttatataacacatacagaaagaaggaaaaagaaagtgaacctagggaggaatctcaaactaaggtatagtttttcaaaaaaaaaagaaaagaaaaaagtttgcatcgtgggttttgacttctggcaacatctttgcattggatgaaatttctcgttcattcgttgaatatctgtaaaatatttgcagcatcaaccagaaggagaagttcatggtttccccactaacaaaagagcagatgtgttggtcaacctgaaccccacgagttgacccaaagtatttccatgctcaacccaacccaacatgcaccaggatttcctctcccatcttcgcatgcgcaatctgcaattctccccctccttttttttcccatcaagatattgttcttgatttgttagttccagttttgtcttgcagccatcatgaggcttatcttcaaccatcatgtttttacataggatgcacaaaaaaggctagagcttcctggaggctccatcctctcttttgtaccctttgttgctgactttttggccctctaacctgcactactactgataccagttgcaaagctcttgcctccagtttacattgggccacgtgtgccaatgccttgtcactcctagtcagcacacttctcccactaaccagagaagtccaagcacaaaagttaaagcctctcaaatcgcgcgttccgtgcactatgcaacctcctaatccatctaaattatgcacaggcatcttcagtcataagcccgtaaccaattttgaattttagtatgagggaaaagttcttttcattattatttttgccactcaactttggttctagaagttagaacaacatggagtataaagtttatcataaaatccagttttaccaccaaactattttccactacgtcgattaggatccccagcagtcatcatcttcaatctctcttgggggtgatgaatgttgtgaaatcccatgaattccattcaaaactcaacaagggaacggccgcaatgaaattcaaacagttttctgaatgcagcaaagccgcagcctcaaaaaaaaaaaacgccttgccatgcataaataaagtccaatggacacttaatatctgcacaggagatcagaggctcacgtcacccgatctgtcatgaggagccagagtcctttggtcctcagagcaagtttaatagtataccctattactagctctatagccaatctaataactaattcatacaatatttgcttactatactattaatatatggtcctacctgtcatacacatattgcgtcttagagttcatgctgctattctctttaatcttttactccctctgttttttaattgatgatgtcgctgactttttctcacatgtttgaccattcgtcttatttaaaaattttatgcaaatatataagatacaaatcacatttaaagtactatgagtgataaaacaactcataacaaaataaattataattacgtaaattttttaaataagacgatggtcaaacatataagaaaaagtcaatggtatcatctattaaaaaacaaaacggggtagtatttcattaagggggtgtttagatggggctaaaactttttagtccgtgtcacatcgaatgtttgacgctaatttggagtattaaacatagactaataaaaaaactaattttataaatgaaagctaatctgcgagacgaattttttaatcctaattaatctataattatgaaaagtttactgtagcatcacattgtcaaatcatggtgtaattagactcaaaagattcgtctcgcgaattagcccaaggttatagaatatgttttataattagtgtatgtttaatactctaaatttgtgtataaacatccgatatgataagtcctgtttcccaaacagaccctaaaatatacatgctctcaccggcgagaacacccgtcacccgtgccgtcgtccaattattgggcccgtgtcccgtcagaaatcccgcacgccacgccagagagaaccccaagccgcacccgcgcgtcgacacggcgacgcgtcgcagagccagtggaacagaggcacgacacgaggttccaagcccgtgtcctgtagcgtatgcatcctccgcgacgcggggagacaacgatcggtgcagcgccagcgcgagcgctaccgtttcgcgccggtggtggtggtactacgtacgttgggacgtacggcgcgtctcgtactcatcgtgaaaaaaaatggcagggaaacgatggcattttccgcccacggcgttgcgttttttcttcgtgttgtgttgacggggggtgaggctgtaataatgctggtaatgttgacggtttaggggcgtacgtgtgcagcgctgcagccagtcgtgagggcctgaggggcgctacccgagcattgtctggtgtgttacttactgattgggcaggtctgggccccggtgtttagtagggcttgggctcggatggtaagctttagtttgggtagaaaaatagggtcactcactctgacttattactatcttctagaagtgcagattatcatcggagtataaatgcaatttctatactaacgtaaaaagtagtagtggtggtggtggcgctaccaccatcctactaccatatggaacccataaaatatgatataaaactttactggtttcttagccttcatatgttagacctggtcgaaaataaaatatgacaataaaaatttatagaatttttcatctttatgaaatgatggcaaaattatcacaatgataatatattagagaaaaaaaccattgcaatgcatgggcattatactagtgatttaaagagttaaaaagtggcgatttcaagagttcgataatttcatattagaaaagtttcgtctatggctacataggagagggttaaccagatctactacctccattcgactttaaatataagcatttctgattatacaagctttttgtaccattttttacattgaacttagtctgggtacttatccaaacatttttgttgaatgaaatcaacatgagattgtgctatttttaatatagtagaagagaaatacaacccctgagagtaagttatgcagaatttagtataagctcccgaagccgatttgctccaaccgaagccatcttcttgctttctcctttattttcaccagtaggctaggtgctcgaaaactcgctggtttctctctttccagatcccaaacaaccaagagaatcagggcacgcaggtctttcttgggcacttcttttttgttggccagcatctcacaccaggctcgaacgttacaactgttgatatgccacccaggatgctattaggcttcgaatccttctattatatctatattggacgagtatgtggcatgctgactttattaaaacagattcacccatataaatatataattaagctagtgaggaaaggtgaacaatattattcttatctgctcccacttgtttagcctacaaactcttcctttggagcatgtttcgaactcaagacatctttttcgaaatgagaaaaatatggattgctaaagaggaacttagcaacccggccgtgcacgagagggttcgaatcgaacacaggccagtccaaagctcctgtagctctcataccactgtagtacgacaccgtcttcaacagcgtgggtctcatgcatgaacgtaaacagctgatcagaagggttttccagatggtgatgttgctgttttattgcacgctctatcacgcaagcttggacttaaaggtttacgagaagaatcgaaacaactgacggatgcagagacacgcacacgtacaaagggctgatagcctgatattgtctgcgatttgtggactgcgtttcatcaggatcacattctcagtgtcagctatccctggatggactgctgcatgagcgcttagacctaacgcattggcacaaaggcccagtgagggagagagcggctcgcgcacatctcctaacgtggacaaagaatatcaccaataaaatgagagagagagagaaataaaaatataccaatatgcggcttaagaaaattttgtggtgataaggatgtccctaatgccgacacctcaacaaccacagcaacaaaaaaagcaggcttagcattcttaactagagctctccaatcaacagcttaccagtgtactcttggccaccttctcttttttctttccccttttcatttggtcagctgtgaactgtatctgaacatatcttggtatgaggatcaaagggcaatttatatatcctcttctatcatcatgcatgcataatatgaatttcctaattagtagaacatgttgataattttaccaaaacggcttagcaattttatattgttatatgataaattttacggtcatcgaaagttataagaaggaatcatattttttgaagtacaaaatttggtgtatctagcctcggttcatctcaagatatgtaagatcactcacatatgtagagtatttatatacattaaagaaagtaaaacggaaaggggaacaagtttatgtcttgcagaaaagggagtgtgtgctagtaataagatggttcttgacaaaggtaccggcaatgcttattcgaagtactttcgtactatatgatggataaagtagaagtagtgagctttagtgctctacgacttttatgaggattgaagcaaattgggtctttgcatcagtagttggtaacatcagctaagaaagaatcaaatcacagatgactcggatgaaaataactatcttatccttgggccatccacctattgttttctttcattattgttgtacctcccagccgtagttgtctttgatgagatggatgtgatggattttttctagtaatactggagtcctaaattattctaacttggttttacattaagctaataagcttaatgctatcagacgatcatcttccagatattgattggccggatatatcctgaatacagagtctggattgatttctattatcagaaaaaaaaaatctgccagtttttttatttctagtaggtgtcagagcagaaagagatgttttgaaggttttagaaaacaaatatttctctttaaagaaaaacagcttgtcttgaaagaaaaagaaaaacaactttctgctcaagccaacgctacttgacagccgacatataggttccatctttaaaatggttcacaataggattattcggtggtgtccagttgctttcagcagaattttccttcagataacacaaggctggtggtgtagggtcgccacattcacctgttatttaactcattagcctcttaatttttgtggtggataaaatcctattttaaagtataacataatgtgctagtctggtattgtttgtagtgaaaatgttgtgtgaacataattgccatgtcccccacaaatcatatgattacaaaagatccctgaaatgtcaaacagtcagtgcactgcataaagttaatctaattaatccaaatcacagtctgtcctagtgtccttcaactaaattaaggttaattataactctagatatgttttcatttacttgtcattcttaacccatgttaatatttttagaagaaattttcatattttgttgaacacacatactttgttaatatgctgtattttcaaatattttatgaatcgcattgctcaaataaaattgtccaaaaagttgaatgcgaatagtgtctgctgacaagtatttaaaaaggagcatttcaacaacgatcttgctaaagccttgaaattaagtgtgacacaagtactataacatcaaccaaccatgtaagaagcacggtttacaaattaaactgtacggttgttgtcgtggttatcacgtgcggtgatcttctcagtttttgaaatatacctcgcgattaccgcggtaactgtcaaaccatggggtgacgnnnnnnnnnnnnnnnnnnnnnnnnnnnnnnnnnnnnnnnnn

SEQ ID NO: 14372 - DNA, 10694 bp, Oryza sativa
gtcagtgcactgcataaagttaatctaattaatccaaatcacagtctgtcctagtgtccttcaactaaattaaggttaattataactctagatatgttttcatttacttgtcattcttaacccatgttaatatttttagaagaaattttcatattttgttgaacacacatactttgttaatatgctgtattttcaaatattttatgaatcgcattgctcaaataaaattgtccaaaaagttgaatgcgaatagtgtctgctgacaagtatttaaaaaggagcatttcaacaacgatcttgctaaagccttgaaattaagtgtgacacaagtactataacatcaaccaaccatgtaagaagcacggtttacaaattaaactgtacggttgttgtcgtggttatcacgtgcggtgatcttctcagtttttgaaatatacctcgcgattaccgcggtaactgtcaaaccatggggtgacggtacccacgtcctacatggtttggtaaatcctgaccaaatttaagagtaatgttctttaaaaaaaaaaggctgcaatgccacccccaaccccaaggaatccaaattacaagtcccaagatgcctgcatctctcttcagagttcagacagacaagccgatctctgatctatccacgagaaaacgaagcagggaatgcaggattgatccatccatccattcatccatggatatatagctttcagtacacatgtgtagagataagaaggcttgtagggcccgggagggatacgacatatgtggagcacgagccagcgttgtgcattgccctcgcccccgggatctttctcctttacctcccgatcgattcggtcggcaagccgtgtggctgaaggtgtaaatcagtcaaaagcttttggcatatggtgtgtgtgtgtgtatatgttctttgcaaatattgggtaaaaattcctgtgcccacgggcttactctaacctcaccggaaaagaagaagaagaaaacaaatagacgacgacaacaatagacataccataacccatgatatgggtttggaagtacaaaatttggacaatgcgattgcaagatccaaacaggaacttcaatcaaattgatctaaacaaaacgaaatcgtgatgacgatatcgtagttttgtttgctagcactgacgattgacgaacaatttgcctattggttcttaagattaaacaaaaaaaaaagggggccacctagttggggtttggaaggtagcactagctgggcaaagcttggagagcatcagcacgcgaagctacacgccaatacatgatgatcgatcagaggacttcgttggatcacagaaacaaatatttttggcttatctttggatgaagctgtgtgaaggtgcgacccagcaacaaatgctgttgcaattgagctcgcataagctcccattgatcgacggcgacgtgccaatggtttcacgtgggttatgaccaggacaagctcgtgggttcttatccgtagtcgtcgcgacacactgcctttttttttctcggtgttcaatggagtaatggaccatgagctatagcttctttgtcttcaacatattatacacctttcgtgggctccttggaatagatgagctcacgcgaaaattctacaaaattcatgtgttcattttgaatctaattagataattatttaatggatgaatctcaatatagaaccaataatatgagaaaaaccaagtgaagctctcttcaagatgtttagcgagatctttaattcattagtatcagaaatgaaccgcataacagtgttcgtgcggtagtttgtgtgtatgatgcatcttccatgtaattgaaaaataaatgaaaatttgtggactcaaagaatcaactgaattattcaccaatcgagataggatctttcaggattgggtgtctggtccatggaacttttcacccaatgaacttgcaactagttcaagtctcatccaatgaacagcaagtctggccgagcgtgagcggtccaagaaagcagctggtttaggtaaaccgttctctttccattttatgtggctttgacaagcatagcgcaccaggtgatatttttttaaataaaaccctataggaaaatcaccttatttactagtgaatttggttacatactaagccagataaaaaccataagaatcggtagcatctttttaaaaatgatgctcgattggtcgagaaatgatcatattatcaatttttatatgtagctaaagatagttcgattggaaatggtaccagcttcatctctcaaaaaccactcatcatgcttggaagaatagtcttggatcgtagtgtaccaactcagattcagattccagagaacatgaaaaacttggtaaagaatcctgtatgattgtaccagacggtacggtatgaggtgagtacatgctaaacagctacgcgtagtaggagtactagtcatttgtgtgcctaaattatgctattccctccatttcatatcataaattattttatggttatattctctccgtcccattttaaacgcaaccataagtttctttgtgcaactttaatcgtctgtattatttaattttttaaaaaaaataaaaaacataagtcacgtataaagtactattcatattttagcatctaataacaataaaaatattaattaaaaaaatttaaataaaatggacgatcaaagttgaacccagaaacttatgggtacgcttaaaatgggatggagggagtactaaatcaaatcttcttaagtttaaaaaagcaacatttttaacttggaataaacttgtaaatatactataaaaacatatcgaacgatgaatttaatgaaactactaaatgttttcatctgtttttgattaagatatagattttacctcaattttcgttagcacgcttttcaaactattaatcgttgaatttcgtccgaaaactttcgatataaaagttgctttaaaataccagatgaatctattttcaagttttaaataataaaaattaaattaattatacgctaatggttttcttgttttacatccgtgtacttaagttttatctacatcactaccaaaacattaccttaaacttgttataaatgttgctatatttttctataaatttggtcaaacttgataaggtttgacctatgataaacttaaattaacttataatataaaacggagggagtcccaaaccactactcactaaagtataactactttcaacagtataaattctatctaaaatataactacttctctacctactccatatcttaactaatcatacatttaactttcttcacttaattctaatctctcatcatttactctacaagctgatcagccataaaaaataaatgaagcaattaaaattgatctatggataaaacttgtatatctttgttcttagtgcttttaaaagtcgatcctgaaaattaaactacgatgcaaacaatctcaaaatcaattctaaaattaaattttaaattttagctattattaataaaccaacaagcaaaacaatttgtttacttattttctccacttatttatttttttaaaaaatatataaccattcctcattcgatttcacaattatccatggtctccgtgaaaaattctaaagtgattacatgttgggaaggaagtaaagaattgatctacgaatcatattttttttagataatagaatgaaatagcatcccggtctttactcaaaagagctacagccaattattacaaaatagcactctgtaagagtaaaatccaaatagaagcaaacacaccaaccaaactagacaaaataacattattctagtctattggtaaatctccattcatgattggcaaacagttgtataatcttcgtttcaagcttacgacatgcaacaattaagaaatctgtattttcatcacacttttgtaactgtgacaacagatgaagccaatatgttgccttgaaaatgacctgcatataagtaacagtaagtgatttatcaaaaaccctatcatttctactcagccacagagcccaacacaaggcagaagctccaacaagtatcagtttgctctttttgtttatgactccctgaagccaatcatcaaaaatatgagatatgctagtaggaatatataaaccaaaagaaaactaaactgctctccaaataaactttgcaaaatgacaatcaatgaacaaatgttggatagactcatttttcgtacaaaagcaacatcttaaattaccattccaattccgtcttgctaaattatccttggttaacacaactcccttaagcaaataccacataaagatcttgatcttaagcggcatcttgagtttccaaattaacttatttctgtcaatgtaaccattattaattaaagctaagtacattgatctaactgagaattggtcattctgatgatagttccatctaaaacaatcagaagtattattcaattgaatatgaacaatagatgcacacaattcatgccaaagtgttaaattctgaccaactaaagctctcctaaaagaaacattgagcggaacagaagccatcacactagcaacagaagaacttctccttctgacaatagcatataaagatggatacttttctctaaaggccatatttcctagccatctatcttcccaaaatcttatttgttccccattattcacaatccaagaacccatagttaagaaagtgtttttgacattcatgagtcctgaccaaaaatgggagtcaccttgtttcctgtcaacttgggttatagacttattataaagatactttctcttcaataggtcttgccaaacaccattttcatttattaacttgaacaaccatttactcaaaagacatctattttgaatatctaaattatgaacccccaaactcccctgttctttgggttggcaaataatatcccatctagtaagtctataatttttcttatggtcatctccttgccaaaagaaacgaaatatataataatcaatcttttgaagaacccctttcggaatctcaaagaaagatatcataaacatagctaaacttgaaaggacagaattaatcaaaaccagtctacccccaacagacatatgttttcctttccggctgctaaattttttctctattctttgttcgataactttccaatcattattacaaagctttctaaaatgaattggaataccgagatatttaactggaaaagatcttaacttacaaccaaagatattagaatattgctcataacactccttttcctgaccaaagcaaaataactcacttttgtgaaaattaattttcaagccagataatttctcaaagatagacataatcaattttaaattctttgcttgttgtaaatcatactccagaaaaatgatggtatcatctgcatattgcaaaatagacaaaccatcatccactaggtgaggaaccaccccatgaagagatccattatctttagctcttttaattagtaaagctagcatatcagcaactaaattaaagagaattggagatagaggatccccttgtctaagacctttatgcgtttgaaaattattaccagtttgatcattaactttaataccaacatgaccaccttgaataaaagaggcaatccactcacaccatttagtagagaagcctttcatcctcaaagtctgttgtacaaatgaccatttaaccttatcataagctttctcaaaatcaatcttaaaaattacagcacttttgtttttacgatgtaactcatgcaaagtttcatgcaaaataaccacaccttccataatatttctcccaggaatgaaagcagtttgagtaggactaattgccttttgggcaaccgtcatgactctatttgtggcaactttggtaaagatcttaaaactaacattaagtaagcaaataggcctatattgctggattttcatggcctcaacatacttaggtaaaagaatgatcgtaccaaaattaagagagtataaaggcaaagtatcattatgaaattctttaaaaagatctaataagtcacattttatgacattccagaaaacttgataaaattcagcaggaaatccatcaggacccggtgctttgttatgttccatttggaagatcgcctcattaatctgtttttcagtaaaaacatgcgttaaagcctcattctccaactgagaaacttgaggaatgtcagcaaatttattctcatcaaactgaagagtagaatcattaggaggcccaaataaacctttataataagtggtaatatgcgatttcaaattcgcatcaccatttattaattggtcaccatcatgtaattgaaaaattctagtcttcctatgttttccatttgcaaccaaatgaaaatattttgtgttagaatcaccctctaaaatatccttagatttcaccctctgataccatttaacttcctcttctctcagaattgtagataatctatttctacaaaaccatctaaaatccaactcctcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgtaaaagccaaccaaattcaaacttgaaactatgttgagcattactcaaagaagaagtgtttgtatttaaaagtaaaggagtatgatcagaaatatctctattaagagccaccacagaagataaaggaaatttatgttcccactccgtgaacattaaaaccctatcaagtttctcatatgttggattcactaaattgtttgcccaagtaaatttcctaccagacatctgtaactcccggagacataacccatcaataatagcattaaaaaggaatggccatctatcatcataattatcattattcttttcatcagggctacgtacgtagaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaagcttaagacagtggaataaagcagagagagaaatcaaagcaagaaagagagagaagaagcgaggcaagagtcaagaccatctcccatggccagtggtgatagtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtcaacccggaccacttcgacttccgccgctacgacaacctcgacgcctacgtcgacgacctgctcgccatcctcgacgcgctccgcatcccgcgctgcgccttcgtcggccactccgtctccgccatgatcggcatcctcgcctccatccgacgacctgacctcttcgccaagcttgtcctcatcggcgcctctccccggtacgctcgcttccactgatgtgaatcctttctcgctcttaaaattgaatctgatcgggggcgatcggggagcacggacatgtgtgtgcaggttcttgaacgacagcgactaccacggcgggttcgagctggaggagatacagcaggtgttcgacgcgatgggggcgaactactcggcgtgggcgacggggtacgcgcctctggcggtgggcgccgacgtgccggcggcggtgcaggagttcagccgcaccctctttaacatgcgcccggacatctccctccacgtctgccagaccgtcttcaagaccgacctccgcggcgtgctcggcatggtccgcgccccctgcgtcgtcgtccagaccacccgcgacgtctccgtcccggcctccgtcgccgcctacctcaaggcccacctcggcggccgcaccaccgtcgagttcctccagaccgagggtcacctcccccacctcagcgcccccagcctcctcgcccaggtgctccgccgcgctctcgcccggtactaatccaacgccccccgcacgccaccgcggcgcgccgcgcgtgcgcgtagccgcagcgacgagtcaaaacgaaggagaaaaaaaaaaaccaccgcagctgcggctacggtacgtgtggcccagtagggggacacgcatccctctactgtttttttttttttaccgcgtcggattttactgcatttttaccctcctcttctcaggcctagaaaatatttcggcgcgacctgccaagaccgagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtaattttttcttcgtagtactaatatgttcaattaatttaaatcgtatcattatttgttattaacaaatatataacgatatttactttgttatatagagaatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacggaggaagtatgttcttgctgagagattcctatgctctaaccttacctacacctgccatctcaaaaatttggtagcctttcacacggataaaacgagatggataaaaag

SEQ ID NO: 14373 - DNA, 22575 bp, Oryza sativa
  unsure (1)..(22575): unsure at all n locations
cgctgtcgccacgagctccgcagcaccgccaccgccgcaagctcgccccacaccagatctgccctcaggagggccggatccgtccagggcggctccctaggttacccaagcgtggtcccgccggcgagaagcgatccccgccgccgccatccttgcagccgctgacaaaagccggcggccgctcaggcggcggcgaggcggaggaaagaggtgggggagagggggtggccggagctcgcctccctagccatccccggggagggcgacaggagaggtggggttgacgttccttgattaattccaagatacatcaaattcataatactatgccatcatatatggggagagtgggagtaaggttctctgctctctagcctgctctctagagcgggccccctctccgttggggtatcgaaggaatcccgatccctgtacgcgataagatggggccatgccatgaaccgggtcggcgtcgtgcgtgccgcgtacgtacacatcgccttggttgtgcctagttgccctatagccgcagcttatcctccccgtcgtagaggcgacaaccgacggcgagccatctctcgagtccgaggcccttccgcttttgtcgtgcccggcgcgacgttccgtgccacattcatcggccgcacgtcgcgctacagcgggcggcgctgtgtgcctgtgttggctcgcggccaaaaagcccaagagaggggaggctgggagaggccccccatctccatgtcgagtcgccacatgcagtgaccagtgatacagtcatatgtacagtagggcactatgcaagtatgcaggtaatgtgttggaggcacacgcgcacgggcggcggagccggcgggaaacactgcaaggtgcatgagattgatgtgagagacggcattttgatccattgttcgtgaatgtggataatttttaccgtaattttgacaatttgacccttttaaaaaacttattttgaaattgaatcatcccaaaaactaatttcaaaattaggccgttttctcagcgccatatagattagcgccgagatgtcatccgaagtgtcacggattttacacgtcatccgaggtcatcgccaaatactctttgttcaatttacaaatattagttatctacaagcttccattgcacacacaaagacaagaaagcttggtgaactctaggtgctaaatactgcgaggtaatgggttcgatcctcagccaagcaagtataagcatcttttgctgttctatttaaaaatctcacatgcttttcaaattcattttatttttaaatatggatgttttttaatttattttatttttaaatatggaaggagcaaaattatgtatgtggtatttatagcttaatagttggtataaaattacatctttcattttttttcaccctctattttgctacataattatgtatgcagtattgatcctaaaaggaaaaaaaagaaaaataagaagttacggggttcgaacccttgacctcttgttatgagaggcagcccttcaccaccaggatagaccttccataaggctagaatgtacatgcatactatttatacaactataccatggaggttagcaccaaattctttagcgctgacatcgcatcgcatgacgtgtgatttacgtgacacgttggatcgcatctcaacgccaaagaaagtggcgctaatacgttgtagctcagcgccaagtacgatggcgcgagaaaatggtctatttttaaaattagtttttgacacggctcaatatcaaaataagttttttcaaagggtcaatttatcaaaattacggaaatttttactaggcgtatatactagtgtgctataagatgtaaatcatgtaatgtactgtagctgccagtacaagcgctttttgaacactagcactgaaactccaaagtgattagctagctagtaaagcgactaaagcgatgtcagtaagatcatttcttttctgattaaaacgtagtaagggttgattgtgtccgattgtacatcgaattcgacggtctgaaggctgaagcgatgcggaaaggctaatccgcgcgctgccggcgcacacgctggcccacaagaccaagacccatgcacgcgcgcttttgcgcttctctcttttttttaacgccgctgtttctttttttttttcttttttttcgccgtatgttgttcctgccgtacggataaaagaaaaaaatataattagtttagattagtttcctatttttactagtggttggtttactagtaatttttaaattttaactttaaatttttcaaatttagacatgaaaattttcaaatctcgagctgaaagttttcaaatctcaagggagagagggaggagaaagaaggatagatagggtcatagggatgacatgtgggtcctataattactttttgtgtgaatgacaaatagggcccatatagtttttaattctaatgctacctaagcgccacgtcagtaccacaaaccaagtcaacatcgccacatcagcgccacgtcagtaaaaccgccgtccaaaaccaatgagggagtcaaattgcactggtttgaatagttcggggagtcgtcttatttggttttatggttgagggtcacggattagattcgggtcacttttaagggagtcaaagtggacttattccaatgcacgatgcacgaacgactcaagccaccggttggttggaccgagcctcgctgcgaggcgctcgggttggtcccggcacaccgtgcggagtggaggcccgtcaccgtgatgcgccgttcactttccggcctttcccatcgcagagaacgacgggaagtccagaacacgcaacgtgtgcgcgtgggggtgcagaccgtgcagcgcagtggtgggtggtctcgtcgtttccaccaccttccccgcggagaagacgcggtgcacgttcctatcaaaagcgcggtccttcagtactccttcgcatatcgtcgccatgacgttgaccctggaccttgagagtcctgctaaaacaggattgagatcctcaacatttgagtgcaccgtgactttatcactaacatgtgaatccggagatcatcagatccacatgtcaataataaaggcacggcgcagtcgactgcaaaagattatgttccgctaaaacactccccgaggaaaaggagacaggaactggtgtactatgtcgtcattgacaccttgtaattgtttcctgattgtctctcagatttgccgtacagggtatagatgcctgtggctgtgtagttagctcgccttggagtttcgaatataggccttcccaggatgaggagggggagggggaggcctggaggccggcccccctccgaacgcggtgatggctcgatcgagtcgccacatgcggggagccacatgcagtggatacagtcatagcgtgtttggttacctacacatgggttggctcacaaggagcgcgagtttggtttctcgcacgggctcctggacctgattccacttgtgcaaacctaccttcctagctaggcccgagggaaacgctcgatttgagcttcgctcgccatcttggctgggcgcgtgcacgcgcgggtgcaagaggaggcggggatgcatggatgcatgaggcagggagggttgaagcatccactcacctcctgctcacatttggtccttgaggccatggggtgagtgtagattcggggagaggggcagtgacctgcgtgccaccggatgactggatctggcgtggctggggacacgagcaccgagcggcacggcgatggagaggaattgcagagcggaccgcactgagtagttgactagcgacgagatctactagagtagtacatccttaggctgacctctccacttggccgtcaccgcacgatgcctagatctagcagttggttggctaccttcatcgagagccaagggtgtgacgtggcgggtgcgtgacgcagagacagagctggacatgttgctatggttccacttccacctgatggatgaggagatggagacgtgctgcctctccgtgcatgccgccggctacctgacccccgtcctcatcatcacctagatattgtttgggcgttgggagtggtgccaaacctgtctagtggtgcactacctatgcatgcatgccgctggctgcctgcccccgtccccatcatcgctgagacgttgttagggtatcgggggcagtgcctcttctgcatgcgcgaccgcaagtaccccaatggatcccgccccaaacacacattaccgagttgctatgtaccagccaccgtcagcatcggcagtggaatctgaattaagggcatagaaagggtagagacaaacacatagagaagggggagatgggtgtgtcactaacatgttagggccaccacctttttttatttttcctaactaaaatgtcacataggccgccacttaggatgaacccgtcatcgaaaccacttagggacgctaatcgatctggtactctccctatatctggtatcgaggttcatgacagtattcaaactcgacgtgtggacgagatatctaaaatgaacttattccatatgtcgcggacctcccgttcggccgtttggtctgggcctacgaccgtgcggagggaggcacaccaccgcgggggaacgaccggctcgttgaacgcacgaggcacgacacggaagaggagtgggtgggcgcgtcgcgtgggcgtggtggcctcgttgtttctttccgcctccccgcgccccgcggagaagacgcggtgcgcgttcctctcgagcgcggtcccatttgcgtcggacggcgacgttgaccgctggacctggattccggctaaaatactccgcgaggataaatgggaatcggtgctctaaccacattttcctgtgtccttgtctctctgattatttacagaataagtaagatgctcgtatggtttagctttgctttggagtttccaatttatgcattcccgggagtcctgtcctgatctcctggaccctctctagagaaatgcgaagtcattttctatggtagttgcacgtttacgacgacgcggattcgaggacctcatcaggcgaggattgtaaaatcgtgccatcgtgggaccatgttctagttacttgaggccccgtttagagggttcaccttttcctctgtttcggtaaaaatcaaaagttgtttgccacgagaaatagcgttcagccttcaacttatgtgttctctctctctctgaagactttatgtgttctcttcaataatattcaatgttaggcgcgtccgcacatgaggctagagagccggtaaggaatgaattttccgttggtttttccaatttgcacacttctacgaaggcaacacctcgcgatgacacaatgatgacaatggcacaaatattgcctccaagagatgctcaagtaatgctcaagtcactggaaagttgaaggaaacgtttggggctttctcatccggccgtacaagagaccaaaaagaccgaacgtctctcctacgcatgtacgtacgtgcagcagagctgcatggaatgtcttgaaaagttgccccccaagactcggttcgagttttgacccctgaattgccggcgcattgccagtagcgaacgaaataggagagaggagctgcccctgcatgcgcgcgatcatgcatgcacgcatcccctcccgttgttgctccctcctcctcctcctcgcatccgtcaggtcacttcctaaaaaaacacaggaaactacgcaaaaactcccatgattccgaccagccgaacactttccccacaaaaaaaattgcgctgaagttgccgtcagagagtcgccttcacgaacgccattgtgcgagttgacgcgtttcttcgcggaagaaaccaaatgcccgcgttggctatatagaaagggtttgggttggcggtggggaggagatcggaggagggggtcgttggattgggacccaattgaaagggaaaggttgaagaggcgcaatggagagctacctgaaggagaatttcggcggggtgaaggcgaagcactcgtcggacgaggcgctggggcgatggcgcaggttggtcggcgtcgtcaagaaccccaagcggcggttccgcttcaccgccaacctcgacaagcgatccgaggccgccgccatgaagcgatccaaccaggtaactgccgccgcattcaacgccgatatatgttatgttcgtgtgttgcatcggcgtcgtaattgccattgccattgccaccgcttttcttggcatacttcggatgtgtaaactatcgtaatatatatatatatatatatataatgaaaatcattacgggctggggctgtcaggccttattagttcatctgtaaattactgagtgtaagctgcaatttttaggccgttcgattagattttactgtttcagatgtgaacctgattctgcattgatcaagaaaaaaatatttttaaaaaagatgatattcaaacgtacctgtttgactgtttaatctttatccagtttgaatgtttcactgttatccattgagctgtttgtgaagtttgtatcttaaaaaaaagatcattttaactgaaaacttaagattttgtttagcacctcccttgaacatggtaaatttaaaattttccataacctctggcaaacaaaatttatagtgagtaacatgttcctctgttacaaacttacaataatacaatccacactatgtttcttctggcaaaatcgcaagtataaagtataaacacgttacacgtctgctgcaagtctgcaacacatatacacatgtaaaaggtgcagcatttgtgcagtactgaagcttccacaacagtttccaggacaaagttctgcatcactttgtaaaatcaagtagtactaacgcgattaattaagtattagctaattttttttccagttaggaacccctcctcccatgcacgcaaaacgatgcttgcattaacgcgtgattaattaagtattagctatttttttctaaaaatggatcaatttgattttttaagcaactttcgtatagaaatgttttacaaaaaaacgcaccgtttagcagtttaaaaagcgtgcacgtggaaaacgaggaagaagtgttgggaaaattgggtgccgaacacattgcagttgagcatggtggccgtgtttagattcaaacttttttcttcaaactttcaacttttccgtcacatcaaatgtttggacacatgcatgaagcattaaatgtggatgaaaaagaaaaccaactgcacagtttacatgtaaatcgcgagatgaatcttttgagtttaattacgccatgatttgataatgtggtgttacaataaacatttactaatgacggattaattaggcttaatagattcgtctcgcagtttacaggcgaaatctgtaatttattttgttattagtctacatttaataattcaaatgtgtgtccatatacttaaaaaaaatttggcacatgtactaaacacagaaactcagcctgtgtcctgcgtcagtgtgcgtgttgacaaaccttcagccagctcgactattcattgtgtgcaatctgctgctaaaactgcacgttctttgagcactggaagattaaacgccagcaaactcatgtttttttcatgaattttcatgcaattgttccactgtaaaattcacgaggcttaccatcaatgcacatttttctgtaccgatttcaagagaagctgcgagttgctgtgctagtgtcaaaggctgcacttcagttcatccaaggtatgaacgatactgataccagttcacaatcacatcccagaatgaaatcaacatttttttctcttttccatggagcccaatcatgacattggcacgatcctgcaggacttgctccggcgagcgagtacacggtccccgacgacgtcaaggcggcgggctacggcatctgcgccgaggagctgagctccatcgtggagagccacgacatcaagaagctcaagtcccatggcggcgtggaggccatcgcggcgaagctgtgcacctcgccggaggacgggctcccgaagtcgaggcgccggcaagccgtccgggaggagctgttcggcatcaacaggttcgccgagacggagtcgcgcagcttctgggtgttcgtctgggaggcgctccaggacatgacgctgatgatcctcgcggcgtgcgccttcttctccctcgtcgtcggcatcgccaccgaggggtggcccaagggcgcgcacgacgggctcggcatcgtggccagcatccttctggtcgtcttcgtcacggcgaccagcgactaccggcagtcgctgcagttcaaggacctcgacaaggagaagaagaagatcaccgtgcaggtctccccgaacgggtacaggcagaagctgtccatctacgacctcctcgccggcgacatcgtgcacctctccatcggcgaccaggtgcccgccgatggcttgttcctgtccggattctcgctgctcatcaacgagtcgagcctgaccggggagagcgagcccgtcgccgtcaatgccgagaacccgttcctcctgtcggggaccaaggtgcaggatggttcttgcaagatgctcgtcacgacggtcgggatgaggacgcagtggggtaagctgatggccacgctgagcgagggcggcgacgatgagacgccgttgcaggtgaagctcaacggcgtcgccaccatcatcggcaagatcggcctcatcttcgcagtcgtcacgttcgccgtgctcaccgagggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacaccggcggcgacgtcgtcttcaacaagagcgggagtcgcgagatacttggcacaccaaccgagacggccatcctcgagttcggcctctcactcggcggcgacttcctggccgtgcgcaaggcgagcaccctcgtcaaggtggagccattcaactcggccaagaagagaatgggagtggtcatccagctccccggaggagcaatgcgtgcacacagcaagggcgcgtcagagatcatcttggcatcttgcagcaagtacctgaatgatcaaggcaacgtcgtgccactcgacgatgcaaccgttgctcacctgaacgccacgatcaacagctttgcaaacgaggcgctccgtaccttgtgccttgcctacgtcgatgtcggtgacgggttctcggcgaatgaccagattcctgaagatggctacacctgcattggcattgtggggatcaaagatccagttcgtcctggtgtgaaggaatcggttgccatctgcaggtcggcagggatcatggtgaggatggtcacaggtgacaacatcaatacagcgaaggcgattgcgcgggaatgcggcattttgactgaaggtggcattgccattgaaggaccggatttcagaaccaagagtgcagaggaactgaatgagttgataccaaaaatacaagtaaagttttcgttgcttttgctggtcagtttaactgaattttctggatttcatttgctgatgtgttctggtttcatgtatcaggtgatggctagatcttcaccacttgacaagcacaccttggtgaagcatctccggaccacttttgatgaagttgttgcggttactggtgatggcacaaatgatgctcctgctcttcatgaagctgatattggacttgcaatgggcattgctggaactgaggtgattttcctcaaagatagttgatagtgttccccttgcatgaacaatataattaatgaattgcatcacttcgatttttttagaagtgtatttttgtggcaatttagccgctaatttagttgtcttgagttgtactaccatccatttcatgccctcatagttctatgcactttttcactcccaaaatttctcactgtgctatctgtttgcaggtggcaaaagaaagtgctgacgtgattattcttgacgacaacttctccactatagtccctgttgctaaatggggtcggtcagtgtacattaatattcagaagtttgtgcagtttcagctgacagtcaatgtggtcgctctgatagtgaacttctcctcagcttgcttgacaggtacagctaaatgttgatgttttttacctcattctactgtatagaattgatagtttcgttccgattaaaataacctttgatgttggtttcttgtaataactgcactgctgatacatgttcatcttttatacttctccttcaccactgttcctagtctgctgcctactgtttctaagttcaaatactgtttagtgttagtgcagcagaaatttttcgttagatttcaaatgagtggcagaagagatgtgctaaaacttaaaaaaataaactaacataaaatttattaatgtggaaaatcaagaatttcctagtttgtttcataacttactcttgactgttctttgtacttctgcttggcattcagggagtgctcctcttactgctgtccaactgctctgggttaacatgatcatggacacactaggagcactggcattggcaactgaacctccaaacgatgaactgatgaagagaactcctgttggaaggaaagggaacttcatcagcaacattatgtggagaaacatcctgggacaggccttctaccaattcattgtaatatggtatctgcagacagaagggaagtggctatttggactaaagggagaaaattccgatctagtcttgaacacactcatcttcaattgctttgtgttctgccaggtaatttgaaagtgcttgtcacatctatttagtgtctaaaataattctcttgcatacatttttgcaaaaatagaccttagctcttgaataatatgttggcaaatatgttttccaaggatcaatactcacatgaatgtagtacttcagctgtaaaatgatgaatgaaaaatttcagactatattttgccaatattagtgtgcagtttcattaaaattttcattgttgtgcaggtgttcaatgaggtgagctcaagggagatggagaggataaatgtatttgaaggcattctagacaacaacgtgttcgtcgccgtcctcggcagcacagtcatcttccagttcataatagtacagttcctgggtgatttcgccaacacgactcctctcacattgaagcaggggttcaactgcattttcatcggtttcataaggatgccgatcgctgctgcggtcaagctgatcccaggtgatttctaagttggaaagcagaactaattcaagacacgggactgaagtcggtagggattagaggcagtaccatgggcataacaaagttctctttatgcgcttgtttagatgtgaacctctgccccccccccccccccccctttttttcttgcagagtatgatccaagattgtatggtgtttaatggactcgtgtagatctttccttcatgtcattttcctcatgttctttccttggaatgttggaacttgcaattgtatatggatcgcttgataagtttgacatttgtttgattctacacccttgagtccttgacagggtgtatgaattgactcgtgtaagtttcttcccttgttgccatcctactgtttttttgtggccaatctgggactgtagcaaagttacttgcaataaaatcaatcgatttcattgtactggaaactacaatctttgttctttactcattgtactggaaactacactctggttgtcactaaaacgtgctttactggactgcatgtctgcagatgctatctttggttgtgtcatgatctgccatgttctcattcattcgacatactccgtattacagtcaggcaattttcagcatggttagctgtagtaggatttgtgaaatgcctccgctaccttccaagatccaagatataacgtcacatttaactttgaccacgaatctcagttgcaatccaaatgccagcatcagcagataatatgtactggttgcatgggcctggcaggctgtcagttaccttccttttggcatcccaggcttttctctcttcacacatcgcatgcaattgacacacacaatcaacaggcagcttgtgcttccatcactactgcaccacttcaccagtgccaatacaaaatgctgctgaccagtcaagccagtgactgggcatgttactgcccactataaaattccaacagcgtcggccaccagtagccatgcccctgtgaaccgcggtgaacccatttttttaccttgctgccaggcacaagacagcccaacacaacagatcagtacatgaaaaaaaaaattttaccatgtctctctctttctcatgtcatgcttgtgcagcgcttttgggttttgaccgcaatgccagttgctaccgcccacgacgagtcaccaggggctagaggaatccagtgcaagggttggtcatccacagccatctgaatcagattcagatcattcatggggagttgtttctttgcgtggggtttagttggagggactaaattggggctaaactttagtccctctaaaaaaacataaggcccttcctgtggtagggacttatgtttgagggacttatgtttttttgagagggactaaatttagtccctagttcccaaacacccccttggtcaaaaacttcaaagatccagaccacacaaaacacagcagctcttgtactccactttcatcagaggttttcacagtgctacactacacgcactgtcttcttggaggcagttaaaaaattggagggaaaggggaaagaagcagatccactcacatgctccccaagatgagcaattcatcagaacctcggcagctggtgagaggaagctgaagagtgaagaagagtctttcttttggcctgttccacgtgtcctagtggagtgtactactactggagtagtgatttgcattgcatgatgcacaattcagagagagctaaagaaggcagcgttacagctgctttcatgcgagagagacaaaccaacagtggcagtcacctccaagaaggcaaagaacagcaaagccattgctgagaaatagcaaggcagggtgatttgatgacacggcacaaaggcaacatcagaaaggcaccgagcaaacgcatttcttcctttcgtcccacagatatcaataaacaattcccaaccactcatggtcagcaattgcacacgagacacgagagagtagagtgaagtacagtgagagagatggcccctgccccctggctatccaactactatcaatcagttcttgcaacaaaaatgtactaccactgtttggctttagcatcaggaaattgctaatgaaccaaaatggcatgactcaacagagagtaacagataaccatacagtatccacaaaaaatgacttctactcaatacttgggaattgggattccctctctctgtctccacatctcagtgaggacttcctccctactttgagcaagagctctttatcagttttcaggccttttcctctgctctttacactagtacctttctgggccagggaaagatctccacaaaaccagaatctttccattgctaactaatcaatcaactgtaacaattgcataatcagaagaagaatcaaatgttggcccctccatttggccaaccccccctgaacttgcaagagcactgactagggctcagctgaaacaaaagaaaaagggtgaaaatgatcaactaaaaattgcagagctggactccaaccaacatgctgtccagctccagcctccagctcctccctctactggcgctgaggcgagtgcaaccttttcctcttcttgtccggggttgcctccaaggtggtggcattattggcccctcccatggcgctgtcctccgatcccccaatgtgggcaacagagacacccgaggaagctacctccgtcgtcgattgcatcgacctgtcctcttgaatcatcatcttgttgtagcaggaatacacatgcccctgcaagagaacaacagcgttgcagaatttactctcgacattgtcatttctaccaagaacttaaacctaatgggatgagatctcgcaaaagagaaagttgggagtgcttacggtgtctagttgctgccataacgagcccacgaccgacttgagctcgtctagattaggcgccgtctccttgttccgagcgatgaggattgctgctagagcgatcgttgatggctggtaccccaccgagctaatgactacgagattgcggaaatgaaatgagattcttgcgatccgattcggtgaaatgaaagcagagggggggaatgatcgacctttgatcgaggcgaagatgcattcgatggcgcgcaggacgatcgccttccgctcgtcgtgccggaatttcgcggtgaagcagttcaggtaggagaagggtgtctcggtgatcatctgccacttgagcgtggtgaggacgaggagctccatccgcatcaaggacgcgcagtcgtacatgtccagcttgaactccggcagccgcggcggccggcgctcctccaccttcgccgccagcgacaggcacgccaccgagaggagctgcagcgcccactccttgtccctctaaaacacccccacacacaaacacaaaaaaaatggcaatacggagtcaggcattacgtcgaacacgcactcggcatcacgacaacaagagtgaggcggcgcatcaaggcaagcagggaggatcggcattacatcgacacaccggcgcgccaagaaccgatcgagatacgtcaccgcgacatacgccgtcttcaagctgaaccggaatcccgcgttcgtctgcaaccagcaaagcgaggaggaagccccccccccccccctccgaaaacaagagtcaatacaaagatccgatcttcgcgaaaccgtgtggagagtaatctcaggtcaagggggcgacaaagagaggaggagacgcgaaacgaccttaacaatccagccgacacaccaggcgcgcgcgttcttcatccactcctccaccatctcctcctcctcctcatccccacgctcgccgccgccgccgccgccggcacacctctccttggacagcatcagcgcgaggtactcatcgtcccggtccatgagcaacacatggtcgtcgtcagcaatggataactcccagtcgccgccgctgccgccgccgccatcgtcgtcggcggggtcggcggagaagaggtcgttgccatcctcccggcagatgagcgtggacgtgggcgtcgcgggcgcgaaggtggatgccgaggcgtcccccatggtcggcgtcacagcccgccgcgcatgcagaagaagaagaaaaaggaaagaatcgagaaaagggaggcagaaatccaccgggacgaaaaggcggcgtgcgggtagcgggcgatcgagccggccggaacagaaagggatcgattcccaccacctcctccgccgcctccgcctcgtgccgtgcctccccccaccacccgcgcgcgcgttgaaaggggagggaaatctgcagttagagagagagagcgaaggaaaggggtggactgattcaggactggattggaatagagagagagagagagagagagagagagagaggtgtgtgcgtggaggagtggccgcgtgggggggttggatggtggtggatggagaaggcgacgcgcgcgcgcgagttggcgcctgcctgctctctgcggtgctcggctggcctgcctggctggctgcgtgcgtgctcgcgtgcgtagtagtagtagcatactactcgtggtaaagctcgtctcgtgtgatggctgctaggactcggctcttctctcgtctcgtctcaccacatgtactccctccgttcccacagtataagaaattttaaatttttctggtaacttttgaccactcgtcttattcaaattttttttacaaatataaaaaacgaaaagttgtgtttaaagttatagataataaaataagtcataaataaaataaataataatttaaaaaaaattgaataagacgaatgatcaaacgttgtaggaaaaacttaaaatcccttatagcttgggacaggggagtactctgtacgtatgcatgcatcttgtgtgtttcgcttcacggtctatttctactgtaagataaactgatatatgtgaaagtttagaggtccaaaattgataaagagggttttcctatagggaacgacacgcgagtggcgcctctcctctgcgttggcctagccgtctgctcgcgtgtgtagcaatgtactactggtggtaacgctcgtgtcgtgtgacttgcaggatctgctctcctctcgtctcgtcttaccgcacatacttcatacgtttgtacacattttatatgtgttttactccatgctccacactactataagatcaaccgccgtgtgacaagtttagatgtccaaaattaataaatatactctaaggtattttagtaacacacgagtagcgtctctgcgctgctccgctggcctagttgcatgctcccgtgcgtaatagcatactactggtggtagtgctcgtgctgtgtgacaagctaggtctcgctcttctctcctctcgtcttactttgtacgtatgcacgtgtcttctgtgtttcggtccatagttccactctactctgagatcaaccgtcatatgtgagaagtttagaagtttaaaattgatacatatactttgaattatgatgttatcttctattatgtcgagtagcttagtcataaggtttattaaaaaaaattctcgggtttgcttaaccttgacgcttgtattgtaaccttgtccctgatgctgctagcttcgctagtcaagtaatccacgacgcgcgtctgttgctaccaaacaagcctgtacagtatggtgtgcagaatgagtgagggcttctaaaatttttgtttaggtccacaccaaaccaatttgttcaagttttagaacttcctcactcaatttcttttaagctgtcctttctccttcggcgattatgctaaaagcctgaaatatgttcgtctaataacaaggtatagctaaagagaagaacattagattaatcgctagctacttttctgatgcggatacatggcacaccacccataataggcatcgagtataaagagcaacgtacagcggtgaactgtacttttaattttatttttacaatatttaaggcaccggccgggcctctaattcgtagatatagccatactaccaacgtgtgatatatacatgaccaaggtcatgcaaactacatacataaaagttttttacctatttggtcaatcggacaaaacacatatatgtgcatatcatggtggccacatgtccacaaatacacactctttaatacacgtttatatgacaaagagacaaagactaagaataaatgcgtgaatcttgtccatcgatttaaaccttaatagttaataggtaaatcgattgtttaatttgcaatgaaccattatattggtattaatcaaataatttcgacgtaggtgtgatttttaaaaatctcattaagaggatataagggttccaaggtagtgattattcttattatcaaactttatgtacaagtactttaggcgtgattaaaatggaatcacgtaccaacttttgctaaggctgggttgtgtcacatattctccaacaagttcctatagaaaatttacatgcgaatagcttttggactgtagaactcaaaaatcaaaattcatgttaaagtttcttgtgggaaacaactttttttttcctgaatcatatgaccaaatttcacgagatcccgaaacccttatctcattgtttcagaaattagcttgtcaaggggaaagcaccggtagtgtgtagagtcattggaatacatgcggtgtattattaataaagtttagttagaacaaggacatgtagtttggccttcacctttttttttaaacgtttgttagtggaaacatttactaccatgtatagttataattgtgctggtgcatacacgtcttttgtgtaatggaaaaaaaagaaaaaaaatatgaattatcctcctaaactatagcggtcgatcaaattacctcctaaacttgaataccagacattttacacccttaactattgataccggacaaataaccccctgagcactgtattgagtagttttgacttgagtttgcataaatagccggtaacgtggcaatcaagtcagcaataaaattatttttaaaaaaaatcaatgggcccacttgtatatctttcctcaagccaatcctccccactccccatttcaggtgcaaatcaatgggctctctctctctgtgcacctttggctagagaagtaggacagagagggaccttgctcgaaaggaggcggatcaacgcaagctcgcctgggcacgcgaagctggctctcggaggtggtgggccaaagcgaagctagagctatgcggaggttgagctcgaaacggccaccatccgctacaccctcacgtgtcgcggtcacggtggttgggatggcaacaacgaggcaaaggttggggacgaggatggcacactggagatcagaggtggggatggcgtagtggagattggggggggggatagcgtggtgaagattgggcacatgggtggggcagaggttgggggacaggaatggcgcactggagattgggggcagggatggcacggtggagattgggggcaagggcgacacgacagaggttgggggcaagggcagggccacacggtgaggcggaggttggggatggggacggcgcactagatattgggggtggggatggtgcggtagagattggaggaaggagatttttttggggggggccccaaacccaanggncnnggngnaanttggttntngnnggngngnancngngngngttgggggcccaacgcgggttgagtgcggagggttgaggacggggatggcaccgaccatcgggtgaagggaagagagagcagcgaggcagaggttggggatgggggcagcacggtgcagtgtggcggaggttgggggagggggcagcaaggtggaggttaggggctgggatggcgtgccggccaccgagcggagggaggagagggagagggatagtaggggggaaggattaggctgtgggagagatgacattgtttttttaataattttattgctgattggattgccatgttggtgcccatgtacgcaaactcaaggcataactatctaaaatgggaggttaggggctgggatggcgtgccggccaccgggtcggagggaggagagggagagggagagtaggggggagggattaggctatgggagagatgacattgttttttttaataatttcattgttgattggattgccatgttaacgcctatgtacgcaaactcaagtcaaaactgtccaaaacagtgttcatggagttattcatccggtattaatagtcgagggtgtaaatggctggtattcgagtttacgagtttagggtaattcggtcgactactatagttcaagagggtaattcgtaccttttaaaaaaactactccttccgtcccataatataagggattttaagtttttgattgcaatgtttgaccactcgtcttattcaatttttttttgcaaatataaaaaacgaaaagttgtgcttaaagttatatatataataaagtaagtcacaaataaaataaataataatttcaaaaaaaaatctaataaaatccctactaccacttctctacaagaaaatgccatgccttacttgctatgtttggaatcattactgtcttactgatccgatcttgccatcccactacgagggagcctacaaaattgtcactcatgtgatcgtgcgcagtccggtgttacagaaataattcaatgagtaaggaaatatttgtatcgatgtgcagtatataatagagaaatcttggagaggaccactgtccactggccagatcgccattacatgcacgccatttgctgcctggatagaacttcgcgtggtttctgatttctttgtggtttacccccgagctcgctaggaccacaattcagttagtgaatagttgcatatctcacttgctccaaattgcaaacaagatctgttccaagcttatctagttatatatatactgtatctcactagactagagcaattaggctgtgttcgggcattcttgctcccatccggaacagtaatcatagaaaacggcacggtccattagcacgtgattaattaagtattagctatttttagaaagggttaatttgatttttttaaagtaactttcgtatagaaattttttgcaaaaaaacacaccgtttagcaatttgaaaagcgtgcgcgtagaaaacgagggagagttgttgggaaaaaggggtgccgaatacagccttagtatatatcgattaagaccccctctaaacaatggatttacatataaattttataggattcaaattttaatggttttttttctctatttagctctttgaaacaaaggatttgggcttttatatcctataaaattcctaagaaatgacttaatgcctataaattttgaagaaagttagcaagagctttattttttgaaaaaaaatatttgagtccatctatgttatctgatttttttttctttttgttttttatgcggactattcaaatggtcgttcatagattttccgatgttttccacttatatattcatattaaaattccgtatttttcatgtatatcctacaaaattcctaagaaatgacttaatgcctataaattttgaagaaagttagcaagagcttcattttttgaaaaaaaaatttagtctatctatgttatctgattttttttctttttgttttttatgcggactattcaaaaagtcgctcatagattttcctatgttttccacttatatattcatattaaaattccgtatttttcatgtttctatgttttctataaatgttgttggcgattctagcaaccacgctgctatggctacttaattaagattaagaagagcgcacagagagttagagctaggctgtgtttagttccacaccaaaattagaggtttgaagaaattggaacgatgtaatagaaaagttgaaagtttatgtgtgtaggaaagttcaatgcgacggaaaagttagaagtttgaagaaaaaaattggaatctaaatagggccctaattgcaaatttgcaatgtaagtgctgtaccgcatgcattatctaatctgtcaatcagatcctaccctacagaatacactatcggtctattttggaaacaatgtgtactaactttgtagagttttaatcctatagaaaaattttctacctagtcatttgaaacatagggttgaagcttcctaaatcctatgaaattcctcagaaatatctcagtagaggttcaacctattagaaactttcattctagtctgttattctcttccggttcctatattttttttctatattctatttaaacggttatttcttattcctatgttatcttgttgtgttttataattttctgttttgcatatacatttctattaaaatcacgtgttttactatttcagtgtttaattgcaaatggggcttgctatattatgtgatggttaattcaattacaaaagaaactgaagtacgactgtactgcttgctagttgcagagacttgcagtcattgttcagtccggcatgcactgatcgatctgctacctgccctcactgatgtatcatggatcaatccaagcaccaaacggttacagtagtatatgcatcctatgaccatcctgtcagtaactagggaccatgcattactacggccagttccctcccccatttttccatcctaaaacttaagtgcactgcataaagcgcatatggttccggtaagactggtttccataattctaactccatatatcgtcttctctgttcagaggcttgcacaagctgtgaagatgtaaccagtaatctatcttatctatccgtctagtgcacttgatattcctccaatctatcttatctatcgatcaagtgcactcgatattcctccaaccaaccagaccagtacatctcaaagaaaatcaactgacagtaataaacgtatatgaacacgcacgcacctgcaactcatcagaaagtctgaagtcaatccttgatgatgcgaatatagtagtaaatgcaannnnnnnnnnnnnnnnnnnnnnnnnnnnnnnnnnnnnnnnnnnnnnnnnnnnnnnnn

SEQ ID NO: 14374 - DNA, 4121 bp, Oryza sativa
ctactagctctcccagagcggggccggggggaactccgtgggcgcgccgccccgctccagcaccagcacgcggccgctgccaggaccggccagcatcacggggagcaggcacccgccgtagaggagccacggggagctagagcaagcacccgcccgtgctgcccgtcgtcttcgtcgtgtccccctcgaggaggggaccgacctcgccgctgccgtcgcgcacaagggctccagcttctacgtccttgccggcctaccgcgtgagtgccacggccaccgctctcgccgttctccgccacgagcgcacacgacgactgtggtggaggccggttgcggcggaaagcttgtgctgctccctcctctcccgccggcgacgccgtcgcgcaccgctccctcttctcccgccgacggtcatcggggagaagggcggctgatggctaggcgagctccctggcctaccggcgaccactcttctccatctccaccgccgtcgtcatcgttggccgcatcctccagcgcaagaaagatgaagaggggagaaggggagagaggaagcagaagaggagggtgagttagactgacatgtgggcccacgtgggccttgctatttttaaattattcttttgtgtgtagctgacaggtgggtccacggtttttttaagatataattgctacgtaagcgccacgttaatgccacgtgagacggagaactagtcaaacaagtcacgtaggcgccacgtcagccaaaaccgccgagggacctcgtctacccggttttcgtaagttggggatgggtcatacccggttttgcggtctaagggacgaatatcggactgggcgacaaatagagagacccaaaacgaacttattcctttacaatttggtaacaacctgccgaagggccaagggccaaccaagacaaagttattctacacaatcagatggcccaaacttctcgtctgttgaatttgctggactgatctaaaaaatagtactaaacgacaacgaggacaaggagctggagcttcaggacgtcattctcattggggggcacgctttggagtatgtttgggcgcataaactggttaataggagcagaatttcgaagcaaaggcatactgatagaaagttcagaaatgaaaagattgcctcaaagcatcgtacctgaagataacctgaggcatcatccatcccacatactcatactactgcatgaacaccaagcaacgcatcgaaacacgtggcttaaatgcaaggaccagaaagacaatacgacatggcatcaagcagcgattactccgttgaggctcaccgatctactgtccacatacgcataaatgtgtcagagcgtcaggtcggttcttggatggcataataaacgcgtggaattagcgagattgcgacgtatatacagtagtcatactagtagcacggccgatccacaggatcgagctgcaggcataggctgccacagtgccacggtatcgtcagtcatgctgcactgttgatagtacaagtagtagtactcctggccaccgacatttctgcactgtccctttctgggactaatgcaaatgggaattgtggaattggcatctactagctggtatttcgtgtaggcagaaataatgcatattgctcctaaccacctctttagtactccggagtacatcggatgaaccaacaaaactaggattcttttgaatcacacgaattttgtaaaaaagaaagacttggaaagaaaatcacatttcaaaatgggttcagtcagtcagatgaccgttttagattgatgccaaaacataccctataaatttatcggtagctcagatcataaatgtgatagtttggtttgatgtcaactactcctatttggtaatgcctatgctttatttgacacaatttttaggtggtgtttgaatctagggacttaactttagtctctatatttagatactaatttagagtattaaatatagactacttacaaaactaattacataaatgaaagctaattcgcgagacaaattttttaagcctaattaattcataattagataatgtttactgtagcatcacataggctaatcatggattaattaggctcaatagattcgtctcgcaaattagtccaagattatggatgggttttattaataatctacgtttaatatttttaattagtgtccaaacatctgatgtgatagggtcttaaaagttttagtcccatctaaacagggtcttagaactttattcactctattataagatttggctcaatattgttaacaaaccaaacattgacaacaaaactttacccctatcaacgatttggtagtgcaaaattttactgccaatatactggaatttggaagggttgagaaccaatggactataaagacattaattaattagatctcccttgaagtgtggtttataaaacacatgaattaaagagtttgtgtttggaagatatgtaggaaatgaaatatagaaatttagaagaaattgtttttttatgagtgtgtgcgcgagagagaatgcatggggcttctcatataaaaataaaagcatgaagtatgaattcgtttagtttggtatgagaagcaaattgttagttttttttgtcaatcatattccttcgtttcaaagaaaaaaaagacgtggatattagggaatggcttaatcatattccttcatttcaaataaaatgataggatttttttcccaaacaattgagatccaccaaacttgtgttgaaatcacttcaatccaaatgagtcctaagatctccgatcacatatctccctacaaggatttacaaaactaacgagaacctgttggttttcatgagaactagatttcttggtccagctcgaggacacaaactactcggtttagcagaagttttttttataaaataatcaaattaattttaatttttgacaaaaagatggttgtgtttcacctgtagccaaaatttttaaaacacactggaccaagttttgtgaatggtttgtttatgtgaactccacccccttttgttctgcggtaccatcgtgagaaacggtgtacacgttgatatttatatacatgtccataagttcgggctaccaattaactcatgccaactttccaattgaggacattgttcagggtccagggtagcagccagccggtgcttgctaaacgcatttcccaagtttatcactagctagactagtacagaagcgggattaaccggacctacccgtgtctcctcctcagcacgcacacctattcgcctagccagacacgcgcgaccaattgcgcccgatcgatggcccgcggaccgcggagaggagagagagcacgagaccaccaccacgcgggacctgccgcgcagcgtgtcattgcccacgtttccacgcctgaaaaatccccctccgttttctaattctaccggtaaatccccctgcacgatctcactcacattctcaccaccaccaccaccacgcaagtggaaggaagtactcctacacaacctgcgcgcgctgcgccggcaaccaaaccggtcgtgccgtggcgtagccgcggtgcgcgcgggacgaccgagcgccgctccgggatcggggccgctttgcacgtgacggcgcgagccaaggcaaagcagatgcttgacgtgcggattagagtatacaaaaccatccatccattccatccatctacccgcaagaggactggaaagcggacaaaagagaagccgaaggccaagcgaccagcagaccatgctacacgtgggacccaacatgggaaaacaaaatactcctctatgaaattatattctcctcttcctaatgtagtactgcgtgatgattcagtacatacgatacgcaggagacatgcagcccccacagtaaaacgctttcgactaaagctaatcgagcactaacaaaggaggaaaaaaaataaagattggtatttgaagatccaatcccagcaagagaaagatacagattgttaatggttctgtaaagagagaaaagaagcaggcactaagcaaccccagggcagcatccaacgacggattgctttgtgcattgtcaatcagtacatcctctttaaataaaaatgtactagta

SEQ ID NO: 14375 - DNA, 1849 bp, Oryza sativa
  unsure (1)..(1849): unsure at all n locations
catccatctacccgcaagagggactggaaagcggacaaaagagaagccgaaggccaagcgaccagcagaccatgctacacgtgggacccaacatgggaaaacaaaatactcctctatgaaattatattctcctcttcctaatgtagtactgcgtgatgattcagtacatacgatacgcaggagacatgcagcccccacagtaaaacgctttcgactaaagctaatcgagcactaacaaaggaggaaaaaaaataaagattggtatttgaagatccaatcccagcaagagaaagatacagattgttaatggttctgtaaagagagaaaagaagcaggcactaagcaaccccagggcagcatccaacgacggattgctttgtgcattgtcaatcagtacatcctctttaaataaaaatgtactagtaataaatcagtacattgcgcgcgcgacccaaacacggtaggaaaggcccaggctttaaccgggaagccccacatgtcagtgaacgcaacctgattagtttaagccaccggaatgctgttcggcgacactgatgttcacatcaactggatggttggtacgcaaagtataggattccagttcagaatgtgtcttgtgtggaatattttctttccttcgctgagcaccaacctaccacaacctaattgtttaactcattaatttctccagaggcaacaggactacatgatatctttataccatctaagttttttacactaccagctacataatgttgagttttttttaaagaagaaaaataaaggtccatctaatctaaagtatggtttcttggtgagtgagtgactgagtgggtacctacaaataaaaagaggaggaaatgctgcgaaagagaggggaaaagagggaaaagaagcaaaacggaaagcagattctgatgccacgtgtgagggagaccgttgatctccaccgatggattgcatatggtacaactccgaaaccgaaaaatggcggctttcttcctctctctcccctccctccccttcgctcactctctctcactctagaaagcagcagcagctgctgcagctgccttggttggctcgattttaattttttgtttttcttttcttctgctgtcaatgccccccgccatcgcgcgattcgtcgcgatcgcggcggtgttgctgtgtggccatgtcgcggtggccgctgagtccggcggtgtcggcggcggcagtgcgaggagggtgctgcatcagccccctcttccccccattgaggtgggnaaccttnnccctttcnccaaaaccccccccctcgnncgcgcgcgctgcaccggatttacctccgaccccagcactccgccggcgcctgacgcgccttccggcgacttcttccctccggcgccaccgaccacgacgacgccgacgagccccggaacgactccctccccgaccaccgtcgccgccgacgtctcgaaaactccgtcggggtccggctcgggacaccacggaggcggccctacgaaggcgaccatagtcgctgccggggcgggcgcggctgccgccgtcgcgctgctcggcttcgcctgcgcgttcctgatcaccggccgcgcccgccgccgcggcgactcgcagaagctgctcggtcccgaccgtgccggcgcgcatcgcagcgccgccacctccgccgccgacttcctctacgtcggcacggtggagcccaccacccccgcgcgccaccacgggcccaccaccgccgatctcgtggggtccccgtaccgcaagctgctcagcgaccgggcgcggcgcggggtgatccgcgacgaggacgccgaccacccgagcccggagctccgcccgctcc

SEQ ID NO: 14376 - DNA, 852 bp, Oryza sativa
  unsure (1)..(852): unsure at all n locations
cgcgccatggtctgggaccagctgaagtcaagctcattccagttgagatttggtccacactactgaatgccgtgattgctacaggtttggtctttgaattacgcgtgtgacgttgaggcgttcctttcaggttggacgaggacatgatcgaggcgttgttcatgaacaactcgacgccggccgcgccgccgagagaggtcgggaggaaagccgccggagtgccgtcgttccggcaggaggagagggtgctcgaccccaagaaggcgcagaacatcgccatcctgctgcgcgcgttgaatgtcacgcgtgaggaggtctcggatgcactgttggatggtgagtacttagttcagtttactgcttttgacattgcattgttaattcagcgtaccacgatagaatcatcatttcatttttgttggtaatagtagtcgctatctgatttgatatagtatttggtaatagtacttagttgtgtttgtttagcacatttgttgctttggtaggatgttttattcagattttgttgctcggtccgtactttcgatgatattttgttttgttttcttggtggcatgcccgtttgatagtgctaggtacttaggagctgttgaattaacagaaaaagtcaggtcttgataataaagacctcaacagaacttacagtgacttggaagtttgaaacatccatcatatgttacattgaacattatttttctttatgtcgttgtcgaggtaatagtaatactactctctatacagtatacagctgcaaaatttatcgagttaataatattnnnnnnnnnnnnnnnnnnnnnnnnnnnnnnnnnnnnnnnnnnnnnnnnnnnnnnn

SEQ ID NO: 14377 - DNA, 16152 bp, Oryza sativa
ttctctcaagccatcggtgtttttctcattgatatcatatttcatcttttctaagcaatcacattcttaaaaactacactgtctgaaccaaaatcttcctcatcctcagaagtcagaacaatatatgaactactccctccgtttcacaatgtaagtcattctagcatttcccacattcatattgatgccaatgaatctagacatatatatctatctagattcattaacatcaatatgaatgtgggaaatgctataatgacttacattgtgaaacggaggtagtagtttttttcattgcggcatactgtaaatctgtaatttagtatgccatctctacatgagggtgtccagtgaatatgtgtaatttctattgttcttttgagcaggcaatgctgaatgcctggggagtgaacttttggaaacattagtcaagatggctcctactaaagaggaagaactgaaactacgagactacagtggtgacttatcgaaacttggttctgccgagcgctttctaaaggctgtgttggatataccttttgccttcaaaagagttgatgcaatgctataccgagccaattttgagactgaaataaattacctaagaaactcttttgaaactctggaggtatgctaagtcttttagttttccatgttgaatatcatcaccattttcaactattaaacctacaattagctgacatttcttgtcatgtttttactttttaggctgcttgtgaagatcttagaggcagtaggttgttcctaaaactccttgaagcagtgctgagaaccggaaaccggatgaatgttgggacaaataggggtgaggctaaagccttcaagcttgatactctcctgaaactagcagatgtcaagggcactgatggtaaaaccacattgctccattttgtcgtccaagaaattattcggtcagaagacgcaaaatctgaaaaagaaagtgccatgattagtagctctaaagatgaccgtaagcatggtctcaaggttgtatctgggctcagcagcgagcttggaaacgtcaagaaagcggctaccatggacttcgatgtgcttcatggttatgtcaataagctagaaacaggtcttgaaaagatcaagtcagtcttgcaactcgagaaaaaatgcactcaaggccagcgattctttatgtcaatgcaagactttctgaaggaagctgaaagggagatagagagagtcagaggtgaggagaggagagctttggggagagtgaaggacatcactgagtacttccatggcgacaccgcgaaagaggaagcgcatcctctgaggatattcatggtggtgagggacttcctgtcaacgttggatcaagtttgcagggaggttggccggatgcagcaggacagaacagtcattggtggatcggctaggtcattccgcatctcagcaacatcctcattgccagttctaagtctctatggacaacggagagaaaacaactccgatgatgatagttcatcgtcatagggtaagaaggataaggaacatactgaattttggaatgaacatagacgcacaaacttttacagcttatagcagatgcagcaaatgctacattgctgctacaatgacgatgacaaaggaagcacatgtgtaccgtggggaacaccatgtttaggagagatcaggggtttatacacttggatcatgtggaaattcttttgtacaaaagaataataattataacaaagctctttttgttgagtaatttgcaatcagcaggctgagaaaagagtctcacttcagtagtatcttgcagttgcttgcaagataactgcaatcttcttatgtaattattatattcatctagtttgccaactagtaactataacctggagaccattcacagatggtaatctttagtctgtgcccataatctgttgttgtcttaaaaaaatgaagcaacttatattcaggccttctctgcacttccctctttcagatttgttggccatatgctgggagcctgggacaatagcaaatctctctcatttttcgacaatactcagtggatgaatgccttacatcaacatcacaagtactgcataacatgggctgcaatggccatccttccagatatcttctagcaaagcaaaggtaaaaaagaaaaagtaaaccatcactatgtttgtgatggatgtaaagtagcagtcgagtgaataataactgccagcaaagcgaccatcataatctgctccatcgccagcgcccagccttcttcgtcgctgtcacggcctttgctctgcaatgtacaggagatagtagataataagtgatgaatcgagcatgccatctttgcgtagaggtaaagaaagcaatgtgggtcagcatccatccagcatagctacggagaaagtatccatctgaccatttttcccctcttctcgtgagaatgattccaggactcatgatcgactttgatgagtccctctcgtattcttgtctgcagatgaacagaggctctacatctgggagagaaaacaaaggaagcatgccattctgcaacatagggaagcaatgggcaatgggaaaaagaaggcttgatgggtccatttcgaatggtggtgccatgataacctaccctttgaagtagtaatattttagttgtatatgtgggtgtaatggattggaggggatttacatacttgcgctcattgaggaaagtagtttgatgcttgagtatttgattacttggtgtgttcttttcaaaggattagaatggtggataaattcactcggttctcgagttactaaatggcatgattttttttatttaaatttattaaatatcgatttaagttatattttaactttacaatatttaatttgatctatgtgttaggccgtgaggagtaatttagtaagggctatagccactaacaaactatccgacccaacccataacaccgcagctaaacataataggaataagttcacttgaggattcttatcttgttatcgagttttaaaatcgtccctgaaccagaataccagatataacacatccataatcttataaaatcaggttatattgggtcccaagacaatattaaggtgactttggatgacgtggcgctataagaaaaataaaaacccatgtgagatttgtatgtcagtgaaacaatatagtattcttcttatttctctccccatccttcgggtctcgagtctcggcggcgacagatgtggcggcggcgtgcggggtgaggagatggcggccggtgtgcggcgtgcctaacgacggcggcgaaggaggctcaacagtcggcggaggcacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaaaaagtgaaggcggagcacgagtgtaagttattttagaagacagagatccctataaggattgtgaagcaatggacaatccaatttatcttttactacctccgtttcaggttataacacgttttgactttggttaaaatcaaactgcttcaagtttgactaagtttgtacaaaaataatagcattttcaacccaagacaaatttattaagaaaatgggagcgaattttccaggatttaatagctttgtgctttcagtggtaagtgacgtacctgtctacagcgaggcgtctgtggtgacttcattaatctccaggatagatttgccagcccagtcttcgaagatggcaagatgctcataggggtatggtttgcgtgtgtgttgtgagtatctgcgttgtaccatgtaattaaaaaaatattaatttaataaaactaatttaatattataaatattactatatttgtctataaacttgtatttgaagcacaatgatgtgaaaatctatgtctcgggaataatgatgagaaaagcacaatggtgaagcaacgcaaagctgggatcaatcgccctgttgaaataattttccgctaacaaagaatggattctttgctattgggtacactgtaaaacagattctcgcaccctgtaaaaatgatgatttttatttttcattcgatgtgtaatgggctagtctggtaccttgattgggtacagttatcattggcatagacgtcacccaacatgttcttcactgctgatttgtcgtaattctgaaatctgactttctgaacattagccgatctccctgatgcaccatgatataccacctacgttttagcagaactcgttagatcatcatcctggttttgccaaatcacaagcacaacgcgtcctgaatttattgcaaatactttgcaacatcacagccaggtgatatcagatactccctccgtattttaatgtatgacaccgttgactttttaactaacgtttgaccattcgtcttatttaaaatttttatgcaaatacaaaaatgcttatgtcatgcttaaagaatatttcatgataaatcaaatcacaataaaataaatgataattacataaattttttaaataagacgaaatgttaaatgtttgttaaaaagtcaacggcgtcatacattaaaatacggagggagtagtttgcatcatcaacatcacaatcagatataaggagtattgtaagcccagtagtgttaactttgcgatatttttgtctcgttttttgtcactaataacctgacttattacccaagtttacagtgtttatggaccattgtgttaggccttgatcgaggagtaatttagcgagggcgacagccactagcaaactatccggcccagcccattagaccgcaattccagggatggatttcgaactcggggacaagttgagggatcgaaagttaacttattccaaaccgtaatactcgcacgggctttaacgctgtttgggccacggcccaaacatatcccctggtgggtgcgactaccacccatttcagcagcaactccggcgatcgatgccggttgccctagccgccgccgccgtcgcccgctgtaatttccctctccatcctggctctacgttcgccggatcgatgctctagcggcttagcggacaggtattagttcgttttttttttgtcctttcctgggcgtgttttaaattcatcttttgctgctggttttcattttttagaatatatgcatcgatgctctctgcgagttctgcaagaaaacacaagagagaagaagcaccgatcttcttctgtgattcaaagcgatagaagtcaatggaatctcccttcttttcttggtttccgaggataaatttcataggttttcataagcgactgcatgcaaagagcttagtggatttctttaatatatctcgtagtctgtcatgttgcctcacaaaactctttctatctacgacaatgttttttgaagcagatctgtgtcaactactaatcagctgtgaccagttgcagcaactaattctgcatctttgtaaacttcgggattcgtcaaagctgaagttggatatgccaaattcaaaactccgcctcgttgaactctattcgtgcagtatcaagactgtagagtttctctgcctccctaaactagagcatctattatgtgaatcttggttcttttcagttgcccctttatcttttggtgtgattccatgtcttgaggggttaaagcttgtttgtgctgcgtatagtaatcaatcagggttcaaattgactgatcttatgtgcggtgcttcaaatgtaaaggatcttactttggatttccaaggagaggaggcaagttattttattacatgcaaaatcatcgtatttactgtcatgtggtggtggctgatagccacatgtttatatgcaatttagactgaaactgaaagagcattttaaaagcaccttttatgtgattagatgttgatggcaactactgtttaacttctttctcttgatcaaatttcaaatatgtaatacatgctctcagattatcttttagagtatatttgtgttattactatcgcgactagggttattgagtacataatgattggactgattaagagatttttgtgcttacaattaattccttgtttattttgttaattttgcatagatttggattaaatttcaaggaaaagaactacgcaccgccttgaacaagataacaaagttgcttctgcatggcatctatgtgaaattttttgaacgactcacacgagacggtgcgaagttctattgatagagcaggaaaaaaaagtataagattacaaccctggagagtcgtaagcaggaaaagaaaaaaataccaccacccacatgacgacatcgccaacacacacgcccaggagaaggctagtaccggatcggccgccgctaagcgtggccgaccgctagtagaccaacaaaggcacggctggcgcaccgatgctccaccaccgcacaagctttgctgatatgtgggacccctgcaccggcgtcccccgctggccaggcttcgtgcgccgaagaccgcgccgcacccaccggcagcttcttctcatacctaggtcgccttctccaccgccggccgcgcctttttgcgccaagccggcctccttcaacggacgcgcctttcgtgccaatccggcctccctccatcggccgcgcctttcgcgcccagccgggcttcatcttcgccggccgcgccttttgcgccgagccggcctccgctgccatcggctgcacttctctgcgccaagccggtctccgaccccttcaccgaacgatgccgcgccggcaagctacagccgtcttccatgccctcggttagtcaaccgaggccgccatgcctccggtgaccgcaaacacggtcaccaccaccacagccttggttgccgaacacccagccacctcgcccccgactccttccccgccgccgacgtcgccactgcctccagagtcataaccgccgtcgccgctgccaccgacgccaaccgccgcctctgcaaatcgctgctccgccgtcgccctccaccaccgaacagctagcagcccgacgccatgtcttccgccgccgttgccagatgacacggcagccaccacagccgccaccgccgtcgccaactgccatcggccaactaccgccgctgccgtcgccacaccgtcgtcgccgtcgccgactgctcccatcctccagatccagccgagaggcacggatctgggggcaccgctgccgtcgccgccaggcatcgagccaccggccacagcagctgcgcctccgagcctgccgctgctgcccgtgcttgctccgccgtcacgcctgacgccgccgcccggccgcccgtgcctgcgccaccgtcgcgtatgccaccgcctgtcgcggccgccagcgcccacgcctcgccgacgccgtgcccgcgcctccgtgaccggatccagctgcgagcgcgccagatccggtggtggcgacgccggatccgccgccatgcgcctcgacgccggcgccgctccggtcggccaccgcctttgcgtccacccgcgccaggagctcgggagatggccgccgcgagcccagccgccgccgtcctcgcgagccgccggctttgccggccgctcgctcaggcgacggcaaggcagaggaaggggcggggaagggcggcggcggcggcggctagggttccgccgcccgagtcgcccgacgcggggggcgacgcgggggccaggagagagttccctcacgggacattcattcatgagaaaaaaaaaatctatgtgaaatttaatctcctatggacattggttctacttgaatctgcaccatctgttaagatttttggtgtcaaggtaccttatatcttttttcattgtttatttatcatgatttgatttcagctatgttctcattaaagtctttttgatgataagtatgcatgacgtcaaatatttaattcttctcatgtcttgaatttaggtgtggaaccattcatgtgaccaggatactgtggacagagaaatattttctgaaagaagaaatgatttgtgggatgttgcacagttggatagctcggtacattataatcagctagggaagttaaattttggtgggttcaatccaacaataaaagaacacttggatttggtaagaactgtcattgagcgtgctcccaaattaaagtcagtttttttggaagatagagaaccctgtaaaggctgtgaagcaatggacaacccaatttatccttcaacaatatccatgtttccacaaaatgaagatgagaaaagcacagtggcgaagcaactcaaagctgggacctctcgccctgttgaaataatcttttgctaataaaacatggattatttgttatagggtacggagtacgaaaatgctttatactttcccatgatgcacttgaacgacatgcatgactgcgtgagcaagcgcggccactctgggctggaccgattttgggtgcaacaaaaatagtttttcattttttcaacttatagtttttcatttttgtataccaaatgtttatgtgtataaagtttctatgcaaaaattttatgtgtataaagtttttatatggaaagtttgtgtataaagtttctatatgaaaagtttgtgtataaatttttaagttgatttttttagttttgcataatgattctgggtggaatttttttattcatgcatagtattacagtgtaaactttttaattccatataacagtgttttttatgtagagtatttatcactagaagttctaatctagttctatattagatatatatagagtttcatggtgggcttggtgtgcacaatgaacatgggcataggcgattgtgtgggttctaggagtgtgacgggctgcgtgctaggagtcccctacggagtacttgtaaaacatatcctcgcaccctttaaaatgatggtttttatttctatgatgtttcatgtgcttgtctactacattgatgattggtcacaggccataataattataaattttgacttgtgtctgaacttatttccccggtagcccattagccggtcttcctgaatccacagcaataatctgatcgatgatctgaatcaaacatgactcttgtttctctcatagcccattagctggtctacctgcatccaccgcaataatctgcttgataatctgaatcaaacagggcacatgttgccttgatttaccttataaacttgcacttcgtttacagtttaaatttggcttgagagagagcttatcttgaggttctgtacagattttttgtgatactacatatgccaaaaaactcgtgtcttgagactctgcacagatatgtccatgcattatattcccaaaatcgacgtcgaggcaccttgtttaagccatggcacaatattttccaggactatgattacccaaaattttgacaaactaacccttttaaaagaattgtattttaaaaaaatgaatcgtgccaaaaactaattgaagaaatgaatcgttgtcttgatggtgcttaactataacgttttagcgctacaaatataggcactgaatggcacggttcattattaaaaataactttttataaggatcattgtggcaaaatttcagctaagactacctttgtcactacaagattcatgcggtcatagtttcatgcagggcggatccaggaacaaaaaaattggaggggctcagttacatagtatcttcaatctctagccatttaagaacctttactttatcattcacggtgaaaaaatcgaggggggagtgttccgggggtatccatagattttatgggtgcaggggggaccacgttggatccgcccctggtttcatgtcaatatgccatgctttcaagctatgcacaatccaaagttccaaacttctgaggggtaacgtccgcaaatttgtatcacaactaagcttgccaccatagcaaactgaaatctagctagtacactcaataaaagtacttatctacttcgtactttgcatttcacaagaattatgatcaatagtgataatacagtcaaacaatgacacattactgatgatgttaatgtatgctcagttacagagagacgaccggaatcccccccccccccccccctcttctctcctctttcttctcgaactcaaactgctgcgttttggcactcacaaaccaagactcgcaagtcgcaagagctacatagctaagaatattaacgcgagggcagtttactaccgcgtacaaatgatttttgtttgcaatttggttgctgggtcattcttggcatctggattctccatgttttcttcatcagagcttatgttgtcacattggccactgcctgcagcacctcacgggcctctgccaaagcagcagtagtctggaccaatcctagagcatcttaagttctatcagctgggctgacaaagtatgaacctgggaggaacatatgggcacgagaacctaaccaaataaaataacattcagcaaggtcccaaatgtgtgacagcatgagggattaataataaaaaaatctcgggcacaaaatatattccaccaaatacatgaacatgaaaaataattgaaaaagagctaaatgtacctgaaattgcatatcgacgaaccaaggggcttccatgctaaaggagattctagcctgtgctgatacctggggtatcagccaatctaacaagagccacggttcagaatttcagaatgacaaattaaccgaaggaacaaggatcaaataacaatctcttcaggcttcactagttggaaacaagtgggtttaattccctaatgtattcttcatcactaggattctattcaacatttcaggtgctaattccagtaaaatagtgtttaaaaggcttatgataattcatctgataagaaagtgttttctagtttctgactaaagatggaagctcttgaaggaatattttgatatcatagataagaatgggcattaacttcgtaagttttgtattggattaggtatctaagtagatatcagtaaagtgaagtatgccaccactgaacctgcaagtcccagtttaagttttggtttagcagacttcacaactcttcagaagcatgcaggagtacgaattcaatgcattgatgcttgctaatatcaagaaaaggaggaactcatcactcactagagatcagtttccataaaattaatgtgatttaattttcacgtaatctgagaaatgtgaagattaccaaacaaaagaatctgatgcaaaacaacaaaagaatatgtgatagtgtgaagtcttacatgctcacatattcataatgcacatttatgcagtgtgaagatttttccatgatgagttctgcgggctttgatttagcacacattccttccttacacactgatgacaaagattccatatatgtgttcagcttctgattcatggcaatttagccataatctggggaaacgagatcatcaccgatgtgctcaataagaatacttgcaggttgctgcaacaaccaacattatagataagaacaagatcatcggcaaaacttatttgccattttgccccagtctgcccatcccccatatttcatagatgccaacatggttaaaaggcacttgctacactcagacactcagggcattaacttggtttagtttaggatgtaatgctaaatttactggacttacacctgcttccaactgatccatctcataaattataaaggtgttgctaccttttatcctcaatgaattatggtactacaaacaagctaaatatcatcagaaactggaagtaattactaaattgcctgacagatcatcataagtagtagctacttttgttgcagaacggcgttcaactcttgcattcatctgcagaacaaaggactagaagtaagtagtagttgctagcacaaagaagctactctattgagccccttaaaatttcttgttatatcattttcttttcggtgcaagctagatggactaaaattaaatacaaataagtaattttcatggcattactgttcccgacattgctttcctatacgtccaggcaaagcttgagcaatggttaaccatttcttcggtccaagtttgtttaccatctgaacaatgatctcatcttcctgaaaaggggaacatgtcattgtgagtataagatgactaaccaatattatataagaaatgaaaataaatggactagcatgcttacttctttggaccatggccctttgaccaattcagggtgtagaaccttttaattgccacctgtgcaagcattgtacatcggttctattcgcaagctggaaaattagaaggtcctctgtcaaagcttggatttttaacaatatacaggaacctcatcaacagggtaggaaaaagaatgccagagaagcatgactagagtgtaagctaatgaaacagcacaatgctttactgtacatgagttgtgatagcatcaaagaggggaaaaaaatgcttgcgtggcttaagatatcctactgcactgaagtactaaacaattgtagcgcaaggtgggcttgagaacaatatggtaaaaatgtattatatatcaagtataatattgtgaaatattactcctgttacaacctgacatgtattgacatataactgtatgtaatcacaaagctaatgtgtaaaaattaaaaaaaaaatccaagggagtccaacatatgcatggtaggctatataaaatgcagtgatatagataccaaaggtcacacttttgaaggtgctccccctatgttatttcatctctcaaaaaaaatcagtaaaatgatatatgaattggactttagaaggctattttgtttatattttccagcatacaaaaaacaaccgcaacaaagttgaagaaaaacaaaaaatatgacagctaaaagatagtagaaatactatgataaagagtaaggacaaagtatgccaaatagaaccaatgcactaatagaaccaatgcatcccattgtatgtctgaacagctctgaaacgcacctaactttttcccaattcttcccattgcatgtctgaatagctctggacaatatggcagcctccattgatcagctaaaagctaaaacaaatggtatggtttccactctccatttgtttctacgacacgacctacattttagctgaaatggagaccagctgcagaccacgttcaatgacttcaatcagctaatcaatgaagacaatcaattatataattgtgagcattgttcaatctatccatgtcatcctgattttgccaaataacaagcacaatcagatatccagacaaaagatcaaaacttttgccaaatcagaagcacaatcagagtccaaagatcaaacttttgccagatcacaagcataatcagagaccaaagatcaaacttttcccaaatcacaagcacaatcatatatccagtagataggaaatgcatcacgaaggttcatcgcaaatacttcgcaacattcatccattggtagcctgagacagttagtagtacgatctaagcctcggtaccttctaattaagcaacactagacgatagatagcataatagcatccctaagcaaacattgactataggcatcagtgatcagtggagttggccgttgacgtagtggcggtgggggtcatcggcgcggacacggtcatggagtcgcgggcgaggtcgtcgacgcggcgggggcgggggcggtcgatggggcgagggcggccccgatcgtcgcaagggcgggcgccgccggggcgtcgtcgccggctggcgtgtcggcgggcatcttcgccttgaccttgtcgaagatcttagccatcgcagccttctccttctcggagaacacgacgacctcatcatcgccctcgtcgtcgctcgcgatcccggcctggatgcgcttcttcttgtcatcgcggatgatcttgcgatgcggttttccctggacgccactgaaacgatcgaaacgcaacaagggttagcagcccgcgaaaccagatgagatctagagcgctcgcgcgcgcgcgcgcgaagccttcttaccgactctcggcgctccgggaccactccatcgcgactccggcggcggcggcggcgaaagaatggagccggcgcggtcgggacttggacactgctcactgctctccgtgtctccctgctcggaccagcaactcgaggtagtatatatagccatcgtattgggccggcccataaaccctgggctggaaatgttcgtatgggccacactaggcccaaattttgggcccatgaggcgatagaaaagcagcccaaccacgagttcgccggcgacatctgcttccccgaggatcgactccggcgagtaaccatctttctcctcccgttgtactccctccgtcccataagtgcaatcataagtttccatgtccaactttaatcgtccgtcttatttaagtatttttgttgttatgggatgataaaatatgaataatatttacttgtgacttatgtttttaaatttttttaaaaaattttcaaataaaacacacggtcaaagttggatgcggaaaaccgtggctgcacttaaaatgtaacggagggagtaataaaggatcgagttatccgcatccgtattcctaagctttaacagatttacgtatccctgagaaaaattacttataaccatcctggtttttgaacaaaatcgactatccttaaaggtcacactaacacttgcactatcacagagatgggtgtagtgcgcaagcaccattgcagagcagctactccaagtctccgaacactactacttgcccctccagaattgtaacagctggagtacgtagataagggagaagtgaattgtaaatggtccactcaagtattcaaatcccattagtatgtagataattgagaactgaaaaataaatgatcggaggtttcagcagttccacaaaacatccgtgattaaaatgtgattagatattgatgctccacaaaactacctgtcggcaatcaatattctttaaaatattatgggtgtttgtttgtttgttgcccgagtaaataaacccaatactgtccttacgtatatttatatttgaagtatatactttcagtaatactcgcactaggggtggaaacgacggctcggcttgcagtggttcgcaacaaaactaggcttggcttggcttggctcggctcggttagggaaacaagctaaaacttgagctcggcttggcttgtttcctggctcgagccagctcgagctggcatgcaagtcttcctgttgaaacacctcttcatatatattttgtaactattaaaaaaacaagaacaaatcatcaacttgtaaaatttaaataagtttatatattcaattcttcaaaatcttaaagaaaaatttcaagttggcaaataataactccataaaaaaataaataatcgatataaacacatgatggcctaagctcgcgagccaaatcaaacggctcgcgagccagctcgggctcggctcgtttcaccaacgagctgaaaaggagacttagacttggctcgtttggcttacgagccgagccaagtcaaccaagctcacaagtccgagctttttttcccacccctaactcgcactgtcgcacatcaaacgtataagacgtaagaaatacttcagtaaactagcaaactatccggcccagcccattatactacaattaaaccgtaatagaaaaaagtacaccgaagatccctcaacttgtcatcgagataaaaaacgtcctcgaaatgcaaaaccagatatgcggggtcccttaactatacaaaaccggtcacccgaaattcttcggtggttttgaccccggttttgttctatgtgacggctgagtcagcaagagacccacgtgggacccatatatcaggtgtccacgtcaccctctctctttcccctttcttttttttctcttctttttcctctcctctttgcggggctgagcggcggcttgcgagcggaggcgcggaggaagaggcgggaaaggaggagggcgg

SEQ ID NO: 14378 - DNA, 4879 bp, Oryza sativa
aagccgcctcttgcactaagcacacgctgacacgcataagttaacagtttaggacttggcaacatcagctagcagtagagcacacgatcagatggcaatcacaagcagattaagcatatacatggacgaacgacttaatcattacagtttttttggttgtcacgtaccacgaagcataccatatatactcctacatgatgatgccattttctttcttaccatgattttctagctagctagctaatcgatcagctgcttgattgatcagtaggcagcagctgcggcggcggcgcactcaatgtcgccggccttgtcgtcgacgaccttgccgccggccatgacggtcttgtacgagtatctggtggcgacgaccacgtagaagacgaggttggcgatgccgatgcatgcgagaagccagtagaagaggtccagcctgctgttgttcaggtccttgccgaaccagccggcggcgcggccgccgtgcgaggtgacgccgacgaacggcgtgagtgggctggcctcggggaccctgtaccggtagtggcgccagcccgcgaggaaaacggcgagggagacggccacgacgggggcagcgccccagccgaccttctcctggaggtagacgatgatggtgacgccgagcaggacgccggcgcagagccttcctcctttcccgcctcctcctccgcgcttccgctcgcaagccgcctcgccggccgccacgcgctcgcaagccggccgccgctcagccccgcaaagaggagaggaaaaagaagagaaaaaaaaaagaaagggaaagagagagggtgacgtggagaactgatttgtgggtcctccgctgactcagccgtcacgtagactaaaaccggggtcaaaaccaccaaaggacctcgggttaccggttttgtatagttaagggaccccgtatatctgttttacagtttgaggacgttttttatcccgatgacaagttgagggacctttggtgtactttttccaaccgtaatattcgcacgggctttaactccgtttaggccacggcccaaaactatccccggatgggtgcgactgcaacctatttcagcagcaactccggtgtccggtgttcgatgccggttgccctagccgccgccgccgccgtcgccgtcctctctctcctgtttcctcgttcgtaggatcgatgatctagtggctttgcggacaggtagttcgtatttttatcgtcctttcctgggcgtgttttaaattcatcttttgctgctggttttcacttttcagaatatgcatcgatgctctctgcgggttctcaagaaaatacaggagaaaagaagcattgatcttcttctgtgatcgaagtgatagaaatcaatggaatatcccttgttttcttggtttctgagggtaaatttccttgtttttccaaggataaaccgattcgacataagttaattaccaagtcggtttttcaatttcagtatgaatccaattcgagcatatacaagtaagtgccctaattcgaatcaggctctgaggctggtgaaattccctttataaataagctcgacaataacactgatctcatatttgcataccatccgagtggaaaagccccattgtcagtagtcatgcagtccaatagcatccaaagctatgtaagtctctttccctctctctgttagtaatttttgttagtagtttttccagtgtaaataaacctaataccatcctttatatgtttagtatttcttgtaaaattaagagaacattttaaacttcagtttaaatgattgagcactttattggtgtaggaccaaggtagattcaaccaattgccggatcatatcttactctctatcctagaaagagttgatatgcgcacagttctaaggaccagtgtcctgtcgacacggtggaagcacctgcctcttttgctctctgatgtcgacttagatgcagatgaattcatccaccaaaattcctcaatgtcggccgatgaagcgatggctgttctagttaaattgatgagcagtttatttggttctcctcggagcgaatctatcattaaaaagctaaacctcaggttctgcttgctcactgatttggagacatcattagattatttgtttaacatcggtgagctagtttgcaatgctattgacagtggtaaagtaaagagcgtggagcttgcgatcacaactgagaagcggagtgtagattgcacgtctagtgatatgctgctgcatgcaaagagcttagtggaattttttaatatatctcgtagtctgtcatgttgcctcacgaaactcctcctgtgtacggcaaggttttctgaacaagatctgcatcaactaataatcagctgtgatcagctgcagcatctaactctctattattgtgaacttcgggattcatcaacattgaagctggatatgccgaattcaaaactccgcttcgttgaactcaactcgtgctatgtcaagaccgtagagtttctctgcctacctaaactagagcagctatactgtgactcatggcgcttatcaggggctcccctatcttttggtgtagttccttgccttgaggaactacgccttgtttgcgacgtcacgtatccagtcggggttcaaattgactgatcttcttcatggtactgcaaatgtacaggatattgctttggatttccaaggagaggtggtaagtaatttactaatttaattacatggaaagtcatctttattaatgtcatatggtggtggctgttggctacatgttgctatgaaatttgcactgaaactgaaagagcattttaaaagcttttttttttttgtgtgtgatttgatcttaatggcaggtactgtttgatcctttttttccccgaccaaatctcaaatactcagattatcttttagagtacaccagggttactattggcaccagggttattgagtacacaagtgttggcctgattaagagctttttgtgcatagaaataattccttgtttattttgttaattttacctagatttggattacacctgaaggaaaaaagctacgctccgccttgaacaagataacaaagttatttctgcatgggatctatgtgaaatttgatctcctatggacattggttctccttgaatccgcaccatccgttaaggtttttggtgtcaaggttatgctgtcattttttcttgtttttttatcatgatttggtttcagctatgttctcattcaagtctttctgatgattagtacgcatgatgtcaaatgttttcttatatctgaatgtaggtgtgaacccatgcatgtgacgagggtactgagaatagaaaacaattgtatgaaagaaatgatttgtgggatgctgcacagttggatggctcgatacattatttgcaactagagaggttagaatttggtggattcaaccaaataataagagaacacttggatttcataagagctatcattgagcgtgctccaaacttaaagtcagttattttagaagacagatccctgtgaagactgtgaagcaatggacaacccaatttatccttcaatatccatgtttccacagaataatgatgaaaagatcacaattgtgaagcaactcaaagccgggatgaatcgccctgttgaaataattttctgctaacaaagaatgtatttctatgctattgggttcctgtaaaaatgatgattttttttttcgttatgcgtaatgggctagtcagatacctagcttgattggtaaagttatcattggcatagaccactgagcatgttctactgttcttcagtgctgaactggtcgtgatagtagttcattagccgatgaacttctcacgtagtagtagttcattagccgatctccctgatgtacaatgataccaagttgcagatccctttcaataaattatataattgtgagcatcgttcagaatctgtatataccatcctggttttgccaaatcacaagcagatactatgcaaatactttacaacatcacaaccagatatgcaacttcgcaaatcgcaacatcaacataacaatcagataggtacttggcaacctaacgatcagaaatcaatctgatatagattggaaatgcatcgcgaaaccagatactatatcacaatcagaaatctgacatatattggaaatgcatgaaaccagatactatatcacaatcagaaatctgatatagacaggaaatgcatcacaaaacagatatatcagatacttggcaacatcagcatcacaatcaggtatatcacttggcaacatcatcacaaccagatatctgtcatagataggaaattcatcgcaaattgtacttcgcagcatccatggatcgataacctgggatagttagtacggtagttcctaagcaacggtagctcctaagcaacataagactagcatccctaagcaaaattagacaatagctgatcgcatcagtggagatggggattcacgcagtggcgatggcggtggtcatggagtcgcgggcgaggccgtcgacggggtcacgggccgggggcgatcgcgtcgggggcgtcggtggggacgggggcgatcgcggcggggacgtcggcggggacgggggcgatcgcggcggggacgacggcgggggcgggggcgatcgcggcggaggcggcagccttcttggccatggctctcgcgtggatcctgttcatggcggcctcttccttctctgagaaggggacgtcctcgcgatccacgtcgccctcatcgtcgcttgggatcccggccttgatccgcgtcgcgtccttttgcgagctgtcattccggtacggcttccctccgacgccactgaaacgaatcgaaacgaaacaagggttagaagcctgcga

SEQ ID NO: 14379 - DNA, 3438 bp, Oryza sativa
ctagctagtttgcaacgatattgaattattgctagtggtaaagtgaagagtgtggagagattttgatacgctgattgctgttggcactatacttgtatgtgctgcaaacatgtgatcagccatgattcatggcaacaggatttccaagccgatgcatgcatcatgccaccattactttggacttattttcagagccctgagtgatgatggtgttctaagagatgaaaaacagtggacgatttgttagaacgtaactctcctgtgtcatcagatatattcagacacaatggcgccggctcatcacagccactaatttttctccctttcacgtttgaacctgaaaggtcgctattcaccggctcacagctgctccatcggtgttgaagtggccgctggaggtggcgacgccgacgacgacgttgaaatgaggtttaggatttgggctagctgcagctggtaccgacgacaatgtgcgtacttctttggctgagatccctccggtgaccgatgccggccgatacccgattcgattgccctggccgcgcgcggccgctattgaaaaccgatacgtcacgtcacctaacacgtggggtacaccgtacacccagaaaaccgatgcactgtccgtctatatggcggatgcggcacacggtgcgcggcgaccttagcggagggtttttccggcagaacgtcgcactgcttctgcggcgtctggggtaccgcgtagctatataggctggcccatctggatcattagcacagcattagtcacatggcttcgagtacctttagcaccgggcctcttagctgacgcaaatgattaatgatttataactattcttcaccacaagaaactagagcaacacagatttaactttcatttatgagattcaaactttgtattctgtccgaagctacaagaaatatgatcatcaatagtttgattccacatgctatgggtaaaatatacgagtagtaatcataaggatgcttcaaggcatcgtatgctttggccgagtctagaccacgtcaaaaaaaaatactgtcacatttacagtttccgcaatgaaaaacgatggtgaaaaccatcaactaaagccctgtcaatccttgcatatgcttcttcatcgcacggtctctccggtgatggttatcccggccaccacctctccttccacctctgcctccacgaggtgcaggccctcctcgagcgaagccctgtgctgcatctggatcttcatggtcctccgctggatggtcatggttcctgcctcctcttgttgcgccacggccaaatccacgttggccattcgggttctcgtttgcctctggctggttgccgtgatttctgccccctcttcttccaccacggccaaatcctggtggcccgtttgggttctcgccctccggcggtgggtcgccgtgatcccttccacctcttctgccatgatcgccacggggatatgagcctcctctgcctatgttggagcctcctctgccgaagttgtttgcattgctaccctcctcttcctccatgtctctgtgttgttgcctgttgggaactccaagaggtacatttccaccacggccaagaccatgaatggtatctttctgaacattgcgcaggacagccgcttctcgggcactagatacagcaactgaaccagcaaccttgtagctgtagttcttcccgtccttaacataaaactgtgtcttcttttgtgagctccaccgtgggccctgtgaggaactctcggcatcattggcaccatcagtttcctcataacttgattctaccacactgaagccaagatcatcgaacgagtcatcatactcatcatcatattcatactgggattcaagcacagctgatctaacagcatcttttgctttctgtgagtctagagttgcagagtcaggcacgtcgtcattggtcttccttgtaaatctaccttgcgggactgatggtacagatgaggatggtccctgggatgctgatggaactgaagaagatgaagaatgttcaacatagcgatgcatctcagtattaaccttatggggtttgttcataatttgaggctcagtctccacaagtattcctttgcccttatctttcccaacagtggctgcaggctttaactgcggcatctcttctaatgaagtatccagagctagaagatcttgatggagggttccatctaaaatcctttggataacttcctctgggttctggttgtaggcttccaggcatgcagcgaggaaacccttcccataatcaggaaagaggtcccttatttgagtaatcttggactcagtgatggcagtatcctcattcttatgttgtagttcaccaccataggaagagacaggcaaatcaggcacactattccaagatgtcagagtagatccacacaagcgtgcaatgaactggaactgctcatcatccatgtgtatccatcctgtttacgattggaggaacatattgaatacatcaaccaaaggttttggcatcaatataaaactatgacacaatcaataaacttgagataacaagaaaatacagcatatatgtcaacagaataatgctgacagtttagcaaactctttcagtcttcacaacagaatctagccaaaacagaaaaagtgatgtcttatgaacacaactcaaaagtgccagaatgatcaaacgcgagcagaaataaaatcaaatgtagggtaatacgggaatattattggtgaactttatgagaacaaaacaacagaagctagagcatcttttccttttactagccaaaagtccatgcgttgcaacggaaaacaaattgagtttctagttaagtcaattaagcacatagttaatccaagtagtacttttatgattttccttattgaacaagtaggtgattcaaaatttggggagaaccagcagtgaaataggaggaccttgttggagggtgatgtaatagtatagattgtgggacccaaatgtcagtggtaaggatggtgtggcagaacagacaccaccacgtatacattttaagtagtatagatataaatatagataagattctgttttggctctttctctttccattcattgagatcaatatgctggatcaagctggaagttttaagctttctaagaaccactcatgcatagatggcgagagcaggcatagtaacagaatatagaatcataggcaattcagtacatatatgtagaataattgtatgacaacttctgaataaagttcctagatcgtatatgttgtttatggatgaaaaactaaagagacaattttggctgaaataataatagtgggatactaaggttgtgtggaattttacaaacatgaaaataaccaagcatttaattgagattttttatcatttacctttctttcgaatatctccaatccggttcatcaacttgaactc

SEQ ID NO: 14380 - DNA, 8235 bp, Oryza sativa
  unsure (1)..(8235): unsure at all n locations
attgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaatgaataacctgaatcctttgcagaaaacgataaaagttttagcatatgcgattgggactacagactaaagtgaaaacagctgttataatgatatcatatggatgttcataccagataaaggaatacagaatcctataacagctatgtgcagtgatttatgaagaagatcacaaaataacctgtaatgatttcatgcacctctcctgcattgtgtggaaaatgcccaggaattggggaaggacaatattaatgccatccagaatatttggctggacattgatagcgttttcaacctacagatacagaaaatgtgcacttgttattaataaaattataaaagtattcatgccaatgaatagaaaaaggttatctgagactaagggaatgaattagaatttgcatttaagttagcatctgtctgcaaaatgaaaaggagaaaaacaacaacaataataaacacttcaggaaccaaccagtgaacttgtcaatttgcaattgtcatgcccataaatagcacaaatgtccaacaacttgggtaaatcaagcaatcttttctcctgcaggagggctacaaccgaacaacgtgaatatagtatatttgaaccaatggtcactatccattctgctctaaaaaaaggtaaactcaaacagtgatcatatgagtagttctaatctcacctgcatgctccttcatgctaagggattcacccctgaatgctccaggatccttgtttgaagatctaccacccaaacaagagccatatcatgacaaatctcatgtgaatctgaacagtgtgcattatcttatgaaaaatatgtatacaagaaagatagcgaaatggtataaatctcacatgcggtacaggaccataaagactcgacggcaaagctcaagctccccgacaactaagccagcaactgtccctttgggtgcacgatgaggcaagtcataccaccgatgcctgaattgtaggtaactgtccaggaactcatgcagggaagtattctgtgccactgggaaaaggtaacgataagcattaggaaaccattggtaaagttcaaatgcacgcggatttattcataagttaaattctaggagtgaaacaatggataatcacagatctaggcgtgtcctcaactcaagcttttatgttgactcatctactcgctcaattattgttcaggcttagtttgcataagaaaaaatgccaaattcctctgattgtagggtagttattcctgtcaatctgaagttcctgtcaatctgaagggactaggattaattccttcccattaaaactatttcaaaggatcataggtcatgatagtgataagaatatgattgcataggctttgctttgcttatgcaactactagccacttcaactgcaaatgtagtaataaatttaactgcacgcattttatcttgcgcttaaaagtgcaaactgacatttgaacaagcatacactagaattttacacataatccgtagccttagataatcacagagaccgaagcatcagaagatgcattcaacaaacacaattgaagcaaacaagcagtaaacaccgaacattaagtggttaactagttatcgcttccaagctttcagctctgatttcccaatcccaaaataacaattcacgccttccagctacacggtttcatgagcacagtaatgcacaagcgagcgtttcggttaccctggcgccagaactcgcggggcttagcgcggaggagcgcggcgagggcatcgttgaggaggtcgacgacggcctgcgactcctgggcgtcgggcccgccgagcccggccgcgaccacctcgtcgtgcggcaggtacgccacgaacccatcggcctctccgcccaccctgccggcgccagatgcagacggggaagccgatgatcggagggcggtggtgagcgtcggcgggggcgagggtttaggtgcggcgggcttggggacgtagcgctgctgcggctgcggctgcggctgcggctgctgctgctgctggccgtggtggtgcctcggggcggcgttgttgtggcggcggtggttgtaggagggtttggattgctgcggcggcggcgcggacgacatggctggatcggggggaggagggagaaggagaagccgtcacggcgtttcaggacagggagaggagtaggctttgtagattccggaggggtttcccggaattttggggagacccaaggtttcttgtgacaatgtacaatatttaaattgccatgtgacaatttccacctttaaaaattgtaaaaattggaaggggcgtatttcgatcatttttgttttttttttcgtctcaagctcttcatatgatttggtttatagtttgtattttgtctgttcaccctgtcgggtagaaaatcaaaatactaagccatgttttatgaaagagtgcatatctgaatattagtaggagcagtactactattatttaggcaaaatgtgctctaagacactcaaattttatagcctttgtcgtagaacacccaaaaaacgtgtatttattgcattacaaatttgtacttttcgctttgttggactcttctatcgagggagtgagaatggactaggtctggtttggttcaaacaaagttatcttacaagccgattgacacaagggcaaaattgtaacttttctcttggtgtaggtctgatccgaactagatctggttgggttaaaaagaaacatgcaccataggtaaaaagttgtcttttttgaaagtttctctctccatttagatccgatataataaaataatacgttcagcatccaccagctaattaccatgtttttagtggtgtcatgtaataaatacacattctttggatgtcatacaacaaataccattaaancctttgnnaaggggaaattccccccttnttttttttttttttttttttggggggcccctgatatttatggcgaattgaggataccttagctactagtaaggtttcttatgatggnacctgctntctnnnnnnnnnnnnnnnnnnnnnncnaatacccnnatcccnnnnnnnnnnncgtttaaaatagcaaactatgatgggatgagacccatctaagactatgaatctggacatgagacatgtccggaaggagtaattattttcactggtagcgatatacatgttgacagcgagtctatgatgtgcttgtatttatagctaattatttttagtggtggacaacgtaccatattacttgtggtgacttcgtcgaactcaaaatttgtaggtatatacagacaccagtggtgaccggtaacctcgtcaatcttaacatattactaactcaatcttcaaaagtattcattagaaccaaatgtacacgtgtgtattatataagagtgagcttatatgtctgtgatgttttcatcgagctcaagatatacggaccaatttttttagaggtgctcatgagataggttaagtacgtatgcattaagaacaaattcgataaatgaatgataaatcagcaaaaattaattatcaaaaaaagacactaatattacttcgccatttggtgagattgtggttgcatagagctagcgtagaagattaagaagcaataattcaaaaaagatgaataaataaaataaatttagacgattcaaaaaagatgaataaataaaataaaattagacgattaagaagtcaaaaattaattatcagagccaggtttcgatcctgggacctgtgggttatgggcccaccacgcttccgctgcgccactctgatggtgttgtttaggatgttaaacgtttctaatttaaacaatgctctataactaatcattcggctaagaacactaaggcatcgttcgtttaggggtgataggggagattggctctcgttttccgcgcgcacacttttcaaactactaaacggtgtgttttttgcaaaaaatttctataggaaagttgctttaaaaaatcatattaatccatttttaaattttaaaatagttaatactcaattaatcatgagctaatggctcacctcgttttgcgtatcttcccaatctcctcaatccccttctcctcaaacactccctaactcattcattattaggtataagaacactaactcatccattctcgaacactaactcatccattatccattctcgaacactaactcattatacattctcgaacactaactcatcattctcagtataataacttcactaatcattcggtattcagatataatataagaactttctatctcagattttttccgtttgtcaactgagcacagcctgcgatgtgtaacaatcgaatgctatatatctcccataaatgctcgaagaaaagcgaaaaagtacaaggacgatattacagtgctttggtatgttaagcatttttttatacaaaaagtcagacttcataagaatacaagtccgcgtaatttataactcagatagcaaaacatcgggaacaactagcactacagcaaaactaatactatgaaaatatagaaatctcagatgaaaaatacacttctgattctagccagctgttggctcctcacataacaattcgattcaagggttcaattgttcgttttgcattgctctggcctctggagcacacttaacatctatagttagaacacattatctactgtaaatccatcacttggaaattccaaggtgtggggatataggatgtcgtggagatagtaaccatctgattcttcagctcaactcgttaattgcatcaagatgagtatcgtatcaatattcacagtttacatcctacggttcaagctctttgttttcctgagttgatttcccagttttctgtgcttgactttctttcttgcgctgcatcgattattagagagaaaaaaaatatgaggcaaagcagaactcaattgaggtaatttgatctagcctaagctctatgtgcagaagttagaaaagcggagaacataagccacataaacaaataacaatggcaaaattggttctagagcatccaaagttcatgtgttttaattttaaagcaccgaaagttaatgttcactttaatagcactgaaaagttccctccattcccgctcttagcactcccgtttctttgggtgagagatggggttccagctgcttgatttagttgatctgaagatgtgttcggctatttcagttgaaaggaggatagggttggaatttcaggtgcttgaatgagtcaatttcggtcaaaactgacgtcacatgcaagaaaagaaacgggagtgctaagagtgggaacggagggaacttttcggtgctattaaagtgaacctgtaactttcggtgctataaaacaaaaacatgtaaacttacgatgctctagaaccaattctgccaataatttaataaaagatcccatggattcagttcatgcagcacagagagctaaaagggcctcaggtgctgttttatcaaatatatatatatgattaattctggtttaaaaaactgtggtttagttcttgaagtcacaggcacacagtggaaacctatctaccgctgtcgccatctcctcaatatcagcaatctaatggatgaatttagatatctcctcaatattagtaaatgcttatcattagtaaaacatgacaaactcttacaaagaactgctattctgccagtcatgtatcaaccaaaaaagaaaggtacaagaattttaagcaatagagacattaataactgcaaccagttaataacagcaagagattcagcactcaataacaagacagattaatctcccatcatctttcaattagttctttttttctcttgcatctataatgaactacagcatttggttcatggtgaaatatcaacagatcacttaatggaagaataatgatgaggtcagcagctccaagagaatatttaggggaaaatagcatcagaagtgtaacatttcattttcaaagtattagcatgtcggtgagcggcataccttcggaagaagtccttctgcagacatcagctcatataacttgcgcatgattgtttcttcttccacctgtacagaccaacattttcaaagtattactatctaaaaagttacttccaagacatagtgacgcctcatactccaatactctccatataaagctcacctgaactttatgcaactcgtgggacattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgcgcgaggaagcccgcacggggtgaaagcctgaagcaggctagggcgagttcaggaagaagaggggaccgtgctcaccgcgccgccgatctgctcgccggccgcggacacgatgaggcgaggcggagcaggtgcaccacggcgcggagcggggcggcggcgttgaagctctggctcaccgtgctcaaaagtcaagacaggcaggaggtcgattgtggggcggggccgtgcagcgctctgctaccgcctgcctgtgggtcatatgcacaggcccatgaggctggaaagaacaaatttttcatctcggaaaaagttcacctaaggtcccttttcttgacgtcgagttttaaaaccgttcctgaactgaaataccaaga

SEQ ID NO: 14381 - DNA, 2043 bp, Oryza sativa
ccatcaattttcttccacctctctcgactctcttctcatatcaacccaaacctctagggcagccgacaacgggtggggagaagggtgccagccggcggggacaagctcgacggcggagactgccggctagtgtggctcccaatagccgggagtgctcgtgtcatgtacctgactgcgcacccaactgcaattgcaatgtattcacctgcacacacaggggctggggcttccgccacgtcatgctgcccaagctcttattccccaaactcagagccatctccactgagctgctcaaaagccgatttgtttaggtgtcctcgagctttgtctctcccccgcggaggcgcacgcacagctccactgcatcatcttcgaggtcaactccatttactccacgctgtggtcgcgtcatcctcaacgcttccgcccttcttcccgccacccgccaccgtcaagcttctcgccggtcgccagccttctcccacccattgccggccgtcaccgtcaggcttctacttggcgtcgccgcccaacggccgctactcttctcccctcctgttgtcggatgccccagaggtttgggttgagatgggaagagagagaagataaatggaataagactcagccgccacatcatcaaaaccgaggagtaatattgccttgggacctaatgtgatctgattttacaagattagatatgtgttatgtctagtatttcggtttagggatgattttgaaacttgatgacaagataagagacctcacgctcactttttcctttcatctctctcgttgcttttcttttaagaatagtaaaccgactagcgaaggtgttctgccaatttctcagtagttttcacattccgttgcccaaaaataagttcttccatggcaggatctgctgtacgaggaggcaaggagcgaaatggtaaaaaagaactcgatcaatgaggtatataattaaggttggccatcctttgggaatgaatcaaatggattcaggatggaaaaatgtactgtatcaacagaagtagaagaaaaaaaaatatgtatttctgcgccagctgcaaagaaccatagcttgagctagcgtccgtggcgccatggctggagtacgtggatcattgctgctgcggtggagagatcttgaggtcgagcccgacgttgaccccgttgtacgcgatcggcgcgaacatccacatatcatccgagctcagaagctgcgcaaaacgatgaatcccattgctttagcttatggaagattagagaccaacgcgcgaattgaagcaaaacttgggctcttggattcgaatcaggggtcttatggttaccttgatttggagctgcaagaacttgacgtagtgaactgcttcttcaagcatcgtgctgatgtccacctgaaaaaaataacaagtcctcgcatgatcagagcaattcagtatcgtggaggcttttgtggagtattgtgattgatgcggttttggaatcagatggtttttaagtaacttaccttggttccatttgggataagattctgcagtatctttagccgttcattgatcctttctctcctcttctgttcaagcaagacagttaaaaaaaaattcagattcagatgagcaacaaaaatgtgcagcaactcgcgcatagttctacctaccctggcatagaggctttgcggatcggtcgccgccccgcgcccggccctcgccttcgcgccgccgtgcccggtcgccggcgatgacaacgacgacttcttggacgccgagctcacgttgctgcacgaagtcatctccagcgacagcgagtcgtcatcagagaggtagttggtgctcgagctctgcacattgccgccgtcgccgccgccattgctctccttctggttgctgctccggctgcacgcgcccttctgcgccttctttgactgcgcgttcttattacccttcttctgcaccacctgatgcacacatcgtcaggaatcttaatccgattattacgaaagattaatcagttcattaattgtacattttttttgtacttact

SEQ ID NO: 14382 - DNA, 2043 bp, Oryza sativa
  unsure (1)..(2043): unsure at all n locations
gctgctgctgcatgtagcagtatggcgccgagccgtagtactggtcggccgcgtcgtgcgccggccagtacatcgccggcggcgccgccgccgccggctgctgctgctcctggtcattgccgaagtactgcacgccgagcagctgcgccatcgcctccgagtcctccattgcgactgacggatcgaacgagtgccagctcgcctccgaggactccatcatctccaatggcgaagaaatctgtaacaaaatatgatctcgtagatggccatacctgtcctagtatttatatagcaggggcactattttttttttcatcagttcaggaacagaatgttcgagcgtacaattctgaccattcataatttaattcgaaacattttgggaaaactactgcacagttggcgatgccagacagctaacaaaaaccgctgaaattcgtgcaaagacgaatagaaaaaacacaaggccgcgaatcgcacataaaaaacaccatttcgtccgtgcaatgagggcgattgaatttggggtgcaatgagtgagagactaagctaatgattaggtgacttacatactagagtaatgagcagagctggtcttattatgtcagtgatttgtgttggatggtaggactgtagttggaagaaaagaaataagagaaaaaaaaatggtcgtgaaggagttggcaagatcgtggggaagagtttcatgtcatgtcattataatttcagagtgaaaataaatgtgtttgtttcaaatcatggattctgatcttttgcctccctatataggaacttcagataatgctaactaacaaggaataattttgtgtgttttttgtttgtgggctaaagtcggagggacagggaagctggtttgctagtgattggtgaaaaatatttggattaacttatgatccgtgcgcattcgcttgttagtcgcctagatcacgtcgatgcattatcagttctcctgccggcgagaagtgatatctttgaagctagcgaaactgtattgttccagttgttaaaaaaacgtcgagagaatatatatgacaaaacaaaataatgtattaaatgtattaggatttgtcatgacaaaacaaaatgacattgtttgtcatggagatatcactacactttcataaaagtacaacagagaagagtgtacaaaatcgtgcagaagtatatttacatgttgccaatagatattggtggtgattccttacattccaaactccaaatagtacatgcattgttttttttagaaactcttataatttgctctgttgaaactctaattacaaaatatagtaattatcattaatcttattgtatttcataataattagtaataaaacagattaattgtcctaataaacactaactagctgggtggcccgcgcaattgcgcggctagcacccaaacaaaatcatatattttccagtctgattttacttaaaatttattaaatagctatctcgttgtcttaagactttgaaagacaaaaccttatcatccacgtatttctaattatatagcttttaaaagtcacaccagctgctaccccttacttctgtcatatccttctttatttgcttactcgatttatcactatttttattcattctctttgaaacctttaaaaattggatcttataatttttaaagtttattgtctcgttgggtttcgtttttataatttctagaagtccagtcaaacactgtcattatactcctctacaacccgtccactgtcttttctctttattgtcattgggattttaaaaatcgaacataattatcgttcgggttccgccaaaccgttagcggctttgccattgtactcctttatggctcgcccgctgcctccattctttattatcattgagattttaaaatcgaacatagttattattggttttttttttactttttagaagttccaaacctttaaaaattggacctcgtagtttttagagtttattnnnnnnnnnnnnnnnnnnnnnnnnnnnnnnnnnnnnnnnnnnnnnnnnnnnnnnnnn

SEQ ID NO: 14383 - DNA, 10706 bp, Oryza sativa
  unsure (1)..(10706): unsure at all n locations
cattgggattctaaaaatcgagcataactatcgttggaatttattttttattttctagaagtcccgccaaccgtcggcggctttgcagctatactcctatacaccccgcccgctgcttcacctttttattgtcattgagattttaaaaatcgaatatgattatcaatgaggttcactttttaactttctagaagtcccaacaaccgccctgcccatttgcttcacggcctgcatgtcgtccctccttttaatcgttattaggattctatttggtgttttattaacagtttttatatatcgtatcagccgtcaacactctactcttttataggcctggtacttaatatatcttgtcatgtgttttagatggtcttttctttataaattgtattcctaattaaaatctttttttcattttcttatttcagaatttatttttttcaaattttaattaatatcgcatagtgttcttttaatatttttatttttttaaaaaaaatcaattgttttaaaattgtatttctacttgaactctcttttaattttgtctaattttggatattattttattttttattctaaattttaattaatctcgtatagggttcttatgtgaattcttctttcaatatttcttattttttaattccgaatttcagttaattttaaattgtattcctaattgaattcttcttttctttttgctaattttggattttacttttatttttgaatattaattaatctcgtattagattcttatatggactcttctctcagtattccttatttttaattccgaattttaattattttaaaattgtatttctacttggactctcctttttcttttctaatttcatattttattttatttttattctgaattttgattaatctcctattgggttcttatatggactcttatttcaatattgcttatttttaattccgaatttcagctatttttaaattgtatttctgcttggactctccttttctttttctccgattaatgtgggaatttttagtcaccacagcgaacgtggtgcctcctttcaaagttgttttaataatataatagatcttgaaatgaaaattattaattaacgaaaaaactaactatgtctaatcatttgcgttgacaaaagtggatggtctcatcaatcaatttagatgggggctcatccaacatcttaagagaatatatattctcttcagtgtccatcccatcccatccactctggcccatgaaacaaaaacatgtaaaaatgggatgattatctttcatctattttcatccctcaaccaaatagactcttaatggacaaaagcttcaattttttttctctccaaaaggcattcatagagggcttaacaagaataaaggaagagtctggagactcctagcctcttgggtggcctatcaacagttggatccaaaccaatggagagccttgcctcgatgtccaagcctgttgggagatacttgctaacaaaaaggaggtacccaagaaaggcatgcgtagcttaatcttgttggttgtctgagaaatctcgacagagaggaaccggcaagtcttcgagcacaagaagatagcgacacctggcctcgtggcgaaaataaaggaggaagcaagaacatggaccctagcaggagcaaaaaaagctccaggagctccttccaacctcggatagatttgtatagatttttttcattcttacgcctaggggttgtatttttctccttctatatttaatgaaatagcataacctcgtgccgattccttttaaaaaacaagaataaaggaaaacaaaatatatggggatattttcattttcttcagaaactaagctgtcagatattgtatacttcatatagttattcagactatatgtccttagaaaacacattgtagtcgctgagtttctaattttaaattatttatacaattttatatatgtaggctcggagccaagttttattttttgaaaaaaaacttgcagcaaattcgcattgcatccccaaaccgaaatatatatattttttattttgttccttgcaaagaaaaaaaagaaaagattaatttgttgaaagagatggagaatagttagagagaagaaacatgaacagagccgtaccagatatattcaaattagagccacgttataaccacgtccaacaaaccaaaactaaaaacaatcagagagaaaatcgaagccatatgtttggtctccttccatcaataattaatattctagcggggtataccagtggcggagccaggattttaaagttgggtattcccgtctaagcgttgagccgttggccgcttctacccctcgcggctgccggccacccaaccggcctgactgcctgagcttggcggagtggcgggcgccacccgctgcccgccgcggcaatagcctccccctccgtggtagcgcggtccagttctcgccgccagttgccgcctcgccgcgccgccgcctagggtttggaaatggggagcggcgcgagggagccgagccagggagggatgggtcatggagggagagcgagagggggccgtctggaagagtggtggctaagtggatcaactgatgtctgatgggtcatataggccggttgggctgtgtttggatcgaagaattgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatggggtatacagtaccgaaaagaaaattatctccaccatgctcggttgcacttgcacacgagtgcagaaccgccagatcgaaagctagcgaacgtatgctgctgcgatggcaaacggccgtagtacactagcctagcaggctagcactactactctactaggcgtgccacggcctttgctacatttttctaccctggtgcacacgacgtatcaggtagtaccctggtgttgtttagattccaactttttttttcaaattttcaatttttttatcacatcaaactttcctacacacacaaactttcaacttttccgtcacatcgtttcaatttctttaaacttccaattttaacatggaactaaacacaaccgtaatagaatttgtgatatgatttgaatctttagttgtttaagccctactaactacttcatccgttctaaaatacggtatggctcattcatgtattcaggggctatttggatggaggctaactttaccacagtataactttatttaccataagcctataactgtgtcaagccatacaaagtgtttgttggccacaaccatggtaaattttggctagaaaataaaaatatgacgcgtggaccattgtgctaataaagtgtagcttaactcaactatggcactcaaccagccactagcctaagaaattgtggcgcgtctaaggtttggtgtagcaaactgcggccactacccaaacaacctctcactctttttattacgcacaaccacacaggtgaagtgggggaacctaggccttattagtttggaaggatttctaaaggaaatctcaattcctttggaataagcactattcatgccttcggtttgtaggatttaaaggaaaattttccataggaatactatgccaatcctccaaaaatcctccaaaatgtactaattccataggaatgaaaatatctactctatcctcttttggttagctcagtgtaggaaaaattcctatgttccaatcctttattttgcacgtgcattcctacattatttctacgtttttcctatgatttgaaaatcctgtgaatcgaataaaccctaagtggttgcctaggattgtggactctttgttcactagtggtactatggctatgttctttatagatgattcgacatatatattatggatattttttgtatgattagaaggatgaatttaagctagagtaatgcagatgaccagtgtgttggagtgtatgtgtgtccacctgcgttcgaaccctatcagaggtcgtcgcatgtgttcacctctcttattcttttatatatatatatatatatatatatatatatatatatatatatatatatatatatattcacctcccttcttattaccatttatatggaaactcctcttttcatatttagattttttttataggggtgagttacctattctatactccctctgtaccatactataaacgatattgagtggatgtggcatgaatatgaacacggagtgaatataaatttaaaaatagtagaactagttattcgagtaatgtcgatatgattattttttttttggagaaatcgtaatttgatatctgtggtacacctattcacaagtccgtaagttaaaaataacagggcctaataagagacgatgcacttaagtacttaacaagttaacatgcataacgttagggtattttgattttctcatcgtgcagcttggcgcacgaagttgagccctgagcctgcttagtcgatcggtctacgtccatcggtccatgacagacaacagtgttgtctggttgactgctcatgcacttggacgccaccaccatcatgtgcaccccgatgctcaaaccagtacgccaccaatcaccatcatttgcttgcaagaaaacgacctctatatccagtcaagaacacgtactctttttcattacaagagtcacaaccgattagcaatcgtatagaagttttgttgtcacttggtcgatcgacaggtgtccacaggatgagaacacacatgacatatagtttatgctttccattaattgctaagcgtgtgagttagtggtgcattagtggagttaagttttttttttttttgagaaagagttaagtattactagttaagtgatggatctagaacagcaaattaaacatgtcttttgacgactgcatttgagcagaaagtgaaatgatagtcaggattccggcaaaacacaggaataattaagagaatatgagttaaagaaaaggagtccgatcggatgattagctaacagataccttcgctctttggacataattcgatatccaaatgttgccgtaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaatgcaaattgctaactatgttttgtcaggccaatcagtgtgtccacgcatgatattcttcttcttcaacagcaatcgttctcgaaaaaaaaatactacttcccagtgcgaatattcagtgaattgttccggccatgacttccttttttttgatcaacttgcatgcggaggacacgtaaatttgatttccgtatcaaatctgtttagaccattgtactgtctacagctactctgttgagtaagaagactgaggttgtgtccaaacttcagccctttttcatctcatcaacctgtcatacacatacaatttttcagtcacaccatctctaattttaatcaaaatccaaactttacgctgaactaaacacagcctgaggtattttgtgcagccaagcaatgcattgcaggagtttcaaactctaaactctatttaggttgcgttcgagatgaggggttgggaaacctctttctcggcatgcaaaacaaaatacatattattacatgattaattaagtattaactatttttttaaaaaaataattaatatgtttttttaaaacaacatttatatagaaactttttgcaaagcagtttgaaaagtgtgcgtgcggaaaacgagagaagtgagttaggaaatctgggggaagaacacaatacaaggggtacagctatttagcgcacttgcattcttagcttatagtttttttctaaagactttcatctgcaaaactttcatccaaaaaaactttatctcaaaattttcataaaaaaacattcaacgaagaacttttatatgaaaactttcatatgaaaaaagtgtgcgtttgaaacacatgtgctctaaatagagtttagagtttgaaataactggaattgctaaccagggtggtaacagcttagctgcaaattgtttttatgatcctgcaaactatcaacttagcatatttcaagtctacataaccaaacactttcagcaaaagtacttaccagttaccagctaatcaaatgcgttgggaaaatattgatagacaatatacttattttgaacgcatgtatatcaggcccaaagttaaaaaaaaaggaagataagtagagcatcatgtcttgaaaagctgtgagtcgttacaccagttccacagatatattcagtaactcggtcaagaaagaacaacacgctttaaagttctgtttgatgtcttgaactgaatagtctactgttgatctggcaaaagaaatcaaccggaaccttaaacaagctggatgctaaagagaaaagaaagtaagacatgagctatctcaatattctcaagcagttcaaaacagacttaaaatcttcatacagattatacgaatgcagatatacagctagtgtattgttccctttctcattgaaatgaataatagttgacattgttagtcctgccacccggggaaatgtttggcttaagagaaatatactctataacatcgaactgtttggaccagtatactttttttttgtcgggattaccgaaggagatcatcaaatgtaattaagatagaggaaaaaaatgtttacaagaaagtttttcatcgacagcgagctgtcgagaaaggatgtgcagcaaagcacacgccccgacaccacacgccaaccacacagacacaagctacagagaggagagctgaacgccaaaccggccaccgctatgcgagaccggtcgccgccgggtatacaacaacaccatagaaaggatactccgaaaacaatgccttcacgaaggttgcgacgctaaaagacgctgtcgtcgcccgtccaaagaaattggacacggttttcacctagagatcctcgtcgagggaggaaggttcctcgacaacgcccccaagagggttactgcaccaaaaggcgtagccgctgccggcccaataaagcactaggctaggtttcgcctgagaccctcttcaccccgtcgctgtggtccgtcgcccgccaactctgatacctccaaccaaacatcagtagcgcgtggccttcaccgcaccggagtagggttgtcaaaaaagctcgagactcgcaagctactagaactcgactcgttataggctcggctcgagctcggcttgagcctaaaacgaaccgagctcgagcttgaaatgaggctcgtgcactttaacgagccgagctcgaatagctcggtaaagactcgagtattagttagtaactgtcatgtctcatgctttaccttggtctccaataaaaaatcatcgatgcttttccttggtctgctactactccaacattggtctatgtgaagtacagaagcaatcaattcttgaacactactcccaaagctagtagtagtagcaaagcagactactcctgtgctagtactagtagtacagtacactagtgctcccgtatggccgtatctctacacaacgtgcccagctacagctttctgtcagcttctctactttttgaaatatgtacacatgcttgtgttgcgttgatgcgagctcgattaggctcgaggctagcttgactgcaagctcgaaggttagtccaggctcggctcgagctcgactcgagttcataccgagctcgagcctgaggatctaagctcgctcgagctcggctcgttgacagccctacaccggagtttggaccagtatacttatcttattgtcagggccccaattggttttacatttcggctaataatcctatacaatataattttagatacacattgttaagactaagtttacatacacagccatacttgaacaaaatgttcctgtgggaagtaaattagtgtcaagaaaaatacaatgtagaaatgcaacatctcaacctagctcatacagattaaacactagactatactctatagtgcaacagctactgtttcatagaaaaggtacatccccaaatagaaatttcaccgtgaaagaacttcccttggctattggaaggaatcattcctcacctgagaggctgagagactcagactaacatacataaaacaatgttaattgacactactagcatcgaagtcaactaattaactagcacaaagtcagctaattataacatcacccgatcttagattagcaaagatgtgttaactaaaagagagaccgtcttatataattgaagaagaaagtgctctatcatagatccaactagtaggacaaaagcatatcattcaacaagggtgcaggaccattagctgaagaaaatgaactcttttatcataagtactcgaaaacatgggttggatatttgcatccctacaaaaccctttttccagaaatcctaacctattcggttcctaaagacaaaatgagaactactccctccttccctaaatgtttgacgccgttgacttttctaaacatgtttgaccgttcgtcttattcaaaattttttgtgaaatatgtaaaactatatgtatatataaaagtatatttaacaatgaatcaaatgataggaaaagaattaataattacttaaattttttgaataagacgaacggtcaaatatgtttaaaaaagtcaacggcgtcaaacatttagggatggagggagtatatagcagggtagtttaatcaatttcagatatgaaaagggtaatttcaggaaactgtttatagaagtctagagattatcttttttcgtttcctgaaaaagaaaagcagaaagagtatcaagtttcagttgagatttgctagttctgagcaatagcattggtttctcgttaggttcagatataggaatagatataagcattgtgcggttgttctccaatcgacttgggccaactacctgagcggcccaaaatccttaattgagcccattacccacatgggccgtagcccagactggaataacgcgaaccgccattcggccatcgattgaccttttcttctccaaaatgagggaaaaaaaacctgcgtgtaatcgcaactccatccggctcatcggcgagtcggcgtcgcgtcactcccgtgctccggcgacggcggaggaggagccggagcggtcgccggaagccgtcccagcggcggcgggggggagatgggagtgcacgggctgtgggaagctgctggctcccgtgggccggcgcgtgtcggtggagaccctggcggggaagcggctggcggtggacgcgagcatctggatggtgcagttcatgcgggcgatgcgggacgacaagggcgacatgatccgcgacgcccacctcctcgggttcctccgccgaatctgcaagctcctcttcctccgcgcgcgcccggtcttcgtcttcgacggcgccaccccggccctcaagcggcgcaccctcgccgcccgccgccgccaccgcgacgccgcccaggccaaggtccggaagaccgccgagaagctcctgctctcccatgtacgtggcctctctccccccattcctcttattggcgcagcgtattttaggtatcctcccaattgatactgtagggatgatggctgatttgtaggaaattttattcctaatccagtactagtagtgagtgatgaccagagaatttgcactatacactctattttagtaccagtacaacactacaatgacaaccaaatatgctatgatcatgtgaacaagagaatgatctacccaaggcccatgtattacttctctggggaaaaactactactgatttctgaaggatgatgccttgcatttctatgggaaaaaacgtgtcataaacatgtttctcagggttaatttacattccccacaaaaaaaattacaagcaaagggagcaatttatcccaccagcttcttttgtattggactctacccttgtgatcatcctgttatttgattgatctctttccactggaattccactattcagtttcttcaggaactgggagatttccctaggtcccaaatgtgtcctaaccacccaaaagtgtttgtagtggacataaaggagagttgtctaggctattaaatttgttctgatattttctcttaatttcctctagtttcttttcccaagagttgtctaggctattaaatttgttctgatattnnnnnnnnnnnnnnnnnnnnnnnnnnnnnnnnnnnnnnnnnnnnnnnnnnnnnn

SEQ ID NO: 14384 - DNA, 1063 bp, Oryza sativa
tttcctctagtttcttttcccaagagttgtctaggctattaaatttgttctgatattttctcttaatttcctctagtttcttttcccgagtagtccacactccattaccatactatatcatattgaaaaaaaaaattcaaatgaccattcgtttagcaatgatggtatggcattttaattttactagtattttaagtttgttggaaaggcaaaatcaatatctttatggttttgggcatgtggttccagctcaaggctaggaagcttgaagaattggcagctcaaatcaagagtgacagggctaagcatgacaataaaggcaagcaagttgagagcagtaaaatgggagaaattgagaaaattaatggagagcaaaagaaaaacaacgatggagaaaacagcggggggattgtagcaccaatcgaccaggagaaactggatgaactgtgtgtgcctccctatagcttccacatacttcttccttgttaagatcattaagttgatgtttttattgcatgttttaaggctggccgcatcacttgctgcagaggaagaggcaaatttgactggcaaaggaaaacagtatactgtaagtgttccattgcaagaagcagctgacattagtgaggatgatgacgaggatgatggagagatgatctttgtaagtatctggtttttatttgcttgatgaaaactgagtgtgccatctaagtttttcttattattcagtttcacataacatggtccctatctttttttagtgcacccactgctttttttttaatttattagttgattaaaaggtactggtttttgtaatccgattgcagcctatgacaacaggtgatattgatcctgcagtattagcttcactccctccatcaatgcagttggatcttcttgttcaggtaaagaggatgaactactggttctcatgtttctccttggtaccttaaactgtatgcaaccagagactaatttaagagaatatgattggtttagatgagggagagagtgatggctgaaaacaggcagaagtaccagaaaattaaaaaggtaatag

SEQ ID NO: 14385 - DNA, 339 bp, Oryza sativa
ccaggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcacttgcatatttgcttcgtggcttgctgagtatgtcatatactcaccttgcaatcattcatcaaaggaggagttctacagtgatgctgatggtgtggaggattaggtgtagccctggtcaagctgcctgtggagtggagtcatctgcgccgtttatcttattttttccgct

SEQ ID NO: 14386 - DNA, 836 bp, Oryza sativa
  unsure (1)..(836): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgcgcgttggtctctaatcttccataagctaaagcaatgggattcatcgttttgcgcagcttctgagctcggatgatatgtggatgttcgcgccgatcgcgtacaacggggtcaacgtcgggctcgacctcaagatctctccaccgcagcagcaatgatccacgtactccagccatggcgccacggacgctagctcaagctatggttctttgcagctggcgcagaaatacatatttttttttcttctacttctgttgatacagtacatttttccatcctgaatccatttgattcattcccaaaggatggccaaccttaattatatacctcattgatcgagttcttttttaccatttcgctccttgcctcctcgtacagcagatcctgccatggaagaacttatttttgggcaacggaatgtgaaaactactgagaaattggcagaacaccttcgctagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14387 - DNA, 663 bp, Oryza sativa
cattgtccaccactttccagcaagaaaaacattgctgctcttaaaaactgattcaatacaaaaaagtgcagggaaatgaaatgaacggtatcttttattgtttgctcgcatccatgagaacataaggttattcaagaaagcttacttgcgcagtaagcctgaatctggtcttccccaggaaaatggttctgttgaatcatcaacttgtggggaaatatatgcgtttatgactgcttcactaggaaaagtagaaggaatatgccagttcttgctcacattcctctgataaataaatgataacaagtgcaaaagaaatattagtaaagcagtatctataatcaccatgcaattacagcaattgacaattcagtctataaagacaacatacttacatgcttactcataaatatttccttgatgcgttgggtctcattagaagattggctgtcatcagaacctttagcgtattcaggctcaaggctgtttccctttccgtctgaatgatttctgccagacttttttttctttgagctgctaccactttccataccaagttttcccagtaaagttggatctggtgattcaacccactccctgaacttttggagcccatcttcctcaggaaatgcgtgtgcaacttcaatagcattcacaatgccaatg

SEQ ID NO: 14388 - DNA, 3047 bp, Oryza sativa
  unsure (1)..(3047): unsure at all n locations
gatggctgaaaacaggcagaagtaccagaaaattaaaaaggtaatagacattattctttggattatcagcatggtccaacatatcactaatgttactatatcttactagaagtattataattctatgaatacaacctttttatataattttatttacataaactgtgccattttcagtagttaggtgtggcatgtatgaccttgtgatgatttgactcattgcaggaacctgcaaaattctcagagctccaaatacagtcgtacctgaaaactgttgctttcaagcgagagatagatgaaattcaaaggggtgctgcaggcaggggtgttggaggcgtccaaacatcaaaaatagcatctgaagctaacagagagttcattttctcatcatcattcactggtgataaacagtaagtactagtcttcacatatagtcatttgttaactttgtgcatgtgagtgtgcatcacattcggtcgctgtacttgttaaaattcaattccaacccatatagatattgatgatacttatctggatcaggacattagcacaaagaggcggaaaggagcatattgtcgatagcattaaatcaaagagggaaatcaatcctgctgtcttcaaatccaatcccactagtagttctagctcaattaagcctaacaacagtgagcctttggggagttttggacctgatgttgagacatatcgtgatgagagaggaaggattagagtaagtagggtcaaagcaatgggaattcgtatgactcgtgatattcaaaggaatttggattttatcaaagagcatgaacaggtcagaaacagggggcatgactctgtagttgaaggattagctaacaatgaagagcctccagattttccagaacatctttttgaaggtaatgggctgcggagttctcttcatctcagcgaagattatgatgaaactgctagcgataaccatcacacatcatcactagtaggatctgacaaaatttctgagggtgattatcatggaagcaaagaaacaatagagatatcctttgctgacgatcaaacagaagtgaaggacaatgatgaccaaattttcttgcatttagcttctggagcttcatccaacttattcactacagaacagactgatggctctgattgcattacaaaagaaggcgtacttgaaagtgaaacacctcctatgcaagttgatgagaaggatcaccaagcatcactgatggacaatttctgtactgatgatgagatagagtgggaagaaggtggttgtgatgttcctggaggtccttccagtaatgaaaacgatcaatctaaagtaccgaaaggagatctagaagaagatgcccttgttcaggaagctataaggagaagtttagaggattttaagaagcaagaacatgaaaatgtgacccctgaagatttacaggcatcttttgaagacaaacctttgcaatcttatgatgatgttcctaagccagctggagctgcaggaaagacagctgataaaattgggaaggaaataaattgtgaagagaatgatatagtgcatggatcacttgtagttgatggacgagaaaacgagaatcagactcaacccgagaatagtgatgggcatgccgatatgaagagagcttatttgttggatcctctccctccatgtaatatgaccgccagtactagtgctgcaaaatcacctgagggctcagaagttcagcaccacaattcaatgttacattcaatcagaactcccgagtggcctaagaacgatagcgataaagttatgacgcaatacagtttgaattctgataattcaaagtgcaaaatagatgattcttgtactggagaaacctcgaggtcactccaaaatgaccttttgatggatgaactggttcctgacactgctgtacaaaaagaaaatatgatccagagaactacggacttatccacatctgagataaactatacgaaactgaacgataatgttggtatatatagtgtgtcagctagtaatctagaaaaggaattatctcttctgagacaggaacaagaatatctcggaaatgaaaggcggaagcttgaaagccacgcagagtctgtcagcagtgagatgtttgctgaatgccaggtttgaatacaatcaccttttccctttgagttgaggcaaggtttacctcagaattgagatttagtggaagtttgaagtaaatggttttagcagtacaaaatgttaacatatgtatgtcttgtattatacaggaattgcttcaaatgtttggcttgccatatataattgcacctatggaagctgaagctcagtgtgcatacatggaaatgactaaccttgtcgatggagttgttactgatgattcagatgttttcctgtttggtgcaaggaatgtttataagaacatatttgacgataggaaatatgttgaaacatacttaatgaaggtcaattttctttctgctttcaattttactctcatttttatttcattgccagctgaagcaatgggaagtccatgtccttgctggaccttccacagctaatattgtaatacattttcaggacattgagtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttcttgttgagttgcatttttcgttgaaaggaaatatgaactgaaaaacttgctgttccagagatcaagtgcatgctctgttttgttggacaaatttgttatgtatacagtcattaagaatacagagcattgtactttaattatgccatctcaatttcttattttgaaggggggaaaatgccatttcagtttctgttttgtccagtgtatttatttatatactgattatgcagtggcattggcattnnnnnnnnnnnnnnnnnnnnnnnnnnnnnnnnnnnnnnnnnnnnnnnnnnnnnnnnnnnnnn

SEQ ID NO: 14389 - DNA, 928 bp, Oryza sativa
gcgcaagtaagctttcttgaataaccttatgttctcatggatgcgagcaaacaataaaagataccgttcatttcatttccctgcacttttttgtattgaatcagtttttaagagcagcaatgtttttcttgctggaaagtggtggacaatgtagtccaacatattggcagtggcattaaccgctcaaaaacctaaaatatatccgatatgccagcaccagcttgtttctggtaggtgttcagactggtaccgtggagcgcaaaaccctagacaagttttaccagaaagcagagtgttctgttacttttagctgcctgatatgttataatcaatttgtttttatgatgtggaatgtgctttttagctccttatcattaccttgacaatttgttctgatctttttcttcacaagttagttctgtttcaaaactaaggattatgattatgaaaaaacacacatgctctatttcttttctttggcgcaacaacagaagatctaatgttgagttccttcaggttatgttgggaaaggtttgggtggagcaaggaaaaggctgatgaactgctaattcctgttttgagagagtataataagcacgaggttagtctctggaagactgtaactattatttatcctattatagaatggtttgatgtgataatatgtttatggataccattgaattctgttccctaaaaaaatgagttactagtaagttagttttacggtttgagaacatcaattgttaagatgtcagcatttcacctctattttacattttttttggatcggctggtgctggtttgccatgttctgcaacatttgcattttaggcatctgtaaaaagcaagtttttgacaattcgtttcattgtctttaagttattttcatttaggaaatcgctgccttttgaaaatagaataggca

SEQ ID NO: 14390 - DNA, 656 bp, Oryza sativa
  unsure (1)..(656): unsure at all n locations
acgtggcgctaaggtagcattaaaaataaaacttatatgggctgtatttgtcattcacacaaaaagtaattataggacccacatgtcatccctatgaccctatcaacccttctttctcctccctctctcccttgagatttaaaacttccagctcgagatttgaaattttccatgtctaaatttgaaaaatttaaagttaaaatttaaaaattactagtaaaccaaccactagtaaaaataggaagctaatctaaactaattatatttttttcttttatccgtacggcaggaacaacatacggcgaaaaaaaagaaaaaaaaaaagaaacagcggcgttaaaaaaaagagagaagcgcaaaagcgcgcgtgcatgggtcttggtcttgtgggccagcgtgtgcgccggcagcgcgcggattagcctttccgcatcgcttcagccttcagaccgtcgaattcgatgtacaatcggacacaatcaacccttactacgttttaatcagaaaagaaatgatcttactgacatcgctttagtcgctttactagctagctaatcactttggagtttcagtgatagtgttcaaaaagcgcttgtactggcagctacannnnnnnnnnnnnnnnnnnnnnnnnnnnnnnnnnnnnnnnnnnnnnn

SEQ ID NO: 14391 - DNA, 864 bp, Oryza sativa
  unsure (1)..(864): unsure at all n locations
nnnnnnnnnnnnnnnnnnnnnnnnnnnnnnnnnnnnnnnnnnnnnnnnnnnnnncatccttcgggtctcgagtctcggcggcgacagatgtggcggcggcgtgcggggtgaggagatggcggccggtgtgcggcgtgcctaacgacggcggcgaaggaggctcaacagtcggcggaggcacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataatagcattttcaacccaagacaaatttattaagaaaatgggagcgaattttccaggatttaatagctttgtgctttcagtggtaagtgacgtacctgtctacagcgaggcgtctgtggtgacttcattaatctccaggatagatttgccagcccagtcttcgaagatggcaagatgctcataggggtatggtttgcgtgtgtgttgtgagtatctgcgttgtaccatgtaattaaaaaaatattaatt

SEQ ID NO: 14392 - DNA, 908 bp, Oryza sativa
tatatgcatcctatgaccatcctgtcagtaactagggaccatgcattactacggccagttccctcccccatttttccatcctaaaacttaagtgcactgcataaagcgcatatggttccggtaagactggtttccataattctaactccatatatcgtcttctctgttcagaggcttgcacaagctgtgaagatgtaaccagtaatctatcttatctatccgtctagtgcacttgatattcctccaatctatcttatctatcgatcaagtgcactcgatattcctccaaccaaccagaccagtacatctcaaagaaaatcaactgacagtaataaacgtatatgaacacgcacgcacctgcaactcatcagaaagtctgaagtcaatccttgatgatgcgaatatagtagtaaatgcaaaccaaaccgaagagccaattgccactcatgcatgcaactgcaaaaacctctgcaaggttttgttgggtcattggatctcgcgatgtgttacttaactccctacttggacagcagtttttacttctagtgttcactcgatccaatcggcacgtggtaatagtaatacgcgctttgtgaaaacctttggaaatcgacggccagtgtgatcaatcaccctgaaggaaaacgggagagcagccccccctgattgatctgaacgaaaaacctgcaaggctgcagatggagacacatgcatgcagcaccgcgcggcgcggagacgtgctcgctaccgatggataggtggtacgacgtaccagtgtgttactgtgtacatctcgagccacctgcgtcttagttggaactcgtcgtgtacctgcactggacgacagatcactccggccggggcacccagtactgcagcgtcactgccagggatagctagcagctaga

SEQ ID NO: 14393 - DNA, 516 bp, Oryza sativa
  unsure (1)..(516): unsure at all n locations
nnnnnnnnnnnnnnnnnnnnnnnnnnnnnnnnnnnnnnnnnnnnnnnnnnnnnnnnntttttcatctgagatttctatattttcatagtattagttttgctgtagtgctagttgttcccgatgttttgctatctgagttataaattacgcggacttgtattcttatgaagtctgactttttgtataaaaaaatgcttaacataccaaagcactgtaatatcgtccttgtactttttcgcttttcttcgagcatttatgggagatatatagcattcgattgttacacatcgcaggctgtgctcagttgacaaacggaaaaaatctgagatagaaagttcttatattatatctgaataccgaatgattagtgaagttattatactgagaatgatgagttagtgttcgagaatgtataatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14394 - DNA, 714 bp, Oryza sativa
cagaggttttcacagtgctacactacacgcactgtcttcttggaggcagttaaaaaattggagggaaaggggaaagaagcagatccactcacatgctccccaagatgagcaattcatcagaacctcggcagctggtgagaggaagctgaagagtgaagaagagtctttcttttggcctgttccacgtgtcctagtggagtgtactactactggagtagtgatttgcattgcatgatgcacaattcagagagagctaaagaaggcagcgttacagctgctttcatgcgagagagacaaaccaacagtggcagtcacctccaagaaggcaaagaacagcaaagccattgctgagaaatagcaaggcagggtgatttgatgacacggcacaaaggcaacatcagaaaggcaccgagcaaacgcatttcttcctttcgtcccacagatatcaataaacaattcccaaccactcatggtcagcaattgcacacgagacacgagagagtagagtgaagtacagtgagagagatggcccctgccccctggctatccaactactatcaatcagttcttgcaacaaaaatgtactaccactgtttggctttagcatcaggaaattgctaatgaaccaaaatggcatgactcaacagagagtaacagattaccatacagtttccacaaaaaatgacttctactcaatacttgggaattgggatt

SEQ ID NO: 14395 - DNA, 602 bp, Oryza sativa
  unsure (1)..(602): unsure at all n locations
nnnnnnnnnnnnnnnnnnnnnnnnnnnnnnnnnnnnnnnnnnnnnnnnnnnnntaggcttccaggcatgcagcgaggaaacccttcccataatcaggaaagaggtcccttatttgagtaatcttggactcagtgatggcagtatcctcattcttatgttgtagttcaccaccataggaagagacaggcaaatcaggcacactattccaagatgtcagagtagatccacacaagcgtgcaatgaactggaactgctcatcatccatgtgtatccatcctgtttacgattggaggaacatattgaatacatcaaccaaaggttttggcatcaatataaaactatgacacaatcaataaacttgagataacaagaaaatacagcatatatgtcaacagaataatgctgacagtttagcaaactctttcagtcttcacaacaaaatctagccaaaacagaaaaagtgatgtcttatgaacacaactcataagtgccagaatgatcaaacgcgagcagaaataaaatcaaatgtagggtaatacgggaatattatgggtgaactttatgagaacaaaacaacagaagctagagcatctttttctttt

SEQ ID NO: 14396 - DNA, 366 bp, Oryza sativa
  unsure (1)..(366): unsure at all n locations
nnnnnnnnnnnnnnnnnnnnnnnnnnnnnnnnnnnnnnnnntattggctggcagattgaaataccaagaacgggcgatgccgtctagagcgagatgtattacctttgccttggtattttcgtcgccatgagccgcttcgatcgcagactcataaatggagaggaattcctttgggtcagtttcgcttgagtagcgtgggacgggtgggaacttgaactggagtgggattggacggttcttgattcccccactcagcggtagccccttttcgccccccgccctgttcacggcaccttgctgcgagtacggcgtggcaaagggctaaatcacggcttgcgcgtgaggttgggccatggcattcggctg

SEQ ID NO: 14397 - DNA, 744 bp, Oryza sativa
  unsure (1)..(744): unsure at all n locations
taaggcccatcaccgatgactcattttccatctttcatttgttatgagtgcaaaatatatagcagctgtgtaataattcattttattagtcataatacattttcggatagtaaaagatttcaaatggaaatatggtcaccaccaaagttgtagagcctttcaagatctactatttttattttggtcattattctatataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatttgtaataaaacaaaattagccatattaatgactacacatatcaagtctttgcaataaaacaaaatacttcattcattacaatagataagtacaaatgcatcagtcacaaggttgtgccttcggtatgatctgaacgagcacatgccacaggctcttggggatcatcgtcaaggtcaatgtgaggtcttacatgaagattatggttgtattcttcttcatcgacgacgttgtcaactcctacaattcggcactttccatccctcacgatgtgcatcttcttgtttgaagggtcttttatgtagaatatctgctcgacctgtttcgcaagtacaaatggttnnnnnnnnnnnnnnnnnnnnnnnnnnnnnnnnnnnnnnnnnnnnnnnnnnnnnnnng

SEQ ID NO: 14398 - DNA, 747 bp, Oryza sativa
  unsure (1)..(747): unsure at all n locations
atggctttccatcgtgctgtccaagaatatcggtagctttacttggtttcctggcgttagatttctccatgtagtataaagtgaaggtccttgaagcggtgcccatagcggcaagcacgtcatctccaaccaatggcatgcctagtgggaacccctgtgaagcgacatatttcttctggacctctttgcccttagtctcttcctggtccttgcttagatctagctttcttggagctagaagcgaggcatgcacctttcctccccttcctctcccctttgcttcgggtttatcgagagtaattctctgaggggaagagtgtgctttcctgctcttcttcatcggtgggggttcatgaatcgccttgctgtcggcctccgttcgatcctccccaaaatccgtgtcgtactgcaactgcacatcgtaagattgtgcatgacgatcttgagcaggaggggctgaaggagcagaggcgggtctctgtagcgcccgttccgtcgtggtgcctagcgggaaaactatctcttaaaaaccctagttgcgaaatctgtttctttgcttgttgtctagtgtccgtgccatctcagatctcaaatccccgatctatcgtcgagttcaatcccgaatccaaatccttcccaaatcaaatccctccacaaaagtctattttgcctccctcgggttcgatgggccgnnnnnnnnnnnnnnnnnnnnnnnnnnnnnnnnnnnnnnnnnnnnnnnnnnnnnnn

SEQ ID NO: 14399 - DNA, 688 bp, Oryza sativa
attgacttggtggcttttgacttgaatttatactttgcttttcttcctgaagttcactcggtctaaagtacccgtacatggcaaagcgactagcttgcatggttatctcaggagctgttagtgcagactgtcttgacatactccagccagcccgtttgcaccaggggacacttacagaggtagctgctttatttcagaactattgttaatttcagaacataatcttttcaactaattcatgtcctgtaatgttatttgtctggtgcttacttgaacaatgtaataatatagatggaggaagagtttgcgttgttggattccacttttaggaaggcagggtttcaggaagaaatcacaacttgtatccttcatttttctcacttgtgttatttatggccaagcagtgttgaacactaatactgataaagatacgtaatagaatggatcgaatgcatatttcaatctcgcccaacttatcttttcttatctatttttctttgacaaattagttttgaccaaagagtggtacatcaatgtgctggcaaggatacgcataaatgcattccgcattgaacgggttgcaagttcatatgaaaacccttctatcctcagcagtagcctcagtatcttgccatgcggcagttggcaatgctggctatatgcttccctctttctataaccatgaatg

SEQ ID NO: 14400 - DNA, 663 bp, Oryza sativa
gcacatgcatttatcgatcactttacaaacctaaagcaacaaagccagagagcgacgtagaagggaatcaggcaatcacaaactcaaacaaataaggacatttaccaagcagatttgtgctgatttgtaacattgacagccatgtcacactcgtagtaaattgaagatagcattcatctaatcagttcatgttgcccaaagccagtagagcataaccatgtctcacaacaatggaactttagttataggcaacagaccaaaactgcaaccagacaagtacccattacatttccattgctcttaactcataacatataaggcctactcagaaagacaaaccattgttcaagaactggaccggaaaagcagtacacgaaataaggcgacaatatggcattttactttcaaaaggcaggaaccacgaaataacacaaccgccacagcttcagcgcagcctcctggcctccctctcagactcgagcagggtgaggatgtcgccctcacggaccgggcccttgacgttcctcatgatgagacggttctggtcgtcgaggaacttcactctgacctgggtcacctgacccctggagccggtgcgggccatcacctttaccacgacggcaagtttgacctgggtatccatgctgcacaagcaggaagcat

SEQ ID NO: 14401 - DNA, 511 bp, Oryza sativa
cagatgtccgtgtacgtcctctccgctatcaaacatattctcgttcttgcaatctgcacatggacaacacatgtaatcactgtttcttcttatccgatcctcctccgcggcattcataaaatttattacgccctttcggtacttcgtagaatgacgtttcaaatttttggcatacatccaacttcgatcaattgctacaaaaaaaaaacaaattagaggcacatattataagatcagtattgcaaaagtaagacatgatgaaattgctcaattaatgatttatattactcacttgattgatccattttgatcacttttgggaatttaatttctgttttccttggaaaaaggacaaaaaatcggcccctacagcctcccaccaaaatagtgaacagtgggatacagttacactaggtggtggggggtatttatactgcgcaacaaaaatctgtaacgggccttaaacaatcaaccgtgacgagcatacaaagaaatctctatcgggccttaa

SEQ ID NO: 14402 - DNA, 745 bp, Oryza sativa
  unsure (1)..(745): unsure at all n locations
gatagtacctgcttcatcaaaaccaggtatcacggtatgctcattagctggttcacactgactacctggaatgctgtttgcacatgataaattaatagcattaagactgtaattcatataactttcttgatgagaattgaaagtattgaatggagcatcacctttctagtttttctctattcacatcttctgttacatcctgactattagaaacaggtgagcttctttttattacctggtatacagatagtttagagagatacttggttttaaataaaagaagccaaacaaattatatattaggaagaacaatcctgcaagcaggacttgtaccaagaaatgcacacaggagataatgcaaatatgcaattgaagctttcaatatttgcatctcatatggtctcacctcatgcccaatactgtcaaatatgtcttgaaatttatgtaaagcaatctccatgttgtgaagctccataagcattgcctaaataaagaaaaacagtaaatatcaacttagatttttggagtttcagagaaattggaaaggcgttatgctataactgaataacctgcttctctgaagtcagtctctcaataatctcatccttcaccaataaagatttcctaaggtaacatcgttaaggagacgcaaccaaccaaatgagatcaatagaaacaatgacttttaactnnnnnnnnnnnnnnnnnnnnnnnnnnnnnnnnnnnnnnnnnnnnnnnnnnnnnn

SEQ ID NO: 14403 - DNA, 2454 bp, Oryza sativa
cctcacatagtccatcacatttgctatcacatagtgcaccacatacgtcatactactaacaaatagattaacttcatagttaatcacttcttctgttggcgccgaatagcttgcgagcccggagtgtacctacatttgaaaatccaatgtttaaaacatttaaaaacaaaatgagggaaatcaaataacatttgagaatggtaaactcatttacctctttttcgctgcctgagtggatcgcaagttgtattgggtgggttgcgtcccctgaggcgcatcgggaagctgcgacatgtctatctcctcagcgtctggtgcgacgtagtcctcatcctcctcgtcatcgtcgtcgctaggtggagccggcgccttcccctttcccctcccttgtggaatgcgtgacgacgacaaaccaccaacttcttcacgctcttctatcctgatggagtgtcgagcgatacttggacgacgaaccaccgtagtaaacacgaacaagtctatccatctacaccaaaaaatcaaatgtaactttacaactaaaattaaatcttccttcctaaacgtagtccaaaccgacatattataaccaatgtataacttaaattgtctcaaagctactactccacaaaaaaatatttaatccacctacaaatatcaacaagtttactagcgcattacacatcgaaatattacaaatactccgtcatacaacccaacctagttctaagtaactataattaatttctataatgcaaccaaaattttctccccttcatataattaatgagtaaaagtttaacctataggctatagcatcaagtccatcaaattaaaattactttcatgcctcaaccctaatttttcatctatccatctaaccaaaccatccaaaaataacattaccacatatatggttcaaaaaatcgtgacaccaatgagtacattgcaaacatgtagcactacaacaagctaatcccaagaacaaatgctaaaaatcacaaaatttgggctaaaaagaggttctagggttaccctccgatctacaaattcaaccaataaaaacgaaaaaaaaagaggggggaatggaggagtctacctttctcttcgatttccacaaaaaatcccgcgaaaaacgagttcaaatcgagtggatttgaggtggaaaggttagggggagaaaaaaggataaaaacagctagcagcggctcacgctaagactcaggcgaaaatggcagtggccaggaaaaaggtggtggggcccacggggtttaagggcgcggcccacagaagaggggcgcgccagccatgctagcacagtcgtatgaggggcgtcgccagggtggctggcgcccccttctgctcagtcagcatcgccacgacagctctagtgtcacggtggcacgggcacggcgccatggtggctggcaccaccatgttggaggacggcgccagccactctggcgccccaaaaaggaccattcctggtttaagtttttccaggggtctatttgtaaaataaatttttaaaaatgatcaaaatgtaaaaattctacacgaggcagcaggacgtgacaaacggatcccgtgactccgtcggtgacgaggaaagccctcatggttactcttgtttttttatgctacacaaatcgttataagaggttgaagaaaaaaagatatcacaaacaaattatatctcaaatggtctacaaaagcttaactaattccaaaaacatgttttacaacatgatggtgtttcctaagaacattaatgttataaaaccagtcccaaaatcaacatcggtagctaaacgtgaaagaaacgccataggagatccaaacacgatgatgacaccgaggcatgatatttggtaaaggagttcagccgaggcctacatctccgaggcactgattacgggcgctcctcccggatccagcatattacagcgtatcagagttacaacgactcacggccggtcgccgctagcagctgctccctctcgctatgctaagtcaccatgcagttacaacaggtccacctctctatttaagagagatccaaggatagagtccgactcttactctattccaatttctaaactgtaaccgactatatacacatattcgacataaactcttacaattaaaataaaaaataagagtgaatggcaaattggactacatatcgtggactaaaaccacataaatttgcagtcttgcagattagaagggggcgagaaacattgcaccaaacccccaaattgacaactcaaatctacataatgtaaccgattcaatcaccatataagttagcaccccgttcctattctctatcttgtacttactatatttggcaactcaagccatataacacacataatttagaagaacaaatttgcatggtgttaagtgaaaaggatggttatgccctagttcaatgcgaaactatggttaaaa

SEQ ID NO: 14404 - DNA, 7330 bp, Oryza sativa
tgttaagtgaaaaggatggttatgccctagttcaatgcgaaactatggttaaaatatctagcctaacgagcaaatcagtctaagaataaacaacttctccttttcacacaaacaacattttaaagtaattaatttcacgagaattaattaaactaacacgtatgaaaaaaccatgtgttctaaggccatggccaacgctccaagctagagcgtggtctagccctgcccgagggaaatattcatgccagctcggatgggaccgcaccctagcagaactacgcgacccacagcagagcgccgcgtttcgtcagagccgtagcgaggaaagcgtgaggaaccgcattgggaagaggcatcgccccgtgtcgttgccccacaccgggaaagaagatatggcgaggggatggatgggagagaatggcctacttgggaggctcaccgatccaccacctccgggcctgctacttggccaccctgagcaccgctacatcgatccgccgccacgttgatccccacctccgccgtcgattttctgtcgttatcacatcgatccccacctccagtacatctatctgtcgtccccgcatcgatcaacgccagggaggtagaggggagctcgagctcatcgccttcttggcggtggcgtcaaagagagggagggcagaagcggcgcagctgagaagggaaagctgacgggagaggtggtgtcgccgaggaaggggaagaggagaggcgaaagaagacagggagagggaaggtgtgggtctttatatatgtttgtgatatttaggggagcatactacaaatattgggcttatatgcgaatagaaaaacacaaggatttaaatgcaaaatatgaccgactaacaacgtccgaaacgcaaaagcaatatgaaactatggttggcactctattagggatatcacaagtgtggttttatcccatttttagcatcttctttcttatgggggctatggcttccaatggccaagcgaagctattcatacataaaaccttctcctgaagggatagcgaacgaggctttcttggcagataaccgcacaaaacctaccatcatacaacaggccactactgtcttgtgtcctcggaaaccggttcgtcccacggtacaccatcaccaactctttaattatttaggtatatacatctatcatttctataatatataacatgcattcattcacatatttcgtagcaaagcgcgggatatcaactagtctgcatatatggctcagacatgctaactagctaggcctggtccggaaagcccgtggccggtgcagttcaatatccagcctcatgttggccagctgcctctctctcatagcaaaccagctgatgaagagccttcaccaagcacaaaatgtggctgcctgtcctctccttgttggcatagaacaatgtctctatcttgctcaccctggaatctgcagaattattcgatcggcttctgataatattgcagtgaaagtcttgcacgtcgtcggcatcctccatcctggtccaaagaaacaaaataatgaagggatgttggacaagctatatctgccctttgtcttgcatgtattttgcatagtctaaactctattcagttttcatgcctaataggaagttggaatgccgtggaagaactgttattccttttttttgttttgctatttatcagttgccaggaaatttcttatttgtcagtcacctagaggtcctagaccaactgcagtttagacttgcacaaaatcttttaccaactttggtgcatcttttaatctggtatgttctttttttttaagagttcacccggatgcgtgtttttatatatgatgattttgctcactgtagttgcctgaattttttttcttggttgtcgttccactaaatttgtacggtgtgttgactaaacttgtatactcttggtacaacctttttgttcttttacagattaaattgctaatttgtgagttttggatgttgatctacttagaagagtgactaatgacaaaaaaaactgtcacttaacaaatactccctccgtcccaaattataagcctatattttttctacatggtcttcggtgacatactttgaccattaatttattccatgttatgtttccaacaaatataaaattagcatcagatgaaagtactttaaaatataaatctagtcccaaattataagcctatattttttctacatggtcttcagtgacatactttgaccattaatttattccatgttatgttcccaacaaatataaaattagcatcagatgaaaattagcatcagatgaaagtactttaaaatataaatctagtgatataacatacataatatttagcatatatatggttaatattattattcgtcaaaagttactgagcttgatttttttaaaaaagaagttgccctataatttgggactgagggagtagatggtcactctctaagtctatttgatgagcaccactgattggtggtatagccaccctaatcttgggctaattgaactgatggaagagacaagattaattcaaattaaatgattaaagctaaaccaaacaaagagttaaatgatgaacaacgaacttaagaaataaaaagaagtgaaactagttaggctataatgctctaccgtacctgttcatcgcctgttcgctagctccatcattgtaactaggtcgtaccccccgcggcctttgccgcggacccaataaaaagcataaaaaaactaaaggatgaagagacatcaacaaatacaatacaatattttggtaaaataagaattgtgtggataatctaaacattgcaaacgtataggagtaaaagatagcaaattagatgtgcctgaagccctgaacattgctaatagcatattagtttactaatgcatacggcgtgtcaataatattggcaaatgaacaggaactgcagcatctcaatacacacattaacaaatacggtacatcataggcataagaacatcatcaaagaccaagtgtgtgcatattggtggtagcatatacaacctaatgattttgcatagtgcattacatatagaggtacgcacaacaacaaacatggaaaagtttgtagcattgtaactgaatgaaggaaaggaaatgataatggtcagcctctgggtttggttgtcgtttgcaactttgcatcgatagtagactaccaggataacaacaaatagatggcaccaataaacaacttgatcaacctgcatgaacatatgagaaaagggaatcaagtagaatgccatgatattactgccaaataatcaaaaaagaatgtgttcggttgtgtttgaaaaaaaaaagtaatatgataaaattaaagttgcaagtcttggcaaagtaaaacaacagaagctgttttgaactatactgagctcagtatacatacataattatccgtaatctgtttcagtgagctgaaaataaaatgagtaaatagcacatactatagtgtgctttaagaagtaaaaaacaataggactaccttttttgtgtgtgtttgtgtatgtggagacacaactatttaactgaatgtattttttttttcatttacagcagtaagcaatttagaggaagggaaaaaatatatgcatcaatatttcctgtatttcgtgccatccaatgcagagtttgagaccatatgacatgagggtacacaaaaatgatgaacccatgtatatccaagggaagatcaacaaataataactttaaaagaaaattacctttgtatttaggtgaagaactgcacactacagtgggaacatacaaccacacggaagaagcataacacatcatatatctctcaatttgatgattttgggcaccatgcactacaatctggaaatagtgaaatatatagatgttagaccaatcgatgcaagatataaacatagaaacatagcgatgagaatacctggtaaaattaagcacgttgattcgcgatatcgctgaatatttcagtatacacgacattatgtgggatgaagcaatattatcgaattagtcctcaacgctgaattagtcctcaaagcaatattatcaaattagccctcaaccaccaattttgacatggaagccatcaccacatgtaattgcagatagtagcctcacatcacagctagcggcaactgcaggaaacagatcaagcaatcagggtcaggcagagcaaaaccacagagaaaaaaaaacagggaaaattagagtgggatgcttaatttcttaacctttacagatctctatgaattgaacagggattgggtactcaggtctgatatagggggcattcatggcggaaagacttcatggtacataaagaaaagtaacactacaaaatatagaacaaaggctaacaaatttatgacacattggttgttagctcacctcttatttgttttgcctaatatagcggcctttccctcacgttttgactcacaaagaatatattcgacaggacatggacatgatgttaaggctatgcactcacccaaatcgaactggttcttaacactattctcatgcactgatgtctggtctgacctagatggatttaaaggaaacatgaataattcaagagatagaaggaaatacatggatagtagcagcacacacagctagagtcatagaagctagcaggcagtacctctgaacccccaacccctgggaaaaaaagagcacaaattacagatgcaaccaatgggtggaaacgatcctcctaacacaccatcggatgttctatattttgtatcttgcttttgcagaacttccattgatagtctaatttaaattgggcaacaaaataatctgtcacaacattgatatataagtccattccaatttgagctaaattttatatgtaataatgaaaaacagcatatacaactattttgcatcataactcataaatttaggtgcagtccaaacatgaatttcttgatcttagtttagttctcttggaaactactgcacaatgtagccctcgagcttcggaggcctgaatctccaccaggtgtcctctaaaaaatgtgactactacataacattggtttaactaaatggaagcaggtcaccagcaggctgagtggaggagacgcagggaacctggtgtagcagcaacactacatgactgcaaacaccaatgacggggaagaactacatgactgcaaacatcaataacgggaagaaataggtcaggtgcaggaaggagaggattgaaggaggattaccacggattgggctctcctggaggagcctgagatagctggagctgcagccctgcctacgacgacccgatctttggatagattgtggggggaatcgaacttgaagggacaataaaaatagcttggagggactatgaaggatcttctagaagtttcaatgtggggaggagcttcgagggtggccaggagtcgggctcagatcggcagcggcggcgaccatctcgtcccggtgacgaaggcagcttgcccagtatatcgtagctgttgcaaccgccaccgccgtcatcgccgtcagatccaccacgggaagccgttgccgcgggtggatcgggccgggggaaaccgccggcaccgtcgtcgccgtcggatccaccgcgggaagcggccggcgccatcggtgccgcggcactccacccctctctcttgttttccgctggtgccttcatcgtcttcgcgccgggtcggtgagacaggagggagaggaggagagggactggcgacgccggtgaggggaaggcgcggcgtgattacggctagggtttcgatggacggccaaaacaactcgcggaaggatcggacggccaaaattagagtgaacagtggaacagtgccaggctgcgcaacaccgagccgtacctcaccgaaaactagagttttttttttctatcaaaaaaaaagaaaactagagtttttatagatacaatctggtaatcacggagaacaaggaaaaggcttattgaacataccacccattttagaaaatactttgaggcaagtcaacaaatatatcagagcaagcaacgtagctgggataagattgttacgaaacgcattgtccaacaaaatcataattgtgatagaaatacaatacaattaacaacccttgttgtggcattgcttaatgttatttgtcattatgagtttggattgaggcataagtttttgtagacatttaagttttcagaaacatctgctactgaaataagaaattacaagttaattctccacgtgtcatgcattacttagttgacaaaacagtccatattgtcagtatggcagattctacattcattttctagatttctctatttgtattgtgttcttgtccatgtgtgtttgtcaccattagatgcaaattgaacagtacagattgagattgagatgatattctaatcatgtgctgatgcacctttatttttgctcatttatacaggatgaaggaggaactaataattcatatgaaaacatggctagatacatgtaatatttagaactctcttcctttgtacattctattatccactcgttcttgtacataaccttctatgcttcttaatttatatgatcatctttaatagttaatattaccttgtggattcagcaattggcacaagccattgcaacattctattcatttcagctctgacctcttcttcagatgtctacgataaaatattagtactgagatcaaatttgaaatagatgaatactgtatgatatttctcatgttgagttgttgtaaaagagagactaccttatctatggacaaaaacggcttcaactttctataaaatactaatttgatgcaaggaggaagcatttggtataatgcatctttagcttccttaggaacagacttcaagactgagggatcggttttctcaaaggccaatgcctgaaaacaatgaagtcataaaaaaatataggacaaggcataatctaaagaaagaacaatgtcaatatctgaccattaagtggtaatttaatatcatttttcatgttgaagatggcatagcaccagagaaacagtgatgtaccagtttatttatctgcaaaataacttttgaatattgcaaggcaagtccagtggaacctaacgtttccccaagcaggttgcccactgcctctacataatggtcttcaccagtatgcaaaaaaactttgttgatctccaaataaatgagcagcacaatgtctacaagtttttgtacaatctgcaacagaacatatggagcattattgtaagatatggatcagatagaacaaatattgatgacatatcaaga

SEQ ID NO: 14405 - DNA, 4981 bp, Oryza sativa
  unsure (1)..(4981): unsure at all n locations
nnnnnnnnnnnnnnnnnnnnnnnnnnnnnnnnnnnnnnnnnnnnnnnnnnnnncaaggcataatctaaagaaagaacaatgtcaatatctgaccattaagtggtaatttaatatcatttttcatgttgaagatggcatagcaccagagaaacagtgatgtaccagtttatttatctgcaaaataacttttgaatattgcaaggcaagtccagtggaacctaacgtttccccaagcaggttgcccactgcctctacataatggtcttcaccagtatgcaaaaaaactttgttgatctccaaataaatgagcagcacaatgtctacaagtttttgtacaatctgcaacagaacatatggagcattattgtaagatatggatcagatagaacaaatattgatgacatatcaagatgttgcactacatcatccatcttcttggaccaaagtgacttcttctgcaggtttgccacagcaatcctttggttcttcactgaactaattgttatacctgcatacggcagcggttttattgaaaccggcaagagaatattcacattaaatttgtatcttatttggatgcctatgtcaaaaatttaatacaaagttacaaaccactttgtaccactgtaggtttcccctgttcgaacttgtccaacacacacatttccttatacagttcctggcaattaatagaatgagagaacagaaaaggcaacaagatttcaaaaagacaattatcatgaattagagagtatgaatcactgaccatggtgtattgtgcacgttttaatagatattgcattgcagaaactgcttcttctttgctgcatgccagttctgattccaaaataacgtattctcgagatttgtaaagtagctctaatctacattgacaagaagagcaaaaagggatacatgaatggagatgaatcaatgagctccactataaattagctggtaaaaattcatggtaaaaagttgtatttgcagggtcaaagtagcagaagaacattatgttttgtttacttgttaaaataaagatccaagttgcgccatacaggatctttgcacagctttccaagcctaataacatctaaagcaaatcttctcaactgttctctgcatagtttgcagtaaatatatatataagtaatcttggaaagttcatctacaaaacatccacatgaaaatgcatagcttaccttatgtcagcttgatgaataatgagcaattgatagtactgttctgaaatcagagtgcggacaccttcacactgaagcacaacttcattcagatgactcacactttcttcagagagggatttcataaggtttgatccactgacaattgtgttggccacctcaaaggccaggatacctatttttctttctccagaagcagcaccatcagatttcatcatatttgagcccctgacaagtattttggctactccaaaggccatgatctctatcatacttcttcttgcaggaacacaggacacggcggcggtgctttcggtgttcgaagtagatgatctagcccccagcatgctgtcaacataggttgcagcaatgacctgctttgcagtgtttgaggtcgatagtccagtccttgctatggttaaatcatctaataagtttgcagatttcatggtgaacatttgtagtgcctgtatgacaaagatgtgtcatacttagggatcatgatttttctatatgaagtataatgtgattggagaagagtaaattacatgcatgaactccagttgggaatgcagattttatttgtatgttattgttcaaaatcaaggtgctggagtcattgaatgacagttgtacaggcacataggaaatttccaaaggaagtaaaagaggcacttcaatccataaaatattacaaattaaataaatattttaattttacttttaaaatacttgctaatgcattagaatcttttgaccgatagaaagttatattgaaccaaatggtgcatgcaccagcacaaaaaatttgcatatatattcactccaaatttcctatataatttattgatgtagattataccagcaatttgcacttccgaatttgtgtgaagatgataatatgtgtgtaaatataatagtatactgagacagactacattttatattatgatgccactgtctattttgtaatttacaggaaatatcatatatgacaaatttatagacattttaccatgtgttctaacatatcctctattgaaaaattcgatggaaatcgttatgtgttaagtgtaaactatagataccgatgcatgacactcgcattataaaattttatagtttattttacaattgcacattactttttatagtgctctagtaactaacatattctaatggtcaaactcctatgttcaaataatctgcgataacaagtactccctacccaaaataaatcaacttttgtacacaaatctgggcatagctatagttttgtacactatgtaatcaacttttgtacatgaatctggacatagctatgtccagattcgtttacaaaagttgatttattttgggacagggcatattatacaaaatatgagcgccaaaaaccatattgtttctattttcatataaactaaaagaacatccaatcctaccatatgattagtttgatttggagttcctgtggacattctatctttacagaaactgaaattataatcatccattcccaacataatatgatgagctctgttctgtgcagagttcctgtggatagtctcttatgtttccatgggctctaaaactagctctatgtaacaaaaagaacgcttgttctacacctaaatgtttttgtagataatggaagataacatccaggatctgcatcacacaaccattctatacctagttttagcacaaggaattatgatagagcatgggatgagtaatcttacctggcctacatgtgaccaatttttacactctgtttcgttaagcttttggattacatttcaagcactaggccttttctttgggtcaggatcaacacaagcgagtcctatctccatgcatgtgtatatttgttggcaacaagtcttcattgatgtgcatcccactgttcgttccaaccaatccctccaattcttaactacctaacaaattttcatagtgagaaattatgaaaacactagcttaaaattaaattcatcttacatcctctatgaaatgctggaaagattctctggtgcatatccgaggataattcctgtgtcctgttataacctcgatgattatcactcccaaactgaatatatcagatttggttgagattaatccattggccaagtattccggtgccatatatccactacatcataacatggaagttaattagaaatgatacaagaactaaacattgcagtatgtacttgacaaacttatgtagcagtagcttacagtgttccctcacgacttccagtgataatccgtgattgttcatggccgaaaagccttgacataccaaaatccgcaatttttgggcccatatcgtcatccatcaatatattttcaggtttaagatccaaatgaataatatggcattcctcatgaatgtattgcaagccctaggaaattcccctgattattttgtatctcatgtgccacccaagtccataggattcagctataaaagtatatcaaagcacacgcacaagcatacaatcatgtaagaataagatcacccaacacttgtattttcaacaatgccacaatatttataatctaaagtgataagcatgaaaagagagataaaaatcattattgtaccagaaatatacttatcaaggctcttgttatgtagatactcgaaacaaagcaaccgtcttggcatttcaaccatgacatatttcttgccattcacttgcaacacttcccaccgtgattcagcacagtagcctgtaaatcgtactatgttcgggtgcttgagatccataaggaatgtaacctcgttctgaaatttatcatctttcaacatgtgtatctcgaggagcttcttcacagcgatcatttttccattgctaagaattccctgtttatataaattgtctttcaaatcttttttttatagagaaggaatgtaacctccttctgaaatttatcatctttcaatgtgtatcttgaggagcttcttcacaacgatcatttttccattgctaagaataccctgtttatataaattgtctttcaaatcttttttttaaagagaagggtatttttttacccggcctctgcatccaactggatatatgcagccttttttaaattaggaacttagccctcaattaacccaatctgaaattcgctcctatgaagatttgaactcaggaccttagggtgttactcaggtcactgcaaccactaggctacatgcctggtaatacttggggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagaaaaataatattgcacacagatcaaatttttttaacttatggctttgtcacaagaacactacagattcttccacagttaacttggccacaagaataatacggatagaagtagtaaaaagggcaaagctatatgctaaaagaattccttgaaacaatcaaacatctttttgaactactttattacaagttcgaaccaaagcatatcaattatttaaataatatctaaagtgcatgtttcattcttaaactatttagcttgaatgcatagtaattattcaaacatctcagcaaagaaattacatagcagctggatagttttgtattatccattgggtcacatattccttaat

SEQ ID NO: 14406 - DNA, 244 bp, Oryza sativa
  unsure (1)..(244): unsure at all n locations
gggcgggtggcgaagacccctcggccggaggactccgtcagcgccacgcggatcggcggcgccgccgcggtgcagagaaggcggcggcggaggtggtggaacatggagtggacggctggcagagatctcagccgctgattctgattgagggaactcacgttcgtccgttgaaggctcttttgaatgcagaggtatgaatttcagannnnnnnnnnnnnnnnnnnnnnnnnnnnnnnnnnnnnnn

SEQ ID NO: 14407 - DNA, 7138 bp, Oryza sativa
  unsure (1)..(7138): unsure at all n locations
cagccactctggcgccccaaaaaggaccattttcggtttaagtttttctaggggtctatttgtaaaataagttttcaaaaaggaccaaaatataaaaattccaggttgcctcgtaactgttggttgatttttattatctaatgccggttagttgggataagaataaaatcttactggtttcctttcctaacaagaatcaataagagataaagtctatttttgtgtgatcggtacaaaaacacattcagattctaattagagataaagccattgagtcccaccagtgtcctatataagaaagagtagagaaaatagaggtgacaactgaactctctctaaccctaaaaccctaaatcaattcgtccgatcgattttgaaccctaaaaccctaaatcaattcgtccgatcgattttgacattggaaggggttcgtgagagtttccttttcgtcaaccggagagcgtagcagaagaggagtgaaggagaaaagcaaaggaataacatcaaaaccacatacccgtttcaatggcttcattctcaagccagttagatcgcccatgtaattaagcagaggtgattatgtttagactaagactcaaagtaattaagaagattaaactccaacagtaaccaactccatttcctcgcccctgtcgtcaaccctgccaataagcaggttagcacttaggccctgtttctttcggtttgagattattataatctagattattgagtcagattactataagctagattgttataatctgtagtagaataagcggttagttgtttctttcctagattattagagcctaaattattgggtttgcaagtctaaagagagagtggggtggtatggtgggtaatttttcactcaataatctggaaaaagctcacctaaatgagcttatcagattataataagttgggctccagattataataagctacttcaataagttgtatgtttctttcagtttactcttagtaatctggattataataatcccaaactgaaagaaaaaaggccttagcaccctcggctactatgcctcgtcgttgcaccgccaagaacagcaacaggtgatggagagagatgaaggttgaagaaaatacaagagacgttggatatcaaaccaatggtgagattcaatcgactatctccttcaatcgtctgataaataggaaagccgtacaaataatcactaaataggaagaaaactaactaaacaacccccctcctctcttaaaaaaaacagtgcaagtttgttcgcccccaaaagaaaaaggaaagaaagagaggaaaatttgtaccgctgcataattaatgtgaaaaaaaaagaaaaaaaataaattttacagactcaagtgtgtaaccctcttactcatactggttgttcttgtgaatccagtagtacaggcatatgtacaacaaaggtgcatgattgcatcccagggcctcacttaataagtacaagaaacaaacaaacaaaaaaaaaacagagaaaaaacaaaaaattacactcacctagctaactaagcaattatatgccacacttgctgctgatggtgattaaaagctccaggttgatccaccgggttaactaataattaattaaaccacccaagctaatcactaattaggagacagtaattaattaaaaaaacattctgtccgtgacgtcacttcttcttggcgatagcgccgccgccgccgtcgtagcggcggctgctgctgccgccgccgccgccgctcctcacctcctccggcgcgatgaacgactccgggcagaggccggcgacgttgaaggcgacgtcgtcgatggtccacgcctcctccatccgcgtgacggcgcgggcggcgccgacgtcggcgcccaagcgggcgaggtgggcgacggaggtgcccgcgtgcgccaccactggggccgtcggcggagcggtagtcgccgaggcgggaggagacggtggtctcccagtacattgccggcgcgccgggggtctggatgcgggtgagctgcgagtcgtctaggcgggcgaggaggccgctccgctggctgaagtagcccgtcatgccgtgccggatcaccttcgccgcgccgtcgccccaggcggagagcaccgactgcgccacgtcgagccgcagcgcgaagcagtcctcgccgtcgacggccttctcgccgacgtgctccgccgccgagaacaccgacgcgatcgtcaccgggtccagcccctgcacatgcacagccatgcacacatgtacgatcgtcagcaccgacacttcatcggcatgcacacgtggacgcttctcattggtgcagatgcattgtctatattctactcaatccatcctaaaatataagtaattatgcttcagattcatttcagattcatagtaataagatatttcattcaaccaaaatctttaggacactgacgtgtctacgatttttctatgggtggtccaaattatatatatttttcaaataacctaaatataacaaagttaaaagtataaatggatcaaatgtacattataatatattaaatatgagctctttttttttctcaaaagttttcttttcacatatatgtatatttatgcattgggctaggatttttttagtggtcgtatgaccaccgggatcatcctctagatccgcctatgctttaggatggagagagtatccgtttcatattattataagatcttttagttttattccaaagtcaaattttcttactttcaccaaaattatagaaaatgcactaattgttcaccattgcattgcattattttgctcctatttttcctgtagttttaaaattttgttaggtaaactcattgatggggcatcaattttgtttcataattaaagatataaaggctcatggcatggcctttttattagacatctagacagattcattactgtggtacagtgttcatataggatgccattgagccctatgaggatgaaaggtgcttggtagtagcatctttttggagtcctatgtcctagaactgttgttattgagaaaaggttgatgtccttatgctgttccaaggacatctctgctctcttatggatgtaaatatgagccataaattcagaggcaagaacatgcaggtgcagtgtattttattgtgccatgggagacaaaaaagaatgctgtgtgaaatagaaagccagtacacttgtatgttgtatcaaacacatcatgcccaaagctcctctcttttcacagtacaaaaacagctaagacactctaggatgcccactgatatctgttcagcagtattcactatagtacagagcatccagcataggatactgttgagagtaacccccatccagtttcatttcacacacttttgccagagagatttggtgaagtttggtgtgttggcaattatacagcatgaccagcatgcagtgctgtgtgattatgtactaaattagtactaacctgacatggggactatgatgtgttccatctccattgttgatctgggtcagctaatcaattgccagaaaggtacatctcttaatgatacaccatgcatgtaaatgatcccagttattctgatagtctgattgggtttcagaaagactaagcaaactgtttcagtgtctataaggaaaataacatggatgcagactctcactcaaagtggtttaacatgatgtcccatgttcaacagaagcttaactttctttgccatgctgatgtgaggcagcttacaaaaagtctaaatcaattgacctaatagaccaaattggtgtaacactcaggacagatacacctacttagatacgcactgctgcatcctaaaaatatttaaaactatttgataacatgaagattttcagaaatcagaatgcatgagtggcagtgcatccaattttcctactgccaagctgttaaagctgtactagccaatcatagtagctagagatttcaaaggacaggtcagtggcctaaccataatcataatccatgctcttttatttggtcctcctatgaggaccggataaaatggtttttcaactagctatctcagcagttgctagaatatccagatatatattaaaaacagtactagtcgatcggctaatggtatgttcagatatcttggttaactttcaccaaagaagaatgatactactacttggcactagagtatcatcaatttcagacacagatttatactagcctcagtttgccaaattgctcaagatatatgcctcaaaagccaatcttgtaaacagacgagtgctacttagaaggaagcaaagtctgcggactctgcatcctcacagaaagtttttttcaagagtatctcaagagtgatctgaatttttttttcaggaaatgaggggcagcagcctcagatcccgaggtgaaacagtggaaatgaaagaatgccatatctgcacctttattttcagccaaagattcttctttcacaaatgctccccaattcttcaccctctttttttgcgaaataatactcccacacacccagcacacaaattaaagcacaaaaggcaaaggcgaattcagcaaagcgatccacaaaaagaaaagcagcgatttctacgtacacgctcatacacctctcacattgcttttgggtagcttcccagtgtactccgacatacataaatttcagcttaaatttttgtctagagatacttgttatttctcattcaaaatggtttaaatgttttaaatatatatacatgctcacattttttaggataaaggaagaaacttttattgttgaacttggacaattatatcaaggcaacatctacataactaagcatacagccaaacctattcgcatcgttctccgaaaaagagtttacatcattgataaaggaataggtttccaaagataagatcacctaatgtatgtctgtatgtgcttgcaaaattatcaggtattttggtcactttttttataaaaaaaatgacatgtttttttttttgacacattggtaatttctattcgccattcgaacaaaggccccatgtatatatttgaagaatacacatgaagtactcctatttattttcttatgaattcctttgtacgttacgtatgcttgtacgtacaaaatgtatgcgtacgatttttttttttcgttttgatttctttcggtttagacatttataagtttagattgcaatgcaaactaatgcaaaactaattatttttttgcctaaactgaattttaatcggattagaggaggagctaatcagaatggccaaatggcagggacatgcggggtgccaacctggagggctcttccgataggtatatcgccgccgacgcacgcggggtgggcgtccagccacgcgtgcggagccacgcgacccgggactgggacatacggcggagactgcgtgccccgccacggccatttagacgagccccatgtacggcacgagctgccacactacgaagcacccctcgtgcccgcctccgccgacgacgccgatgccgatgccgccgccgggctccggcgccatggccatccgcaccctccccgccgcgtacatgctcttcgccgcgccctcgatcttggcgcaccccgtcgtcgcccggaactgctcgaggatgtactgcgccgacgacgccacctgcacgacacgacacacacgcacgacgtcgtgagcgcgcgtagcacgaagaggaagtccggcagagcgagacgcggcggcggcgacggcgagacgtacgttgcgcgggtggcgcgggaggacggggacgggggagagcgggcaggcgaggacggagaggagcacgcggaggtcgggggaggggcgtgcgtctccgccgaagacgacacgcctgcgtcatcttccccaccggaaagaaaccggagcgggatgcgcgcccgcgcccagcggtggagcgccccgtgcaggccggtctttcgncgngcccgngcccgcttcttcccgcccccgggttcttcgncagcgtggccagctgcggcgccatgaacaaacaccttcgttgcctcagctcagctcagctcatcacttgtgttaaaaaggagggaagagaagagacaagggggagtttgacagtgtctggatggtgggcccggggaaggttgggttgtggggcccacttgccaggaagggtgtgactgtatgcctggaaggtggggcccagggctttgggagagctttgaagggaggcaagaggattgagggggtcgggggagggtctaaatcttgggtgtgagaaattggagctattttagcactaaatgctggtatgggataaaacattttgatcatgttttttttcctactatttcaacatcgattttttacggctaactattctttggtatgtcatgtacctgctgaaaacaaagcgcttatagcaagttcgtcaatctattgatatgctggcccaatcttttagagaggcttataagggtaggaataggatgtatgaaagtatgtttgtggggtgagtgtgcatgtatttatataaacgtttgtgtttgtgcttttttttaaaaaaaaagaaaatatacaccagaaaagaatttcttaataatttcatattatttatgtatgcaaattcaatgttcaaagttttaatgacagtgcatgtttgcggataggggtaaaaatatttttaaacacaaaaataaaaacagtgtacaatctaagacaagggagaagcctaagaagaacagtggatttgacagatcaaaactaattaagcatgaagtccatgaagaataatgagcaacatgacatttcggtttagcaacaagaacttgctgttggtgtggtaacccatcctggggtgatctgatggccacctgacctggagattacatattgccaaatcgttgatgattcctctcaaatcatggcattttcagaatgatctcatcttctgaattgaaggccccatcacgattcccaactactgcattgcattacatggcatttcagggccttttatttttctttttattcagatgatggcgacactgcaactctttttcgtagctcatgtgtagtgtatgtgagatggagaatgaagaggagggtattgagggtgacatggcaaccagatgtgtaataccttac

SEQ ID NO: 14408 - DNA, 9052 bp, Oryza sativa
aaaatatttttaaacacaaaaataaaaacagtgtacaatctaagacaagggagaagcctaagaagaacagtggatttgacagatcaaaactaattaagcatgaagtccatgaagaataatgagcaacatgacatttcggtttagcaacaagaacttgctgttggtgtggtaacccatcctggggtgatctgatggccacctgacctggagattacatattgccaaatcgttgatgattcctctcaaatcatggcattttcagaatgatctcatcttctgaattgaaggccccatcacgattcccaactactgcattgcattacatggcatttcagggccttttatttttctttttattcagatgatggcgacactgcaactctttttcgtagctcatgtgtagtgtatgtgagatggagaatgaagaggagggtattgagggtgacatggcaaccagatgtgtaataccttacctactactagtattgtttcctctgtatttagcatgcattggtagggttttttttttgtactggagaagaagaatccaagctttgatctttttgcattgtgatatttcagaacagtattgaaaaaaaagacttttagaaccttgagctttcttttcttgtttttggaaccaacttgagccatggagatcaagacctgaagatgaaaagaatgacaacttaccatctgagttttgagctataggtgttgaagattgatcttgtcaggaaaagaactttcagagttacattccaggagttagtgtaaatgttaagcttctgtaaaacaattagctgtcttatttaacagctgagttatgaccttagtaacaggatttactgccatgttaattcatgggtcctcctgctctgctatgttagtagtatatatctatgactgcttcaagacccttttctgtggcatttatcatgatcctgtggacctcaagtacctcactggcaagtcaatccagacctttatttccccagcttttctggttcccaatgattttaagctatttgatccgtgcactgatcacatctgcatagttatgtcagtattaaaaaccatggcttcactgttgctgaacccctgatgcatactcgttcgtttcaaaatatagctatttcttaaaaaaaaaaattcacggagattaacaagataggtaaaaagactaggttatcctttattaattatcccagatggtgggatgtgggtgggggttatggaaatgaatagtattttgaatatttcatcactataaatacctattagtagtttataagtagttatattttaaaacaaaatttgaacgctagaatatattttaggaccgagtgagtgagtatataatagctgcatgctttactgctggtcatagtgtgccccagcaattatcatttaactgatggatgcctttattttgttcagtcacagaactctcatggacttttttttttctgtattggtattcttgctgtatatccatccaattcaatacggaacaagggtcaagattaggatagaatactttctgattcattacaggaagaagaagaattaaaaaaagactagtagttgtagcttgcaggcttatccaggaaggatttaggagacagggatattttcaactacttgcattgcatactaagcaaagagagagaatatcagtttaagggttactgtcacaactgatggctgggttgctgtcacttgagccctctcatgtactgaaatgaagccacatggccaaactgttaatgaggttgtttttcatatgatatgatttcttttataggttcagaactatgataacagtcttacaggtggctgtcattttcattatgcaaccagtgtttgttggcaggagaataaaagtcctagattgcattgaacacactaatccatttacttgagaaatgtgaatttctgaaaaaaaaatgatatgcattcagtctcactgaacagaagaagaatttatatatagatgatcaaatcaagcatctattcttatgttcataatagcctcatcatcaggatagcactgtagttggatttctctgttatcatcactttgacctgacattgtaacagtacacttccaaatttgagtgtcagacatctctttccctgatgctattttaagctggaaaaattattttggctaaacctccaaaagcatctgttggagctgacatgataagccacttctttttatgagcattgccatgctaatgaatgaattaattgttcctaaatttgtgacctcctgcatcgatttattttgtgtagttatgatgtgccactttcggttattcactctctcaagcaacccatagctgtctaattgctgtccttgaattaacctctggaaaaaaaaggacaaggattagagacagcattagaaaggtagtctctgcttcttctgaaaagacaaaggaaagggacaatactaactctgtagaattactgcttccatgcttgtctgatcatggccactcattttgtttaacttctaagcaattatgcaagctaatgttttcagactcaatgtcacattttattttccttgacaaaggaaagtagaaatttttcacctgctgaaacaacctttttagaacaggcaggatgtaaaatctacatattttggagatatctttacttgcaaaaagtccaatcaacaaatgtcctagttgtgaaaaagaatagataaactcttcagcagaattggaagctgggatgctgacctggaaagagtttgagacaatttcactagggaatatttccttcaaaaaagaatttgagacttatttccttatataacttgttcaatgatcaagtactacaaattagacaagaaaaaataaataaatagctacaaagttttaagaggtcatctttgtgtaggcctcaaattatggcccaacaggtaacaagcggggtgcctgagaagacttgaaaattgaaacttatttaatgggctgaggtgagatccaagcccaactcaatttcacacaatttgatgtagccaagagatgaaattgtcagcccagtaaccatagctgaaaaagatgtgttgtttggatggcacaaacaaagttgaacaaatttatgcagcatggattttttttcccatttagttaagcctaaataatcaatccaccaaagctgaaaccacaaactgcaatctgaactagtcatttcagaaaaaacagtaatctaacatgcactctgaacctagtcacttcaaatcaaagggttaacatcttggcccttttgttagctcgcccaagctgaagttctaatctaacatggtaatgacacctgagttttgttagggcctgtacatattggagaattatcactgttcctgtgaaatacctgtcttcttgcaggcagcattttcttcagggcagggattcagtccatccctatgaaggtcgaactgacacatatcatgagtcatgaccgagatgtgttccagttcatttttatcttaatgaatgaatggattatggttatctgattttgtggtaatattttagaggaaaaaacgaataaattaactattgctgtttaaaaaggttgttataattaaaatactattctatgaaacgtaacttatatatagaacttctgaaaaatcaaaccatttaaaactttggaaaacatgctcatcataatctatctagtatatgtatatatggccacctatttttatgtcaagctaactccatgcagcatccgagccaagagctctgagacggtgagacctgcaggaccaagggtagctaaaataagcgaactgagcgtagctggtaaggtactttgtgttggctgcttactcctagacttatgtggatgtttgtatttacggataattattttttcagtggtaagtgacgtacctgttaacagtgagacacgtgctaattttgtctatcttaatatatgttggcccggttttcgaatgtgctcatagagataaggtatgtgtttcgcaaaaaaaatatatatatattaggaaagttatttgtgccatcgtaaccaactccagcaagtcttgtaaacaaacccctcaaacaatttttagggctagggaaaaaatgaaatcgagcctagagctctaaaatcggaaagcccctggcgctatatcctaccgtacatacccccaattcccaaggctctagaccacagcccccattctccgtttattcacgcgggaggaaatttatggtctcgtgcctcccactcttcttcaccccatgcgagagccaccacactgtaggccctatctagccagtggcgtccctggcttgccccgtgactccgctgccccgagcttggccaccgatgcctgctccgattgaggctgctgcctccctgccctactttagtggccacttcaccacccctccttttatttgtccgtgcgccaccaaaaaaatggattgggtgtaccgctgatggatctggagatccccatgccatgatgccagtcctcaccttttggatgtccctaagcacccctaacgtcacaccatcatctccattcccgagttggaaccctagcagaaaccagaatatcgtgttgccacctcttgcacttgatgacctcggtgatggcgtaccacgctcctcacccagaacccctaccttctccatatggcactgtcctagcaatcgctcatcgttcgacaattccgcttcgctgccatgcgtatcgtggttaccgtgccagcatcacataacgtgcatgtcacgctacttggacttgtgtcgctgacgtggggatcctaggaaataagggtggtttcttggatttggtggagtcactttggccctcaagaaattggggtagacccctatttatcttttaggactgtaaaatagggctatttatggagattcttagagttgccaaatcacatatactctctctctctccatgatgtcaagaaactaataggaaataggtaaggggtccataatgattccataaagccacagggcaggcaccgaaatggggcttatattagcagggactaagaaataaacgttgtctactgaaattggatactgaaattggatgcctcttagaggtcttaggaaatagggacggccctcatttagtatttggggctacaaaatactagtgactattgctgaatatgctcatattattatatcgctctctcttttcaccatcatctcaagaaactagtaggagctagataacggatcataaatgatgaattcataaatccacaaaaggcaggcaccgaaatggagcctatatggctatatattactgcccatggctcaccatcacaatcaccagccagtcaggcacagtcatcagccgtgtagatgaaatggagagtatgcaaatcaccagtcgccctcatagatcacacccatgtctcatctcatcctcatcatcttgcagatgcaaatgtatctagcatcgatcctagctagctaattaacctaatcttcctccccaatgaacttgcacacactgcagtagcatcagtgatcagtgatcgatcagcttctgctgggcccctgcatatgtctgtctttgaggtagccaacgcggttacacttttactagcaccaacaacccaagaacgaactgcgaccggatgcttcgtttcagtgctagctattagcttcactcgatcgtcgtccagccagctgtggctagctcactctcacttgatcatcaggagtcaatattactcaaccttcagttcagcgtgtgcaggtaggtagggtcgatcagcctagctataacgatgtggcatgcattattaggcctcgtttagttcccaaaacaaacatttttcacccatcacatcgagtgtttggacatatacatgaaatattaaatgtggaaaaaaaataattacacagtttgcgtgtaaattgtaagtttgcgtgtaaattgtaagatgaatcttttaagcttaattgtgccatgatttgacaatatggtgctacagtaaatgtttgctaatgatagattaattaggcttaataaattttaattttataacggaatctgtaatttgttttgttattaaataatatattttatacttcaaattccgatgtgataccccaaaacaaaaacttttgggaactaaaccgggccttattcatcggtgatcgatgcaatgcaagatctctagcttgatcacccccactacccaactaataatgcatttcgatttgatggttccctatatggacgatggattatctgattttgcgataatatttgagggtgcaaataaccaagttaacaattatagagttgaaaagttgttcttaaatgctattctacgaaacttacacatagacaaactttttgcagaaatcaaactattttagagagcttgaaaaacgtaccgtacgtgataatttatagtaatctgtaaaagtaaaagaatgtatccctcttcgctacaccttattcacatcttgtacaaacaaagctataaactgcataataacaaaaattctagtacatgtgtgtcaacatataggatatcccatctgttcaggaatatttgtctgttttgaacgagagtagatggactttgacaattatccctttaagcaacttctaagaaaataggtttaaatgtaatacgttggtaaagaactttaaattacgaatatattgatacaactttgctgctaaatttctctattatttaaaagaaattattttttgttaaaactagacaactcatattcgaacaattattttaaaagtaaagtgtaaatcttttttggatacggcacagtttaggccaaagataggtgacagatgcaacagaaaatactttttaggatgagatttttgcgcttctactcggagtgatccaaaagccactaagtacagatccttccatctgtgacggcccataacaagactggaatttgcgggccgtcacaaggaagtaatctcaatcgggccgaagtttcgcccgattgagatatggtcgcacagccatggtatatcggcataaaactaaagctcatcatggatgacacttatctgtgacaggctatagttgagacccgattgagacgagggttccatatctcaatcgggccctaaaagaagcccgtcacagatgagggtcatctgtgacgggctccaactagaggcccgattgagataagtttattgcccgtcacagatgacactcttttttgacggcattttattaaggcccgatagagattacttgtatgctcgtcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcatgtcttacttttgcaatactgatcttataatatgtgcctctaatttgttttttttttgtagcaattgatcgaagttggatgtatgccaaaaatttgaaacgtcattctacgaagtaccgaaagggcgtaataaattttatgaatgccgcggagggggatcggataagaagaaacagtgattacatgtgttgtccatgtgcagattgcaagaacgagaatatgtttgatagcggagaggacgtacacggacatctgatacaacgaggattcatggagggctatacatgttgggtgaagcatggagagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacctagcccagaatgagagagatggaatgaaattcagcaggttggtaagtgattccgagacgcctttgtacgctggatgcaaagcaaaacacactaaattgtcagttaccttggacctaatgaagctgaaggcaagtagtggatggacagacaagagtttcacagatcttttaggaattttgaaggctatgcttcctgttgagaacacattgcccgagacgacatacgaagcaaagcaagttctgtgtccattggggttagaggtccgtagaattcacgcttgtcccaatgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcgtttcaagagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcagtgacatgagtagtactcacagcacttggccagtttttattgcgaactataacctcccgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttctgtaccattaatgactaccctgcactcggtaatctttccagaaaaactataaaaggaaagaaggcatgctccgattgcaaggaacatacacgaagccggtggttgaagaaatcacgaaagatggtatacatgggtcaccgaaggtggctcccgctacgtcacacatttagaagaaagaagaaaatttttaatgg

SEQ ID NO: 14409 - DNA, 1427 bp, Oryza sativa
aggtccacaatatggtcaaggacataagcaatgagtttgggaagaaaagaaaacgtagcaagacaaaggagaagggtatgtggaagaaaaaatccatattttggcggctaccttactggaaagatcttgatgttcgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccatacgagatgcagagacaggtaaagtgtacctccctccagcctgccacacactgtcgaaggataagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcatcacacgatccaacgtctgtgcgccttcttcaatgcaattggacagaaggttatagatccagaagatctagatgggctgcagactgatattgtgaataccctctgtcaccttgagatgtttttcccactgtctttctttaatataatggttcatctccctgttcatctggtgaagcaaacaaaactatgtggcccggcttttctaagggaaatgtggccgtttgaaaggtacatgggagttctgaagtcgtacgttcgtaacagagctcaacccgaggggagcatcattgaaggttacacgaccgaggaggctattgagttccgtgttaattacatgtctgatgccgatcatatcggagttccagcgtctcgtcacgagggaaggttgtcgggtgttggcacaatcggaaggaaaagaattaggcccgatcaagcatcgtacgcgcaggctcattacgctatgctccaacatatggcagaagttggcccatactttgaggagcacctagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccgtcttggaccatagacacatggcaaggatacgatataaatggatacacattttacaccgtcaaacaagatgacaaaagcacagtgcaaaacagcggtgtccgtatagatgcattccaggatcaagttgggtcaaacacatactacggccacattgaggagatctgggagctaaactacgtcaagtttaaggttcctttgttccgctgccgttgggtgaatctacgcactggtgtcaaagccgac

SEQ ID NO: 14410 - DNA, 978 bp, Oryza sativa
cgatgacttatttttcatttcccaaataagtctttatatttgtgagtacaaaacatacagctgctgtataataatttattgtattagtcataacacattttcgaaataggaagtgatttcaaatcgaaatatggccaacaacaaaattgtagaggttatcaagatctacaacttttatttaggtcatttgtctatataactttgtttccaacagcttgaaattgattttgacaatatgacaaatgtaaacagcatttataaatattacatgactttaaatgggaaagccataaacagctaacttgtacagctaatcaagatctacaacttttattttggtcacttcttcatctgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggatcaactttgttgttgaccatatttccatttgaaatcatttagtatttacaaatgttgattatatttgtcatattgtcaaaatcaatttcaagctgttagaaacaaagttatatagataaatgaccgaaataaaagttgtagatcttgataacctctacaattttgttgttgaccatatttcgatttgaaatcatttactatccgaaagtgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcccgtcacagatgagtcatccgtgacgggcctgaatgtcatctcaatcggacattagtatggagcccgtcaccgatgagtcatctgtgacgggctctacgac

SEQ ID NO: 14411 - DNA, 5866 bp, Oryza sativa
gacgaccccccccccccgagcccgccgccgccgccaccgaggctttacaccgaccggaccggtgttggccttcctcgtcgtcgccgctcgcgtcctcaccgacccatgtcgccgacccccaccgagcatgacgccgcccgcccggtgccgacctgcccaatcggcgtctccaccgaccggcgccgccctccaccgagcccgggcgccgccgccaccgagccccaccggccatcctcaggtgagtcctccatcgcgccgccctctgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtggttcatttaactttatttatatgcaatgcggttcatgttgggatgaaatgtggtttatttatgttgggatgaaatgtggtttattcatgttgggatgaaatgtggtttattcatgttgggatgaaatgtggtttatttatgttgggatgaaatgtggtgcattaatgaaattattgtgaaatatggttaatagattgtaatagattgtagcactcaattgtgttttttttgtttttttggaaaaaagtagacaatgtctcagcaaggcgaaccaatgtcgacgacaactagtgggtcctcaagggcacgtactcctaggacagggaacaaaattcctaaggaacggttccgcataacaacggtggacgccgtagggttgccgacatctccaaggaaaatattgagccgatttatgtctatctgcggggtcatagggaggcagaaattcagtattctgcaagacgacttcaagctcgtgccggccgcagagaaggacattgcttggctaacgttcaaggagagctttgattatcctgcggagcatgaggaccgtctcaggcgggctgctttcaaggttatgggcactgcttggaagaacttcaagactaagctagtcagcgagttcgtctacaacccggcaaatccagatccaagagagaaatttccttggatcacggaacaggtctgggaggaattccatgcgaagaagtcgagccccgagtccagagctagaagcgaggcatatcgcttgctccagaccaggaaccagcatccgcaccggcttggtaccgccggatatgccggtaaggaagaggaatggcagcgtgaggatgaagaagcggaggaatcgtgcaccggcttggtaccgctcgtgtttggcgatatcccacaccctcgggctaggaactgggccagggctaggtaccagaaacatgatgatggcacgatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaaacgttgggcaacaaggaacaccgtggacggacacggggcgttgggtcttctgttctctggaaatatggatttccagactacgcgtggcagtacaagaagcggacttccaacaaggtggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaaacacagcagttgcgcatcaactgagttggtggaaaatccaacatcggtcgacatcgccgtcgaccacataacggtaaccgtgaacttactcaatacatgaaagatgtaacgaatccatatgatatataatattctaaaaaaattgattaatctatcgcaggaaccaacgagctgcacctcacagttagggtgatgccgaccttcactgttccagcagccgagggacttgcgtacaagccgaccccagagacaagagtgcatggagcgcaactcagggccgactgtgcaaaagttcaagtcgacttggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagactgtcacgccccgaactagtcccgagcggaactagcccgtgacgctccaaattaacctgttaatcgataccaatcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcacgacttgggaactaggccgaaaccctaaaactcatcgtagccggcttgctcctggaagaactcctcgtcagcgggatccgcttcatcttcttcagcaactaggggggattatttatatagagcaagggtgagtacgggagtactcagcaagccatgggaaataagtgtttaatgcaggcttcaaagaaaggctgttgtttttgcaattgattttatttgaactcttttctgaaacaactaagtgagtgcttctcaaacgacacggatgagatagtgcgtctcgtccggtcggagtatgtgcaatgtatcagtcttttgaattgatcaagattggcacccggccaacagctttcaaacggccacccgggcctggctgatcccattagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggtacactttacccacacgacattactaacccggatcatccagcccgtgcagaacggccacgactagagaccttaaggctttcatgacaaggcatttcgaaagccgacacaggttcaccatatgccaacgagagggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcatgtgttcggatgaaattccaaggaaacggtccttaagtgcaagagcgggaaaccgtacacccgatacgttccccggtccgcgattttggaaattcatttagttcgcaagcaccgactcaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccaccaatctgccttgcagacaggacaagcagattaagtgcgatcctatcaatgcataatatttttcaagcaacataattaagttcaaatataggctcaagatgttcaaaggtggcttgcctcgctcgagatcttgagtttgatcctcgaaatcctcgcactgcgggtcttcgagctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcacggcccgagagaaaggggcggctcggctgagcttaatgggccggccggcccaagaaggcggcccaaggcgcgcgcgcgggcggggaggggagagagaaagccggtgggccgggtccatcccgcgtggtcccgggtgggacccgcttgtcggcgactcggctcaccgtgagcgaggtgcacgcggggcatgctagggtttggggagggaggcgcggcgcatgcgcgcggttcgcggaggacacggtgcggcgggcccacgcgcagcctcacggctcgcggtggaccgcgcgcgcgagggggcggagggaagcagcggaccggggtctgcttgacccggtcgcggccgaggtggcgccgacgtggcgcctacgtggctgccacgcgggccggcgggaggtagacgatgacgccggccggaacggacggcggacgacggcggcgagcggcggaacgaaccatggcaatacaggcgaagacgagcacaccgggatgttgcacaggacgaggggagacgagccaatggctcggattcgccgggggacgctcgacggcggcggattgcggcggcggcaactggcggcgggaggagggggaaacggcgatgaggttacgatgggccgattcccggcggcgagagcatctacgcggctacgggaacccaccccttgcgccggattaggaggaatcgcatcgagggaggccggcgacgagaggcgctttcgagctcgggcggcgacggcggcgagcacacggcgagcgatggcagcagtcggggcggcgtcggctagctacggggaggctacacatgctactaccgaaaactaaggggaagagatggattgaggagggagaacggggagatgcactaccgtgcggacggggagcagtgacgacgggccgacggcacgggagcgatctctccggcctcgggccggggaagaggaaggagagggtgcgtccggagtccccttccgcgtcctaacgcgcaccgactccttcggcacacgtgacggcggcggtcggcgatcggcgagacaaaggggacggcaatggcgcgggcgaaaacccgggaagattgggaggggaaaaggaagggagggcgcctgggtttatagggtggcgatgtcggtttggaaaccgaccttgggcggtcaagggagggagctcgcgctcggcggtcgcggccaaagcggcgacagggggggaaggatgacgccggcgggagggaaaagggaaaaagggggagagaaagggggcttgcctccttgccactttggggaaaaggaggagggagagggggcgatgcggcagagggggggctcagcctccgtcccttggaagccagcgcgcggcggtggcggggctgggttgatgacgacggcgatgacggcggaccggtttggagtggagcggcgacacgggcggcagacgaggggcaggtgcggcaggagctgacggcggcggcgactggccggtcggccaccacggcgcgcgcgcatgcgggcggctcggcgatttgggcggcatcgacgggaatggcagcgagagcgggagggagggctcggcgcggctcacggcagagcagggagagagagagagagagagagagagagagccggggagggagggggagatgggccgagacatattcggcccatcgaacccgagggaggcaaaatagacttttgtggagggatttgatttggg

SEQ ID NO: 14412 - DNA, 12341 bp, Oryza sativa
gtttttaagagatagttttcccgctaggcaccacgacggaacgggcgctacagagacccgcctctgctccttcagcccctcctgctcaagatcgtcatgcacaatcttacgatgtgcagttgcagtacgacacggattttggggaggatcgaacggaggccgacagcaaggcgattcatgaacccccaccgatgaagaagagcaggaaagcacactcttcccctcagagaattactctcgataaacccgaagcaaaggggagaggaaggggaggaaaggtgcaggcctcgcttctagctccaagaaagctagatctaggcaaggaccaggaagagactaagggcaaagaggtcaagaagaaatatgtcgctccacaggagttccaactaggcatgccattggttggagatgacgtgcttgccgctatgggcaccgcttgcaaggaccttcacttatactacatggagaaatctaacgccaggaagccaagtaaagctaccgatatccttggacagcacgatggaaagccattccttggtccaataaattatatcgtggtcgacttcaaggatcttttcgacctctacaggctctgagcggtggacacaagcctccttaagtgctactccttgtaagtattgtcgcccaactcattctggtaataacaatcggtttaacttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattagaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtattgagaaaaggtgaagactttggctgagtttgaggtcagtggtctcaattgtgatagactaactacattttagtacttatatatgatcgatcaactaatctggaattatgacaatgtagggcacaataaccaagtctctgactaccagctttgaggaggttcgcgaggagataaccagcttcatcctccgcgaaataattaaccccaaaggaatgtttaggcttaaactaaaatgatgaacaatgttgaacttctatgtttaggcaatgatgaacacttattatgcaactgtgatgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcatcgggcatggctagcaaaggcctgaggctagccaaaaaacaaaatttattttttttgtggattatagtcatctgtgacggaccataactaaatgcccgattgagatgaggtcatctgtgacgggctctagcttaggcccgattgaggtcagcagtcatctgtgacgggctctagtttaggcccgattgaggtcagcagtcatctgtgacgggctctagtttaggtccgattgaggtcagcagtcatctgtgacgggctctagtttaggcccgattgaggtcatcagtcatctatgacaggctatagtttaggcccgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagttaactcttcacatcagtgacttctagcctgtgacggacgctgtgcccgattgagatggggcttaccgcccgattgagatgagggtatccgttctagtgagccaaaattgagtgatggtgaaaacaatgaacattaaacctataaatcagttttaaaattcagaattagctgcaacttgtaagcctcaggttaaacaagccctcaagttttataaacaatagatcagatgaggaagaaagctccgaagttaattattaagttaaagtagatcttagcatcacaaaaaattgaggcttttggaatacatgttaggaaaaacgtagagacatttaaaaaaaaacaagaattgaaatcatatccaagacgttgaactccttgtttatttttccatgaaatcgagctataggaacgtgcaatcctacaactttttttcctttcctttcccacgagctactgggatcagtaggaaaattctttcgaaagttgaatcctataaaaaaatttatgccaatcctctattcacttgaggctccgtggacagaagatatatactcccttcgattgcataggtaagggcatccacaatgtgcatttaaagtgggtagtaagcaataaaatactactactaacaggttgtatatattgtaagagtagtaagtaactaataccaggtaatatgcttactacctagtcataaggaataaacaaataatttctctcatctttctctcatggctagtgatggtggggtccagcttactacccacttttgttctttcaccattgtggctacaacaacagctaatacccactgatgcagggctcactcttatacacaaagtaggtagtaaacattggtgatgccctaagtcgtattaggagtttaggacttatacacctgtagatgcaagcatacagtacagaaacgacacagctggtgattctcagcctaatagctcgcttgcacgtgtgtcggtgcctgtacggagaggctgtgctgttccatcgtacgtacggaaacgtactgccggtgccagctcgactaggcccagtttgaagattattcactattactggtacattattatggccgattggcgattatctatctatctaattatgtggataaattaaattcttttttttagtaatggaatagaatccgcggcctttgcttaacgtgttacagccaattattataacaattcatccaaacacaaacatacctcaacaagtcataaagaacacgctttaataaacagaagcacacaccaactcctaaacaccaacacaagagcaagaccacattattattgaatcctatttttaacctccatccaaagttggcgagaaactgcatagctgttgactcaagattataacatgcagctttaagaaaatattttagaaaatggtaccaaacagttaagaaaaatggtttaaacaatacttcctgtgccctaataaaatcaaaccctagaatctcaagaaactattaaggaaagaaacaaaaaaccaaattacccttaattaatgtaaaatttgtattggttgatgagcaggcgaggggtattgaagtaataaaatttctcgatttgcatattagtggcaggtaagaaggtaggagttggtttattttgggacaaatcaaaccgtagaagttggtttattttgggacagagggagtatagtagaagatttttttagggatgctatataacgcgggatgataccagttaggtatcaagtccggtattgggtgatacctattaggtatcaagtgattctaccacgtttcaggtgatacttgcgaggtatcaggtgatacctatcagttatcatgcaattcttgccacatagaaggtgatacttgtgaggtatcaggtgatacctatcaggtattaggcgatacctatcaggtgatacttgcgatgtatcattaggtatcacgcgttacatacctgacatcgacgccgacgaccactgccggcccagcgccccttcctccctagtcccggccaccgccggcgatcccttctccgccggctccggcgccgcaccaccgccaccccctccttccccggatccggctccggccaccgtcgctgctcccttcactggctccggccaccgtcgccgctccctcccctgtctccggccaccggcgcgctccctccctcggctcgggccaccgccgccgttctctccctcggctccggcaaccaccaccgccctcttcctcgactctctggctccggccaccgccgccgccccatccccctactctctagctccagccactggcgcctcagctccggccactgccgtcgctctctccctcagctccggctaccaccaccgccccctcccccagctctctggcttcggccaccgccgccactctccccccgccaccggctcggccattgtgccacgtgctcttgcggctgatggaggtgaaggggaagctatcctgttggggcaacggtatcctgtccccttgcatttcagtttttttttaagaaaacgtacttttagaaatgtcgagtaaataaaccgtggtaataatctagtgaagtggtcgaaaacaacaccttaattagtagctagccggcaagctggcggtgctaattgaatatagcccatcacctcctctgtgtccccttgaccaacagcaccatgcatcatcatcaccttctctgtatttttcaactcaaacaagatcgagttgtaaaaccgcaaagtctggactattaatgttatattagggaggcaacaggaagaaattaatacacacagagagagagatcatgccatgtcttatctagggatcttgtgtttttcagatgtcaccatccaattgttatggacaaaagctttgatgggacaaatcaaaatggtgtcataaatcactttcaagagatcatcttgtacctcaaggttaactggctgataatatatagtagtatgaagaaatggtcatggagagagaggaggaagagttgttgttgttgcaaccttttcttgatctcctttattacctaagctaagctaggagttcttctagcttgcacatggcaagagattgttgcccttggccctacacaaaagattcaaccgccaacagatggtgatctctccttctgtcaccgatgcagacctggataaaataatgttggggatcagacgatctcggttagcccaaatgcctctccttgatgtgaagtgtcggcaaaatgcttttgcaagagtgtttgataacataaaacttttgcaagcaacagtgtgcaaaaaatgccagctaggtaaaagaaaacatagatttcaaacataaataattcctttaacgtaatatgtgtggatggcaggatgggattagttccaataggacagtaaagagcacatattggaaacacccgtaatttttttattaagcatgggattagttaccgggcaatattggagaatactatcgcaaagatttttaagttggaaaataccattgcatatgttaatgacacgtgggtccaacttatacatctttgcgatggtacttttaaatttttttaccacctgaagagggaataaacaaactagaggcaaaagtcagaatagaccagccatcggttggcaccacatctctctctctctaagggcctgttcactttgatgccaaaaaaaaccttaccaaattttggcattgccaaaatttcgacaagttgccaaaattttgacaactataccaaaattttagcaggatttcttattaagttaccaaaatttgatagcaaactaaatgtagccacttttttagcaactttaccaaaatttgataaggttgaaaatggcatcaaagtgaacaggccctaaattccttcggaatgcttcaaggatgactagtgtgaattgtgaaagcttcttaatccatgcttgcatgtcataagctcatagctagtaatctaaatgttgttatatataaatacaatttttaactcaccgaaattgtcagtgaccttttttttccatttgacaccactgggatggccccaagttttgctttgttatttataggcttgaggagatttgaggcaagctgccctcagctcttgcaacctttccttccttctattctatggctatggccctatttatgtttggctgctcctgaatctcctcctattgcccttctgtctcacatccctgtctcataattaaagtcataattaaggagcttctctaaggtgattgggacttgttgcagggatcaggaggaaaacaacaaggtagagctctctgttcttgattcttgttgtcttttgtttttctgttcatatgttgtgcagattataacattctatatgttgagggggaaaaaagaagggaaagagatgattggtgcattttgggaacaggtttggtgctttcatgaagaaacaagaaattggatgtgtgaatgtgttcttgcttagtttttttatgctctctttcccttgattttcttcagttcttgcatgattgcatcttgttatgttgctcatttgtcctatcatgggatgttttcttgaacaaatatatactatcaagaaagaatgaaaaggtgttcttcaaaaaaaaaatgaatgaacaaggaacatgaaatttgttctgaaaatgtcaaattctttccctggaacttacatttgatgcccattaaaaattagctttgatctgcacaggataacttaaattttggattaacaacaagaggaagtggatcaaccagacaagaggaaaacgtgcaaacaagacaggcttgcaacatcaccttgagtccaaagccaagaaagatggggctgtcaatctcatacccaccagacgactacctgccagcaatggaggacaacatgggcaggctgttcatccggtccctcagcttcgacgacgacatggaggccgccgccgatgactcgccgtcgacatcaccgatgccatcaccgtcggcgacattgctgccggcattcggctccggggggaagctgatcatagagggctccctgagcttcaagagaagagaggctgacccggttcagatggagaccatgatatccatcaggagtcccaagtctgacaaggagagctgcagcagcaagccaaatgctactgctggtgcatcgagatttgcgcttgccggagaccagacaccggaggattctccggtgatcgccggagttgccagccccaagcaccaggcagcggctgtcaggctgcagaaggtgtacaagagcttcaggacaagaaggcagctcgcagattgcgccgttcttgtcgagcagagctggtatgattctcatgcaaaatgcaaatatttgtgcatttttgtcgtagaatattactagcggagatcaccgtaaaagtattctttgtcttttgggtcatagtgtttgaattgtttgatgcttgaattcaggtggaaattgctcgatttcgcactgctcaagcggaattcggtgtcgttcttcgacattgagaagcccgaaacggccatctcgagatggtctcgggcaagaatgagggctgccaaggtagagttcattggcatcatcccttatccaccaccctatgtctcactgacatgtgggcctataaccctggacccacctcgtcggtgagacgaggtgggggatttgcaaaatcagtggcataggagggattaatctctgaactttttaacagagccaccattgttctttcagtaagcatggaatttatactgcattactgacataggtgtagtgttgctatcaccttaggttggcaaaggtctgtccaaagatgagaaggcccagaaacttgctctacagcattggcttgaggcggtacatgcttcaaacattgatctcaacagtattttcatgattgaaatgtgcaatgaaaactgagatttcatctcatgtctgattatcagatcgatcctcgacatcggtatgggcacaatctgcactactactaccaccgttggctccattgtgagatcaaccagccattcttctactggtgcgaatgcgcgaatctccgaagaccgtttcacatctccgaacccagttgacagacaaggcttactgacaaatatgtgattctgaaacacaggttggatgttggtgaagggaaagatgtcaacttggaagagcattgccctagatggaagctgcataagcaatgcatcaagtaccttggccctgtaagttccatcactattcttctgatctgaaaatctgaaccaaccatttagaaactgctcagttgtagaaattgcatctgattaacagcatatgtttgttcttgttctgggattgtagaaagagagggaatcctatgaagtgatcgtcgaggattcgaggctgatatacaaactgagccgtcagatcgtcaacacgaccaaaagccgaaagggctcaaaatggatctttgtgctgagcacatgcaagactctgtatattggtcaggtagatgactactctgcatccatggcacttcttcattggcaaattgctgctacatcttttcatcttgcaaacattctgggaactgatgagatgctggtttttcaacacgattacagaaacagaagggcacattccagcactccagcttccttgcagggggagctacatcagctgcagggagactgattgtagaggatggaattttgaaggtatgttggggatgtgtcgatttctacgagcaacactggatttgctctctctgactcttgaaatttgtttgtttcaggcagtctggcctcacagtgggcattaccggccaacagagcagaactttcaggagttcatgaatttcctgaaggagagaaatgtggatctgactgatgttatggtgagaaccgaagtgtgaataatatcacaattcatctgcaggaaattatagatactgaatagagttttcctttgaactgattggtgtgccgtgtttcggttttgctacagttgaacccttcggaaggtgaagatgatgccgaattcagcctcaagagcagccattctaggcaggacttgaccgaactctgtgaacctgacatgcaagaacatgaggaacaagtcacacaacaccatggcgctgacgaaaccaagaccagcagtgatgcacccaccatgacatccaccgaaaccatggcgagcacaccggcaatcaggaaatccacctcagccaacaagctgcaagggaagcggcctccgaggctgctgatcagttccaacaacacagaactacccgcaacacattgcaacggaaggccatcaccggttcacaaggacatcgacgaggattccaccatgttcggagagtgcctcgccttctgcaagaagaacctgtttgcagaggaaggcaatgaagaagatgagctggtggaagtaccagaggagatgatcatgaaccgtatcaactgcaagaaggccacgaagtcataccagctggggaagcaactgtccttccaatggagcactggagcaggtcctcggatcgggtgcgttcgcgactacccatcggagctccagttccgagcattggaggaggtcagcctgtcaccccggggaactaggtcgacgaggttttcgtcgccgaggcgaaagcccttgacaccaaatagcattccagttgcaagatttggttgtagccctacagcccaaggtgacaacatggggctgaagccaaggcagaggtgtgctacttggactgctttctaatgttgatatggcatgcaaattgcaaaggcaatgctgcttttcttctccttaactggaggacgatgcaaagtgtatagtgagtgagggaaacatgagaatgtcattctttggttttgtagatgtgtagagcaaacacaccatggcttccaaggaacaagcaataagatgtaccttccgaagaagtaataacaagtaataagatgtatttttagatatgacacatttgacactcgcaaggtgcaagcaaaaatagagattacaggttttcagggaggaaaagaaacagatgccagaatttgtaccacaaaagatgatcaagctaaggaatttgatgtctccaatcaataatctgtagtatgagcaagcatttgatgtgtcatgcaggttcatcacatgcacatgcatttatcgatcactttacaaacctaaagcaacaaagccagagagcgacgtagaagggaatcaggcaatcacaaactcaaacaaataaggacatttaccaagcagatttgtgctgatttgtaacattgacagccatgtcacactcgtagtaaattgaagatagcattcatctaatcagttcatgttgcccaaagccagtagagcataaccatgtctcacaacaatggaactttagttataggcaacagaccaaaactgcaaccagacaagtacccattacatttccattgctcttaactcataacatataaggcctactcagaaagacaaaccattgttcaagaactggaccggaaaagcagtacacgaaataaggcgacaatatggcattttactttcaaaaggcaggaaccacgaaataacacaaccgccacagcttcagcgcagcctcctggcctccctctcagactcgagcagggtgaggatgtcgccctcacggaccgggcccttgacgttcctcatgatgagacggttctggtcgtcgaggaacttcactctgacctgggtcacctgacccctggagccggtgcggcccatcaccttcaccacgacggcaagtttgacctgggtatccatgctgcacaagcaggaagcatatacagtcaggcaaaactgatgttctatacaaaccagcagcaggtaattcaatcgcagtcatttcaatattacagttcgtgaatttatgtatcagatcagatttcaatattgctttcaaaggataaaaatgttcaggcagtttatctacaactcaaaattacagtaacaaatgttaacatctggaattcaaacaaaaacagttcctaaatatcagctattgttaatttcagtcacagcaactacttaccccaaataatcacggtcatagtcatactactctacccaagcaaaagataatttaagaatcgatgcaaatatttcagtcacaacggatcagaaatttcatgaagacgtatatatctattaacgattcactcatcctagaaacaaatccgacgaatcgattaacaaaacaataaaccgaaccacgaccacaagaccaatccatctatctaccggctttgctacccaacgcggatggatcatcgcgacgccgctgacgcaacgatctagcatgccgttacccccgcacagcgcggcgacgcggatggatcatcgcgacgccgctgacgcaacgatctagcatgccgttacccccgcacagcgccgccgcgcgcgtcccaaggatcacggtgaatacatcgcgaaggaagcaaagagggaaggggggaggaagcacgacgacgcaccttctcttctccggctgctagcgacggcggacggcgaaggagggcacggatgcggcggcggcgacggcgcgaggaggaaggagtggaggcgagggtgaaaaccctagggttcgtctcgggtggtttatatagagggagctgagctgagtgggttggtggcctgttaggccgggccaggccggctgactcggcccatcagataagctacttttctttagtttcattttctttttacctatcgatctttcgataaatttatagtttcaaatcttgcgaaaatttcaaagaatggatataacaaattataagtaaaataaaaaagaaaagagacaaacatgtctaaaatcgtaaatctagaaaaaaaacatgtttctaaaattttttttgatgcactgtaactaagtgtaagtgcaaaacaactgaatgtaaggcggagtttctttgcatgagttccctactcactcttctcgtttttatgggcacgcttttcaaactactaaacagtctattttttgcaaaaaattttccatacg

SEQ ID NO: 14413 - DNA, 1263 bp, Oryza sativa
tagggttcgtctcgggtggtttatatagagggagctgagctgagtgggttggtggcctgttaggccgggccaggccggctgactcggcccatcagataagctacttttctttagtttcattttctttttacctatcgatctttcgataaatttatagtttcaaatcttgcgaaaatttcaaagaatggatataacaaattataagtaaaataaaaaagaaaagagacaaacatgtctaaaatcgtaaatctagaaaaaaaacatgtttctaaaattttttttgatgcactgtaactaagtgtaagtgcaaaacaactgaatgtaaggcggagtttctttgcatgagttccctactcactcttctcgtttttatgggcacgcttttcaaactactaaacagtctattttttgcaaaaaattttccatacgaaagttgcttaaaaatcattttgatccatttttcaaaaagaattagctaatatttaattaagagtaaattgcatcgtcggtacacgaacatgtcagatgggtgcaatctagtgcacgaacttgtaaaatgctcgttttggtgcatgaacttgtttaatgcatgcggatgaaggcgaaaaggacattatatggctaatcttattgattcatggactaattaggatactatgtaaacatatatctgagaagattgctattagacatacacctctccaataaaaaatagaatatgacatagtgatagtagaaaaaagatgaaaaaaaaacgagcaatgatattttggtcctcgttcgcacgaactaggcaagttcgtatactaaaacgggcattttacaagtttatatactaaattgtaccattctaacaagtttgtgtaccagcaatgcaatttactctttaattaatcatgctctaatggatcgctccattttccgtgcaagagggatttgatcccaacaagaagtagcgaaagtgtaagttggatatacagcaacatgaatcttgatgcaagatcctacaaagtaaaaataaaatctgtcacaagtaaaatagcaaaacctttgaaaaaggggagtacctattgatctttggataaattggagcttcaaatcttacagaacttttaatcaatggatataacccattttgaatgaaaaatgacaaaaatgtaaaaaaaaaccgtatatctagagataaaaaaaaacacttgtaaaatctaattttagtaaattgtaactaagtacaaattctctatagccaagtataagtgctct

SEQ ID NO: 14414 - DNA, 18647 bp, Oryza sativa
  unsure (1)..(18647): unsure at all n locations
atgatattttggtcctcgttcgcacgaactaggcaagttcgtatactaaaacgggcattttacaagtttatatactaaattgtaccattctaacaagtttgtgtaccagcaatgcaatttactctttaattaatcatgctctaatggatcgctccattttccgtgcaagagggatttgatcccaacaagaagtagcgaaagtgtaagttggatatacagcaacatgaatcttgatgcaagatcctacaaagtaaaaataaaatctgtcacaagtaaaatagcaaaacctttgaaaaaggggagtacctattgatctttggataaattggagcttcaaatcttacagaacttttaatcaatggatataacccattttgaatgaaaaatgacaaaaatgtaaaaaaaaaccgtatatctagagataaaaaaaaacacttgtaaaatctaattttagtaaattgtaactaagtacaaattctctatagccaagtataagtgctctgtaatcgagggtaactataaattggatatacatgagcatgaatctggatgcaagatcttactgacgaaaaatcgaaagacgggaaccaaaaatctatcacaagtgaaatagcaaaaccgtttgaaaaaatcattaagtgatggaaaacctgcagtctaaatgtctgaattctggttagcattggatgaacaccacatttctatttgataacttctcgatttagcatgatcactgtttggatgggtttagataggttagtttgggtttgcagtcgaaaatgttttagggttaatcctctgtcctgattccgactcagtttcaactccaagcttttgatggtctaaatcaacggtaaacatttcatttttcttaaaaaaaaattctattggatttgatagtaaaatcgtcgatgctaaagaggcttcaaccatgttaacccacgctaattattaatatattggtgttgcagatttaaattctaaaccccaactcttagcttccttgaagcgagcatgtcacacaatatacaagtctgctagtctgaaatcatccgtagtattcatcattagtgtcatattgttgaagagatctgacacaatggaatacacagcgcagtgagttcttgcatgtcccaactacccatcactagctagatatcacaaatttgaagttgaaaaaacaaaaaccaaaatgcagcacccaatcttccttctgacctttaggggctaactggacttaacatgctatacagacaagaaatcaatcggctgtgagcagaggaggtcatgagctgcgatgctgggcattggagatttgcagactcagcgccatgccaccagagggaagcccagttgtaattcagggctgtttttgtgactcaaggttcggattcacataatcaattcaccgtcctggagatgaattatcctgtaaataacaagtgaagtgaacacacataaggaccaacttcagggcatagcagtagacaacgaaggagtgtgttttgtgtttttaccatgtcaatatcttcggatccatgtaggcagtcagctgtttcggcatttgcatttgctggctctggagacggcaaagcagaatgctgcattcatgtggagaaatcacttaagactatgaaaatgggagaatagtagcattgccagaaaatcgatataatcatatgtatacttgccataagggatgactggctttgtacttgttttctgcctgggtcaatttccgactgaccttctatgttcggagtagttgctgttgatgatatacaaactcagtgatcgagaagatttatgttcacaaacagaaacctcaaaaatgagaggttaatggaagatgtgacaatggtacagtggtatatatttgactaaagaaataaccatgttattgttatctccaaggataatgcacaaagtaatcgagtaactaactatgtaattgaaaaaaaaaatagtaaacattgaaggaacagagttcagaaattctggaaggaaatataaaattaacagacatgccagaacaggttattaatatcttatattcttacgacaatggagccaccaaggaacttgtaagaaatattaaaaagctctctaagaaatgatagtacctgcttcatcaaaaacaggtatcacggtatgctcattagctggttcacactgactacctggaatgctgtttgcacatgataaattaatagcattaagactgtaattcatataactttcttgatgagaattgaaagtattgaatggagcatcacctttctagtttttctctattcacatcttctgttacatcctgactattagaaacaggtgagcttctttttattacctggtatacagatagtttagagagatacttggttttaaataaaagaagccaaacaaattatatattaggaagaacaatcctgcaagcaggacttgtaccaagaaatgcacacaggagataatgcaaatatgcaattgaagctttcaatatttgcatctcatatggtctcacctcatgcccaatactgtcaaatatgtcttgaaatttatgtaaagcaatctccatgttgtgaagctccataagcattgcctaaataaagaaaaacagtaaatatcaacttagatttttggagtttcagagaaattggaaaggcgttatgctataactgaataacctgcttctctgaagtcagtctctcaataatctcatccttcaccaataaagatttcctaaggtaacatcgttaaggagacgcaaccaaccaaatgagatcaatagaaactaagattgactgcaatgacttttaactcagtagaaatggatatttcttctagtttgggctgaaatttggtgttgagtttctcagcctcaaggcgttccctcaattcatatatcaacctcgccctattccggagttcaagctggtaatcattaattttttcttcgaaaaacctaagtttttctgcataagtgaaaaatcacatttagaacagcagattttaatgaaaaatcacatttagaacagcagattttaatgaaaaatcacatttagaacagcagatcttaaaaaggatatcaacttatatatggtcatcattatcaacatatggaaattgcaatctgactacaagaagcaacataccaacaaaatctttctcaagcacagaaatcttctctactttacccttcaagtcagaaactgaaattgcaacataacacagataagtatctaaagaatgcacattagtgcaataaaaaataaaaagacaatcatttggtaaaacaatagtagaataagatgtttcagccatttgcatacctacattttccttgtcgccaactagacatttcacattaccgagtacttgtttcaccgcagcgacttcctttcctactgaactaaataaagccagatgagcattcagcttttctgaaatcacagcaatctgtttatccttcatctggatagtccattgcagagaacaagcagagtcctgcctatcaaacatggtatcatgagccgataatcagtttgattccacatacaggtaattcataattaatgcaaatgtcagaagcaagaacagggcagaattatatgacagattagacaatgtacaataaagcagactccagatacactctagtcttacaaatgcatagcaattgttaaggaaaaactatgatattaatggcaagtagcctcacataaatatgcaattattacaaagaccaaaagtttagcatggagagaaaacataaaaaatgagttcagctccatataaactactacagaaggaagggggaaaataaaggtaaacacctgcctcgtaatgttttatgaaagcctcctttgattgaagcagtccctccatgttatcttttaactccttttcgtttttctccagctgctcattttcattttcaaggcattttatctgtaaaaaaaggtattgcaatgaacctctgttgaataggtacaaaccaagcactaggggaagaatgaagcatccacggtgtgatgtgacataacatgcatatcaaaaatcaagtgctgcttctacctaatcaaccaagcaccaggactagtcattgttacgattcggtagtaaaagtacaaatctacactatgatagacaactggcccaaacagccccaaatgttggtataatcgccacgaaacacaacatggcaaacaccagcatgatcacaatgtgtttaagttagggactgtaatttagttaggcattaaactgtaacataatccaacacatgagctctacccaaatccatgagacgagaacacaagctacttggcgaaattgagagttgtgaaggggctaagcagaacgaaccctggactcgagccgacggagcgcgtcgtccctcgccgccacctccgcacgcagctcccgcgtctcccgacggtgcccctcctccgcctccttccatctctgctcaaattccacaccaaaacccccaccacgcatcagcaaattcgacccaaaaccctaatccccagcaaacagagaatccaatcacagtccgtagagtaagagagagagagacttggctggcggcgtggagctcctcgcgcgccgcacgctcccgctcctgcgaaaccgtaaaatggaagaggaatcagcactacgagaggaagaggaagatccgacaaggcattggatgatcggcaagcaaagctcacgcggaggagccggtgctcggagacgagcgagagaagctgcagctgcagctgcggcagcgccgccgcctccgcctccgccgccatcgccgccgcgccggtgagctcccgcttcctcttcctctccactcgacgagccaaaaaaaaaaaaaactcccacggggccatatactgggccttgccagcccaaacccttccggcccaaaaggcccatccgcggaagccgaatctccatcgaacgaactcgaccgtcgattcagatccgacggctgagatcccacccaaaccctagcccccactccgccgcctcccttataaatagctcctctctccctcctcccccaaaacctctgccctaatccaccctcgccgccgccgccgccgcaagtagccacccgcgccgccgccgccgccgtcgccggagaaggagaggagcagccatgggtcgcgtgcggaccaagacggtgaagaagacctcgaggcaggtgatcgagaagtactactcgcggatgacgctcgacttccacaccaacaagaaggtgctcgaggaggtgtccatcctgccgtcgaagcggctgcgcaacaaggtggccgggttcaccacccacctgatgcgccgcatccagcgcgggcccgtgcggggcatctcgctgaagctgcaggaggaggagcgcgagcgccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtctagatcgtcgtcgcctcttcgccgccgtcgtcgccatggctcgcctagctctgcgtactactgagttctatgttttgtctttagatctatggttgctttcaagattttgaacttagccgtgatgatgatgctttaagttaccatgtgttttggtggacatgattatctttttctatcgcactggtgaaatcttgagtgattcgatatattaccatgaaattcccatatgctccttgtgttgtaattgcttgttcatgtgttcttcaaattgatgtcttggtatgagttatataccttgctctgtatatcgcgtagaaaatgtttgattggtttgttaaagttgttgataattagtgttactatagactatataacccaatgaaccttaacataggatttcgtttcattgagtgtaacatatgggagagcttagagttggttttattgtctgtggaatagggtagaattctattaactcaatgaaccttaatataggagaattggtttcattgttgtctctagaatagggtagaaattggtgaacaattatgcaggttgtgattctttgatcatttgagttggtacagtgctatccatctatgactgcaattgccttgcgaaattctatactctgatgttcttgattttcctgatctaaaatgcttttggatttggagtagctaggtctccttagtttgcacctatcatacttatattttccttctttggaggaactaaactgtcatatctgttgaattctcgtgccaaaatctgtagaattctaagagcatttttgttctgaattgctggtctttggtatggtagggtctgtttggttccattgcccagctagcctagctgggtaagggcaagccaactcgttgccagcttgccaggcttgccatataccctttgtttggttggtgtgctttctatggcaagaattagtggctagccgtttggttgcttcaacgaatcatctttctctttagagtattttgtgccgcttcttttcatattgagcaaaataatattgcacacagatcaaatttttttaacttatggctttgtcacaagaacactatagattcttccacagttaacttggccacaagaataatacggatagaagtagtaaaaagggcaaagctatatgctaaaagaattccttgaaacaatcaaacatctttttgaactactttattacaagttcgaactaaagcatatcaattatttaaataatatctaaagtgcatgtttcattcttaaactatttagcttgaatgcatagtaattattcaaacatctcagcaaagaaattacatagcagctggatagttttgtattatccattgggtcacatattccttaatagaatccagtggcttacccttcaacatggcagctatattctcatgggtcgcgagataagtctgcagctcaagtcgaaccatgacagggtattccgtcatctcatcaattatcttgaatagggattcatttggatgtgttatatgtgtgaaacacatggtttcagacatattatctgtagcccctgttatctcataaaccacattatcatcagttctaactcttttacctttatcagattttctaccttttgcacgcctagaagatgagctacttccagtattgttctcttgatctggaagacaatctgagtcataatttgatgaagggtcaacatcaccaggactgccatttttatcaccaataaaatcatcatcttcagtcattggatggtcatatggtgtttgcagaacattaaattcccctgttgcatgcttgtcttgaaaaataaactccatttcatcataccaacgtatggggacgttaatgaatttagcccttttatctttggcctacacatgacaagaaaaatgtcagaaaaatagacatccatattatatgtaaacacgatagttatttgcaaggaaagaatagttagaacactcacattagtcattcgaacaacttcaatctcatcatataggattttttttctcaacatcatcaaagttggccccgctcaaattctttgcctccataatcaccttccactgagccttcaacttgtgataaacttgtcgacttgtgaagtttgtgtgatacttgccattaatttgctttgcacattcctcatgatggacttctttaaatacaagttgtcttccatcatgcttggtgccgacggccagaaagttcctagctactactgcccataccatcgacaatccccattaatgcaaaatcagaatccagcaccaaaggcccaaagcaagattactggatgtggaaatagtacatgaagcaacatagacagctcgtatacatccatccatggcaggaagatggagagctttaatataaagaaaaaaagtcctcgtacctgcaaatctagatagacgaggcgccatcggcggaagaaatcaaatctgggagcttctcagttctcaccacgagcaatcttgtgtccagtagcaatcttctgcaagaacatgctctcctcaaatcgagttggccttgctctccgatttactgcgtggaggccggaggctctactgcatttatatatgggcacgggattactgcagatgaatcgaggatgcttgaaagttcggcaaggggaggagggtgattgcaaattgaccggatctgtgagccctatagttcagccaagagtgggggaagagagcgacgagatctgcaagcccgattctttggcgaagagtggaggagtaggacgaaattggggggctggttgttgaagaaggtaacaacttttgagaaaaatcgcttcatccttatcaacaacttttttcacgcgaggagcttgccgtcggaggcgagccgattcggctctcccttgtgagctatccttttctcgctcctatgggctagctcgcccccatgggctaggatttttttctgattccaaacgactgtccttgccaggccaggctaggcccctgctagccttggatccaaacgcacccttgataaccagaggggaaaaaaggggagcataccttgtaaaccactccatacccacccctgccaagctcttgttcctttgagaagtcacatgtaatggttttcaagaattccattggcagatacattggcgtcgcagttggatcttgtatgttgttctccagtataccaaaatccacatgtttttgcaccagggaatcatgtttactagttgatccttccattcctgattacataaaaggaacccttagagataacaagaaaaatcctcaaaaccccatacaccaaattaaacacaagttgcttgggtatcctgtgtgggttcggccggttttccttcaattagccgtgtaactgtaaggtatttatgctcggtttctctcttctcaatgaaaaacaagaactcactaccactaccctttcggaggtttgcttcggaaaataataataataataataaagaactgctttcacaatgcaaacggggaactgacagtgagccctgcaagagaagcagatcaagtcggcttttccacaaacaccttgcatgcacgatgcacatttgataccgtcgtaatcccaaggaattgattcatccattgtctaaaacgtcatttagaccggaggtagcaatgtgttccctgctcctaagaactaatcgtgcatgcaaagaaagagagagagagaggactcacaggatgatccgatgaacaacaaaaaagaaaatgaaaaaagaaaggcaagagagctgcaggaggaggtagtcagatggtagctcgcacgcagaaagaaacatcgacgaactaaccggcgcgagttcgctgacggccggcgcttggtatatataaagccatcgatcggctagctcaggaacctactgtcaattatctactctctcgcgtatcaaaatataagaacctatgttatgtgtgatgtagtactgttaatttggacggagatatttgaagtattaggatatgtcctatccaggactacgttctcataatttaggtgctgtgccccaacacacaattactcacacgctatatgatatactacctgtcctaaattataagaacatatgatcggcatagctagattcgtaatactatgaaatttgctccatccgataataagttcaactagaaaataggcgtgccagttgacacgccgattaataaagcctgtggtggtattgttggtcctagtcgagatacatatgatcatttttattttttatttttggagattcgaagactctgtacaaacggaagcaaagagaccaataaaaaagaaaatattagaatgaaaaaaattcacctcgagaacacatattgatagtacccacatggatagttagacatattccacaaagtcaagttagaaagtcaagttagagggagtagtgtaagataagtcaattggtcacatggatagaccaatgtacgtgaaattcatatacttaagagctagggagatcaaatgtacggggttatctaaaaaatagttttatttttattgattaattctaaaagatatatgaaatggaatatttgtgatattcctatttgaaaaaataatatggaaatgtataattctcaacaatatatatgttataaagtggcaacaaatcctaagtggtttctacagttggatcactcttccaaataaaaacagcttagggtctataagtaaatacctctatatgcaaattttaagtggatcagcatatgtgggagtacatccttttgatcacatctaatcgaactgttctagatgttgtatcgttaagttactactttttatttaaaaaactgttaaggtactacatgcttctagaattatcatataacacttttgttctctatttttcttgatcttctgcattttttttccttagacgaaatccatgatttatttgataagccaggggcgccatggggaatcgtataatattatggtatgtttgagagaaggggaaaataaaaagatcttaaaagatatgaaaagatactaaaataaggtgagtcattacaacatgattaattaagtactatttttttaaattttagaaaatagattaatatgaatttttaagcaactttcttttagagtttttttttattgtttagcacttcaaaaaacgtacatatgagcggagaacaagcatctatagcatgaaattattttagaatactcggtccataattgtccactcatgccgaacagaagcctgtccataattaatttatataaagacataacagcatctatagcatgaaattaattttattaaatttatcatagaatactcggtatattttaaaatgcacttatttgattttacattttctataaacttattagggtgtgttctttgtcacctcttcccaacttctactctctatttttcatggtacactttccaaaatgctaaatgatgtgttttttcaaaaaaaaaagaaagttgtttataaatatcatattaatctattttttaagtttattttagctaaagcttaattaatcatactctaggatcatgccttagagtatattgtgacaaaagtacccatacactaatctagctacgaatttaagattgtgtcatgaaactacacaattaatatcaaatttatcataaaagtatataccacaaaattagtcatgcggttatcaaacaactacattaaaagcttcaagaaaatattcatcccattttaatgaaagggagacagtgaatcatatttttttcaatgttagaaagctgtagtttttgataaaagatgtaaatatatcgaaaattagtagttttaggatacattgagcaaaacatacatagcctagcgcgatttacttaacttattacagacattatatttatgcatatatgtttgataacttgtgtcctattaaaaatttagtgtagataataagtcatttttcaagtgataaaacaatcaagtcgtgacaaaagtaaataatatttacgtcaaattttgaaacaagataattataaaaatgcaatagatatgtttaaaaactactacctccatatttcaatgtatgacgccattaactttttgtctaacatttgaccattcgtcttatttaaaaagttatgtaattattatttattttattatgacttgattcgttatcaaatgttctttaagcatgacataaatatttttatatttgcacaaaaattttgaataaaacgaatggtcaaatattggttgaaaaatcaacggcgtcatacattcaaatacggagggagtagtagcgttattatattatttgaagacggagagagcatagcaaattaagaaaataccgtcgctagcttctcggcgtgaagtacggtgtctctgggtgacggggttttaattgctgcggcagcgaaggctcaaacaaagaacaaaaactacttgaagttgtagtggtagaacgaggctgaagttgccacgtaggagtacagaaagtcaggagtggggcccaccggaataatctgtctcgtcactagaatgttgtttggagaaaaataactgaggaagatagcactagtatttacttagcttatcttaaatatgttaaatgttacttccctaactctaattataagacctgtatttttttacacggtcttcaataacgaccactattttattttattctataatcctaacaaatatgaaattagcatcacatgaaaatactttaaaatataaatataatgatataacatgcataacacttagtatatatatatagttagtatgattattagtcaaaaaatatcgagtttgatttttcttaaaaatagggcgccctataatttaggacgtactaagtattaccagtagtattattacttctgtttgattatgtcgttgatctcttttcacatgtttgacaattcatcatatttaaaaacttttttataattataatttattttcttataagttattttataatttaaagtattttaagaataaaacaaattgtcaaacatgtgtttaaaagtcaacggcatcatctattaaaaacggatggttatatatatatgttaatgattggaggtcgtatttggtttggtatatgattccttagaataaatacacacggaagtcatggctacctaataatctggtacgagctgagtaatagtacaaagttatatatcatatggtagtttaggttatccggtagttatacaaactaacatgatactaaatttaatgaaattaagaatgtgttggtttccaattttttttagcgtgtgtaaggagcaggtgtatgtgtatggtattatatatatacagtggtgtatgtatgttttttttaatgaatcagcgagccgttaattttatttaatatagaaggagtaaactgtaaaaataaaaagctgtatatacacaggaccttaggtccagcctagctaaaaattaaaaattaagccaatcgctgagactcagtgtatgtatgtttaatgtacggctagtaagaaatagaaaagctggtacatatttatacatactatagtgtcagtatggaatgaaccatttgagatgtcaaatcgtctcatatggttatacggaattttagaaaaacaccgtttaacgcacaagcatccgtccagctcggtcctgttccggcggtccggcaggattcaaccgattcttttgccaaaagagagtatataatctgtaacttgtattgtatttggatcacaatctgcattcataatatcgttgtaattagtctctaatttgtgttgtgaacattttctcgattgttgctgggtgaacccattttttccgaaggaagatcgccggctgattttattaacgaaaaacaaatggatagcactccactgcttcaattttaggtggagctaaaattgtttgactgggctcgagctgcaaccatgcaaaacataccctacaacaactatagcaactactttctgtcttaaataagtttatttttttacctattccacacatattaataaaaaatagaaaaatagaatacatccactttatccaataccaatatagttattcctcagtttatatattgctaatacatttactcctattttcataaactcagatatataattattgaaaattgaatttaatttgagataaatgggaggaaaaaaatgaatttattttaaacggaaggagtaaaaatgaaaatatgggataccaaaaaagaaatacaaggagtaacttagtatttatgatagtataaataattttaaactaattaaagatgcacgaattatactcgtggatatcataatttgaaaactagtgatgaagccgtgtatctactgctccacaccgcacattgatggtgcttcctcgtaaacttcgacacgaatattagggaatgacgtaatatcaaataattagaaagagtggggctttaaacccaggtcatctagtccaccacattgtgaagctagctggaaaatccctaggagtttctcggttcctcgtaaacttagtactgaataccgaagttaataagaaagaactgattatgtttctttctagaactagaatgttaaagctgaagcgaaatgagcgtagttcaactggttagattttatatggtggaacaaattcatctaggtttaagttctagatttgatacgggtgttcacatttatagttaattattctttcagtgatatgcagtatacctatcgacagcgagatgtccgtgtgagcgtgtcaagggagcaacgcgaatcgagcaccatgatggttgttcttgccatctgtgtttatctttgttatgggttagcaattagaactactcacttcgtcccaaaatataaaaccctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacagagtgagtatttgtttgggatgcttagggtcatgatccatgagttggacaattagggcttgtttggcacagctccagatccacctcttctggaactggagctcagcctaacagttttagcttcacctaaaatgggagcagagctgggtagagctctctcacaaaatgaactagagaggtagagctgggtttaggcaactccacaactccattccagacccaactcctggagctaaatttaggagttggggctctacccaaacaggccctaaacaggagttggagctatcattttctcactcttatgggctagctcgcccccatgggctaggatttttttctgattccaaacgactgtccttgccaggccaggctaggcccctgctagccttggatccaaacgcacccgtagttcacaatttgttttagaattatcataggtagttaacaatttccttgatcttctatttgtagtgggaatcgttgtgcttcggtaatgttgcttcacattgtatttgtacgtttatgagtttaattctttgatctgggcgtgtttgatctttataactattctacatttgatagacacaggacgatcttatgaagtactcgtaattcttcctccactattcagtgcgagtgttttgtacaacttatgttcaagtgctagtgttagaacttgtgataattgagtttgccaggctaggataattcgatacattgcgttgtagaatattgtcaatattcaggattgatgaaggcaaaccaggctcctacatttgccgaatctcccgggtcggaatcaaacctagcttatgcaatatccgaatcacctgtagaatggcaactcataaggctgaaaagttgccctctttaatttctcttgtcttaactgaattggatttctcaaaaattggtacaattacttcttgagttatgaaaaagttgattgggtcatgtagaagaagtaaatactagctacgaacctgaacaagcattgttgacttttttttattgggacagaggaggtaagtttcaaaccctaaattttgatcaatagattaaaaatcaaaccaatttcttggattatgaatgtctactcccttcaatcctaaccataaatcttaatatgaatgtgtccaaatccgtcgctagtattggatcctataaaaagtctaatcctaattactatatcttataaaaagtctaatcctaactactaacctctatacgtatatgtccagattcgtagttaggattgagttttctattgaacggatggtgtaagttttaaaccctaaatttaggattgagttttctattgaacggatggtgtaagttttaaaccctaaattttgatcaacgattggtttgatttttttctcccacctgcagaaaagtgaagcataggatcgaatagatcgaataggtagtttttgtaagaaaaaaatagtctctctctctctctcttcattcagataacggaaagagaaaaaggaaccgtgtaacagatatgccggtatataatatagaaactcacaggggtgtaaggtgtgcatgtgtatttttggtggatgctcatagaggtgtaatacgtgtgtttgctcatagagttaaatgtacatgaaataaacggagtaagagagaaccgtactcattccattgatatatttcattctatttctattgctccaagcaaaagcttctacgaccacgccaaatataactgtactagtacatgtattcatcaaaacattgtgatttaaaaagtaaatttcacaaaactacatatacttccgatcaagttatcacaaaactacgtatttaaaggcatgtattataaaactatagatttagcattaaattttttacagaactatagatttaaagcatcgtatcacaaaactatatatttagtgatgaagttatcacataactacaaactttaaagtttatatccatagaatattgaggttacaaaagttgtatttttatgataaaactaatgttaaatctgtagtttttctgatacgacacttcaatatgtagtcttgtgcaaaatacgatgttaactctgtagttttgtgttacagttcttaacaaatcctatggctcgccaagtacatgtaattttgtaaaatttcccctaatttaaaagatttgctcatcaatgataaaatctaaaatcacattagccaacaatattaattattagtaaaagggaacaaagggagtataaattatttagggcttattcggtgaaaaggattttcaaatcatgggaatagaaaaatataggattaggatgtcacatacactctaatcctaagaagtttttccaagagctcttacctcatgctaagaatcctaatcctatggcataagattgcaagagtacaattctaaggaatttgggtttaaaaaaatcaatgttttatttaattcctaaagtaatcctttgaaaatcctatatataaaccgaatgagccttatgatttatcgcaacgacaacgccaattatcaaaaatcatagaagtagcaaaatggcatcggcaccaattatcaaatatagtagaaataccacaatagaggtaagcagaaaaggactaaacattgcaatagcgtcagaaagaatttcactactaactgcattcccagtttccaactttgtttttaactaaagggcgtgtcctaagtaattctgcagccaactggatcaatggcctctgctaacatcgccaacacaacatatcggtgacaaaacacgaaaaatggctacaaagctacaagcttatacacactctcctgtggtctgccagcaaaagcatgtgatgtacaaaaactttacacaaaatggggggggccaggaaggtaggggcgctactagggttatgatcctcccgttttctgccgctgcttcatgctagctctccgcgctacgtcccacggcttgtgcggcacaccgacaccttgctgcgatgcaaagaacgactcgtatcccggggagtcgaaggcgaacccggtgtgcttcgagctctctcggggaagcatggagatcgcatagctccttgcttcttctgggcttagatggcttgtctctggaagttgtatcctgctgtactcgtggggttcatccctgtgcatctcctggattacttggtagtcataggggaagaaccacctttgaattctgagacaaataatgcacatcaggatggtttatattcagttgttttgtttataccatggaatgctttaaaatcaaaaggctcaaaccaacacaatttaattggaggaatcaaggaagagctagtaataagtcagtcacaggctcacagctagaaaagtattgagaaacaaaaggggcaacgtgataacaaagatagggtatcttacgataaatataagaagtcgccaaagagagcgatgattggaacaagcaatagtgtgaggtagaagaaaaacgtgctcatcaaaacataaatcacaaaatatacattttcctgcagaaagaaaacagcacgaagttaatgcagttataggaataaaatagtcataccagagcactggatttttcagtaatctatgaactatcccacctgtctgtcgaatgatgtcattattgcagagtagatgaagatgaacataaaccaggctgttatactgccagctacactgatatagtgccatcttgttatagagttgcatgacattagaagtcggagattcacagtcaccacaacacaggtgaaagccattgtactaacatcccaaagaccaagaatcttgccggatgaaccatgaccataccgacttgcagctgcagtgaagtaatagaacactatcgactgatagaaggcaaagaaagcccacactgctatcaccctccacttgaagaatgtattcctgattccttcctggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaccgagct

SEQ ID NO: 14415 - DNA, 245 bp, Oryza sativa
  unsure (1)..(245): unsure at all n locations
nnnnnnnnnnnnnnnnnnnnnnnnnnnnnnnnnnnnnncgtgaggagactgtggtctcccagtttatcgccggcgcgccgggggtctggatgcgggtgagctgcgagtcgtcgaggcgggcgaggaggccgctccgctggctgaagtagcccgtcatgccgtgccggatcacctacgccgcgccgtcagcccaggcggagagcaccgactgtgccacgtctagccgcagcgcgaagcaaacctcg

SEQ ID NO: 14416 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnncctgcattaaacacttatttcccatggcttgctgagtactcccgtactcacccttgctctatataaataatcccccctagttgctgaagaagatgaagcggatcccgctgacgaggagttcttccaggagcaagccggctacgatgagttttagggtttcggcctagttcccaagtcgtgcctgtgatgtttggtccaagtcttggcttccgcttcccttttgtaatgcagttgtgagctcgggatctgtccgcagcccaacatgactggactcctaccttataataaagagacctctggtgctgggatattctgtcttcctgtgataccagcactgtttcctgggattggtatcgattaacaggttaatttggagcgtcacgggctagttccgctcgggactagttcggggcgtgacagtctctttggtggacgaccgcctggtgcagtggttggcctcgctggaaccctgatcttaatgagggccctgggccattggatgaagggaccacgggcatttcctagtgagaggaccctcgccgttcggtggatacttcagagggaacagctcgtattcgggcttcaccaagtcgacttgaactttgcacaggcgggcctgggtgggctccatgcccttttgtctctggggtcgggttgacgcaagtccc

SEQ ID NO: 14417 - DNA, 1704 bp, Oryza sativa
ttcagtgatatgcagtatacctatcgacagcgagatgtccgtgtgagcgtgtcaagggagcaacgcgaatcgagcaccatgatggttgttcttgccatctgtgtttatctttgttatgggttagcaattagaactactcacttcgttccaaaatataaaaacctaggaccgagtgtgacatttcctagtgctgtacagattcgtagtactaggaaatatcacatccggtcgtaggttcttatattttggaatggctgtccagattcatagaattaggaaatgtcacatccggtcctatgttcttatattttggaacaaagtgagtatttgtttgggatgcttagggtcatgatccatgagttggacaattagggcttgtttggcacagctccagatccacctcttctggaactggagctcagcctaacaattttagcttcacctaaaatgggagcagagctgggtagagctctctcacaaaatgaactagagaggtagagctgggtttaggcaactccacaactccattccagacccaactcctggagctaaatttaggagttgggactctaccaaacaggccctaaatatacccattcatcaatttaaccaatacaccagatatatttcatgtctggtgttttggttaaattgatcactttggctactcatcaatcgacaaccccttctccgatgaggtgcggaataaagtagagttaagagtgggagtacaagaaggaaaaggaaacttatcaagccaagccttggagggaggccttgaaagcagatccaatacgcttcatgtgcaacttctgacaaaaagagaaaacactctaatacaacaaatgcaataagatattgattataaaaataatcatcaaacttcaacaggagactacccttcaccttcttcctctactacattggctgaattcgccttcttcctatattccagttgccaaatatgggctccccataatataggctcacagcgagacagtgtgagagcccaaatttatagaaatcgagcttgcactagagagaaagggcctcacgatatcagctcatatggaggtggcacgtaatagatcaagttcttcatagtccgaggctccgatgtgtatggctataaccattgtggtccgctccatatcccttgttctccattgttcctcacaggatcaggggtggagagtgaagagagagcagaacgagtattatttctcgtcgcatcggatcacaatggttaatctaattcctgcaaaaagaaaaagatttactattttttatgctaaattcttctgaaattcatacctctgcattcaaaagagccttcaacggacgaacgtgagttccctcaatcagaatcagcggctgagatctctgccagccgtccactccatgttccaccacctccgccgccgccttctctgcaccgcggcggcgccgccgatccgcgtggcgctgacggagtcctccggccgaggggtcttcgccacccgccccatctccgccggcgaggtcctccactccgcgcagcccctcgtctcccacccttcccctcccctcatccacgaggtgagttgctccgctttactcgcctctttgccgccggccaccgcggctggaaactctaccttctccttttacggacggagcgaaatggttcggattgggctgcttaggtgtgctacagctgcctca

SEQ ID NO: 14418 - DNA, 16533 bp, Oryza sativa
cctgcaaaaagaaaaagatttactattttttatgctaaattcttctgaaattcatacctctgcattcaaaagagccttcaacggacgaacgtgagttccctcaatcagaatcagcggctgagatctctgccagccgtccactccatgttccaccacctccgccgccgcctcctctgcaccgcggcggcgccgccgatccgcgtggcgctgacggagtcctccggccgaggggtcttcgccacccgccccatctccgccggcgaggtcctccactccgcgcagcccctcgtctcccacccttcccctcccctcatccacgaggtgagttgctccgctttactcgcctctttgccgccggccaccgcggctggaaactctaccttctccttttacggacggagcgaaatggttcggattgggctcctcaggtgtgctacagctgcctcaggaggaagtccgggagcggcggcggctcgagcgggagctgctacttctgcagcgacgcgtgcagggagcacgccaaggtgaggccttaacaccattgatttatgtactagtagtataatgacttgtgatgctacaaaattttcaagattcagtggatgttagtgtactgttcttttgtcatttgctcatttccaagttattacgatgctgtatcaagatccagtaggtgttttgcaacaaaatgtgaatggtagccttccatggtcagagcacatgaatggccaaaggcttgcaatctttcacaataatgttccttgaggaaattacatgtttatttgtcctcccttcgacaagaagatatatctgcagagggcaaccgaggatggtgttgtctaacaaggtgtgtgattttttggccaatttagggattccatggcgttgaaaagaaagcggattggtctttgtttgatgaccactgcaggtatgtctctgtccccttgtgtagatgtgtgcatcctgacctccgcattgcatctatgctcatgctcttgggttttatttttacttgttaatgccatggcgatgctattttgttaagcacgcaattgtcttggtggcttttgacttgaatttatactttgcttttcttcctgaagttcacgcggtctaaagtacccgtacatggcaaagcgactagcttgcatggttatctcaggagctgttagtgcagactgtcttgacatactccagccagcccgtttgcaccaggggacacttacagaggtagctgctttatttcagaactattgttaatttcagaacataatcttttcaactaattcatgtcctgtaatgttatttgtctggtgcttacttgaacaatgtaataatatagatggaggaagagtttgcgttgttggattccacttttaggaaggcagggtttcaggaagaaatcacaacttgtatccttcatttttctcacttgtgttatttatggccaagcagtgttgaacactaatactgataaagatacgtaatagaatggatcgaatgcatatttcaatctcgcccaacttatcttttcttatctatttttctttgacaaattagttttgaccaaagagtggtacatcaatgtgctggcaaggatacgcataaatgcattccgcattgaactggttgcaagttcatatgagaaccttctatcctcagcagtagcctcagtatcttgtgatgcggcagttggcaatgctgtctatatgcttccctctttctataaccatgactgtggtatgtcttttgaccttgcgctgttgaactaaagcaatatttaacttccttttgcctacggaatatttaaacagtgtgtcttgccatgagatacaagaatttgttattgcctttttgttgtgatgcagtaaatggtgactgttatttctaaattcttcattagcatatgtttatatctagtattgactgattggtttaccgaaattattctcgtcgacttaatatcatcgagttttgtggaaccttttggttattaatcactttagataattagaaaacaaaagtcgtttcattccgagtaatttttttttacttggatcaatattatcgcgcttatttttctttgaaatttgagacccaatcactcaccatctcccattattaactttcagatccaaatactcacatagtttggttggccagcgcagacgcgagattaaaggccctccgcaacatcgaagaaggtacgtaaatctgcggtgcgctggcccagttattctatcaccagccattgagcgcagttgaacagaaagacaaacacaccgatggctgccaaaattgttgatactgtggatgttgcatctgctatatactacaggtgaagagctgcgcatctgctacattgacgcgagcatggacgtcgatgcccgtcagaggattctcgccgaaggatttggcttcgaatgccgctgccaacggtgcttgtctggagattaaaacaccatccctttttcgttgtattttccatccttttggcatgcacattgaagccaaccgaggttaattaccattgtaaacttttcaaagatcagttgaagccaggagtcaccaatgtaactgccaggtgctcctgtttggaagatttgtaacgtgttggtgtgtgtgtgtcgacaagagtacgaatactgaatgttgttgattattaccccgatgtttaagcattagacttttggacattattagacatttgtttgacatgttactgccatgccaataacattggtgtttacagaatgtcttgttgtatgctgcaactttaatttatggataagagggtatttgttctattttcttgatgcaatctccctagtgttgcagttcatctgtaccactgtacaacgcgtcatgcatagacatccagtcctatctataacattgaagattactgatgtgcaacatttcatgccaaaataaatagcagatctggcactctagcgcatccacaagaaagcatgatgttgtgtccatatgattgttcatgttattaccacttagcactatctgtcaaattagaacccaaaatactgcccacaatctgttttgtcaggttttgcataagcggaagaaatagcttatatcaaagacactctaaccttatagtatttgcaaccgagagatcagcttgtctgtcattaatgatagaaggtccaagcacatcagttacaaaaccagccaatacataactcaagcagcttataccaaaatggaattttgatatctgtcaacacaatgccacctaaacatggcttgggaagggtgggtaagagactgaatcgtatgcaatgcgttgcatcctggatgacagcaccattctcacaatgatcaatgaggggcataagtttcacattttttttgggcatcggcattctcatgctatcgctggccagtttagttaccaaagggatccaacaaaattttactgaccagcactcactattgcggtcttagagaaacaaaagaaacaaaacaatacaaattacaacagataatttaaaggaaataatcaggtgttctccgtgtcacatctggttcacctctcctaggagctggttcaaactgcaagaataatccaagttgaatcccagggaattatttttacaacttttacagttacagcacagcaaaagagaattgatccaacaacattactaatctgtttttaaatcagttggtatttacaatttaccatacctgtataatgtgtaagctacatgtagttggctaataatatcataagtaaaacaaaacttggcataataggaaaaggggatcagaaagaataaattggtatgcacctgaataaatgtgtgattcctgcagtcatcaacctccaggatggatgccatgttgccacagcgataacaataattaggtgcactgaatatggtcacgaccttttgttcctgtgcgtggtgaagaataaataagacaatgctagttcggtagcaaaatcaacaacaaaattaaatctagaaaaatgagaaaattccctatgtacccacgaaagttcacctaatcccttatatgcccctgaattttgctcattcccttatgtacccctgaattttagtttggatcccttctacgcccggtcaactagcggaaagggcatggaagagatcaaaactaaaattcatgggtatgcaagggaatgagcaaaattcaagggcgtagaagggattaggtgaaatttcaggggtacacaagaaattctctcttaaatctatgctaagcaacttacgtgcgcccagttatatccttccataactaattgatgagcccgggctacaagtttgagattattggtatggttaaactgctccgatatgtcctgaaaaattgaatgtgtacggttgagaacagaacagatagtctattaatagatgaaagaaaattaatggaaaatagagtatttagtacctggccaaaagtgtagccagcaccacgaggagatatgccccaaccgcatcgatcatccgggtcagaccatagaagatcacacattggtccctcatgagggacctcttgaacacgatctaagctgcgaacactatcaagattgtcgattgatggcgataaaccaccatggaggcagaaaatctctgattcaaccttcaaccaagacaataatttaacatcaataaaattttctgaacaaataaaaaatgatttctaaacttctgagcgagaacagaaacatcaactggttattaagaggaaacaccaagttaaaattctacaggccaatcaacaggtaaaaaatgatagatcaaataaagaatttcaactggtcttgcacatatattatcaactccaggaaacaaaaggaacaggaaagaaccaacaattatggctgcataaacacttggttgcctacagttgttacagcaattttggttttcaggaagaggaaaagcttaatcagtaattaaggcagtgacacaagggatgccagcattattgacccccttggagacaaaactcattcaagaaacaatccaaaaattatctacaagcaccagaaactaatcagtccaaagaggacacacgtttagactactgaggccagattttattttagagagtagtggttgccaaaagttgataaagtagcacatgcatagatgataataagtgggtttcatctgagactaacttaatctggtattggcttcagattttcgtatagaacattgagcaatgttcatacagaatgtcaattttaaaagaacaatagaaaaaaaaatcatagaaggaagaggactacaagttgagcacgcaccaatgctgtcaatggaaaatagtcaaaaagatcggtgaagatcttccagacatttgcacttccatacctaatcaaaaagcagaacaagatcaatcaataaaaaaaatcaagcttgtccactttgtattcacaagtcaatactacaaaaatcaacttagatagactagagttttccaaactattaactttggcatagatacagaataagtagactttcaagcacctaaactgactcactttcgtaggcattcgtcgtagaatccatacacctgtgtgatctgcaattattgaagatttcaagacagtttaaacaaagatggaatgaagagcaaacatcatctagatgagtccaaatgaagaaatggtttaagaagaaaggttgcattttagaatgagaaggtttctgttttaaatttatttgagggcgggaaaagaaaacaaacaatagaatcatctcatgggcatgatgaaatctacatacctgccgactctcatggtttccacgaaggattgtaatccgctgtgggtagcgcaccttcagtgcaaccaaaagctgggcaatggtaccacatcatgtcaacaagtaatacaaaagaaattaggcttcaataccattaacttaaacacaaatattgccgatacatctgctaggtttgaaacaaagagctgccaaaccatgatgcacatggtaaaacatggtagggccaaacgtcgtaaacaaacaaaccataagcatgacattgttgaacttcaattaaaatttcagcaaacaaaatcaaaactcaggagacttactgtaacagtctcaacagaatagtagccacgatctacataatctcccataaacaaataatttgtatctggacactggtaaacagtacaaaacaaatgtcagcttttaaagcatgaaacaaagaccaaagagagcagaaagaaacaaaactaatgccaatggattgagtaccttcccaccaatccgaaagagctctactagatcatggaattgcccatggatatcaccacaaattgtgactgggctcttaactggctgtatgtaaagtaaacaaatggttatagtcatatcttatattttcctagaccttataacataaaggcatacctaatatgttgacattgggtaaaatatttgtgccccctcaacatgcatagttacaagtacagaacatcaccatgcttgtcttagtcgcatatacataaaagattgttctttgtggtgcaatcaatgattaattagttgtgctgacaaaaaataaggaataccagacataagtcacccttttggttgtagctatacacatttaaattgctagagatgaaaacaaaatgtgagcggctatgctatgtccagactgaagctataaggttctctgtaattttaataagaaaattatcttattatgtaggtttccattgaagctcgaagaaataaaaaaggtgagcaagtacagaaggaaaacatcgcagttttgggtatatgagcgtgctggctggaggggtgaaacatatccttgttgtaaacaccctagagttgtgatgggcttgaaagtcactcaccctaatttcagatcttcccccacatttttcactagatatcttcccaatacccaccagcatacagaatgtgctgacggtaacaatataatccgcagatggaagataccttcataccaatcccactcagatacttcctccgtttcatattataagactttctagcattgcccacattcatatagatgttaataaatctaggcacacatatatatctagattcattaacatctatatgaatgtgggcaatgctagaaaatcttataacctgaaacggaggtagtaataaataaaaaaaatatcaacttcttgcatgggaaaagcatgataccgcaaaaaaccattatttttcatgtccatatcgagctagatcctctcacaataaaaactgaaatgagcatgccaactacaaacagcacagtcaccatatcgctggtgttactcgggctgattagagccacacacacagtcaccatttttatcagaagcaaccggcaatcaatactttcagcccagcacgcataccatcatcatactgcagggcatggcataatcgcaggagagctccaccgtacctgaacgttgctttcttccatcaatatctccttcgccttctcgcacaacgtcttgacctgaaagcgggccttggttagttagtaccagaggcaaaagactcacggattccagtacatttccattggtcaacccaaggcatgacgcatgtcaccgaatttttttttaaaaaagaaagaaaacagaagcatcgcatatatccaaaaacaaaggaaaaaagcaagcggatttaagcgacacaggcgcatatgtctcccgcccgagagagattcgattcggcatctgatgcaaaagctcacatcgacgtatcccaaatccccccgatccggccattactcctccatttattgcttctactcctccccccgcaataattcctagattccgcctgagatctaccgaacccgaaccgcaaaaccgagataaccctagcagccgcctccgcggagaagctgaaacccatagggcggatccggcaccagagaggaagccgtggcgtggcggcgctcacctcgggctcggagagcgggcggcactccatgagctgctcgatctgggcgtccaggccgccgccgccgccgccgcgcgagcccacggactcctccatccttcctcccacctcctccgccgcagacaagaggggcacctggtctaaccctagccgggggagagctcgtcgccggcgagggggaggcgagctggagagagagagagaggagagagattgagatgcggttggggggcgcgagggggagggagatggtgcaagggcagggcaggcagccaaatgcggggggaagcgatcgagccgggggggtcgggggtggggcccgcgtgtcagtgtcgcggggggggggcagaggaatgcggttggattggaactggagaagtggaagagagagcggaaaaatttttatgtggggcccacttgtcagtcagagggaggaacttttatgtgggacccacttgtcagtcggagggagggaattttgtgtgggccctacttttcagtcggggagagagaggaggagatgagggcgttcaggcgtgggcctggtgtgtgcccggcaatgaatactgcccccagtgcgcactccattttatattacaagttgtttggattttttcttaatcagtttattgagagatatactaataattgtaatataaaataaacatattattaaaatatattcaatgttaaatttaataaaactaaatgttatatatgttgctaatttttttatataaactttgttaaacctaaagaactttaactaagaaaaaaaatcaaacaatttataatatgaaacaaatttagtacttaaaaaaaatgaagattggtggtggtgattttaaccttgacagacaaacttaattctaccctatacgatcgcaagatccaacggccaaatcgttaccttcgcactacttttcataagctcattcagaatgcacctaggtgacatttagtctcatcgaggagatttcactccacgtaggcaactggcgtaagctcccaagaagaacctcatctccctacgagagagaggaagaaggagccagtgaaagtgccacggacaacgagattgtcgccactgagctccatatccatcgttgccgagctccaagtttgtcgccaccgagctccatgtctactaccgccaccttgatatgcacctgctccgaaagggtggctcaatctgccctatccaagcaacgaggagggggacgacggccgtactggagagtggggaggcttccttgcttcggagagcccgaagaggcaataggcggtggcagccggagttggaggcgagttgggggagggagaggcgttgacgagaggaaggaggggtgaggtggcgccggcgaaaggtggaagggagagacgatgctggcaccgccactggtgaggaggcgaggggagagggatcgggtgggaattggctgaggagcgaggagggcatgacgcatgagtggggatagggtgagattttatattatttctagattttagggtgtttagtgcaaaatgttggatcactacataaattaataatagaaggtgctgaaatgcaaaatatatgtggggtgctctaatggacactcggtcaacggggtcaaggcctcagtggatactcggtaattctatttagggcttgtttcgaattaacaaagggaataaacgagtaatttcaatttaggaaaaagtcctataagaccctttaagaataaaggattggatctgtaaaattgctatgaaattccgatggaatggcaatgttttatgcgaattttgtagaattcttagcataagcattgacctcttgaaattttccttttgtgtttatcactcttttccaaatcatatgggttgcatgtgctgcatctaaacagttccttatgtagtttttccagtgtttttcatttcttggattcaaggtgacatgacattttaatcatacatcttttctattcacatgttttaaaaattgtgagttccaaagtcctctaacttaatttctaaagaagtgaacccgcgaattattgaacacgcactacactataacatagatatagaagcactcggtctagcgggataaacaactattagtctgttgggaaagacctttaccgacactaattctgccacgagtgtctaccaggggtttagcagttgacaaaagtttttacatatatttttcaccggtagaagagtgccaacaattcttttgtttttgtgccgacagaccatgtattaatggcaaacaaactattcctagtagattgtctaccagcttagggcatcaacaatgttggtcaaaaccagtccatagtcaataaaataatctattcagctacctaaccacattgtggaagtagtcaataggagggaaatagcaaaagctgcccatagcactatggctaggcaagaagaccataaaaaaacatagttgtacagtggtactgttcataaaatattaaacaaaacaagttgtaaccgttggcttctggccgttggcttcctgaattgtgcctacaaaaactgaaacagcatacatacacccctgaacattgtgcctacaaaaactgaagcaacatacaccatctccattcatcaatttgctagaacacaactagttccaatggatccctcccatagaagcatctcaagtttcacaaatcaagactccccaagccaatactctgagagtagtgaccatatctcacctcctacaccccaatctcagtttctctttgcatcaccaaattatctgcaaaacttcaacccttttggtcctccaataaatcagccaccctttggtcactctcctccaagatttcaaggcgttcaacaccaagggagctggctgccacatactccatcaagctatcaatgatttcatttacaagagagttttggttccttaccaactatgcagtttggagctgcagccaacaggccaccatatgtgctgcaatttagctctgcagttggtgctgcagccaatacttcttcccatggatccgagtctagttctccatgccctgcaagacaaaaagagaaacaacatgtcacaattgaagagtcaagcagcagtagtgaagaagaaccaaagaggctgttggcgatatggcatgaggcccttcgaccaaaatctgccgaaagctatgcgaagagtggggattcaagcccgagacgtcaaagttagtcggggcgaagtccccctatggcgaagactacggaacaaggacggcgagaagcaagggatcacgcgggtactttgccaagccagaggcctcttgggcgaaggatgcagggcgaagagtatatgccgaagggggacggactttgccaaagcaagctcgcccccgcaagggccgaagaagcctttccggtccatcaagcctaggggctattgggccgacgatcgcccgacgacccatcaggggcccatgaacctcaattatactatgtacccatgtaaatgtccctttcataggggtaaccatgtaaattcccctgtataaccaaaaccctagtagtaagaacctgtaatacgggctataaatagtctcatagggccatgtaatagggggatcccaagaaaaattctcaaattaatacgctttacttcttttccaaccactgttgagtaaccacgactttcgacgtatgcggttgtcgtttcgacaacagctggcgccgaccgtggggacctccgagcgaaaccactgagggcgaatgccaccaaagaaggttgtgaaggagaaggttacaaggcgaaaggaaagcgacgccggggcggatatagccgccgaagagggagcagagccttcggcgtccattgccgaagatggaggagcgccatctggttctgcacctgcgccatctctaccgccttcggcccctgccacctctgtgcaggtgccgaacgcggctgacatggcgaaggcggcggcggcggcggcggcaagggcactccagaccagggcggagatcctttcgacaagccaactgctggtgccccaagccgctccgtcgcagccggcagcggccccaactgcgctcactcctgtgcaagcccaagtcaaccctaaccctgaaacacaaaccgaagccgacatggaagccatgcaacaaaacatgacgggactccaagacatgcttcgccaaatgtaagaacaacagtaagcatacgaggcggcaagacagtccaaggtcgcttcggctccaatcctccagtattcagcaggctatatcccacaagtctatccacaagtgccgacccagccccttccgcacaagtcgcgcaagcaccaatgtacttcgccgggcaaccatcgaccgcagcagcgcatccggcctctcacatgcaactgcaagctcaaccggtcgctgcccaagtacaccctcaaccgcctggccaagcaccacaaacaatggcagaaggggcttcggctctgtaggcgcagctccaggctttccttcagcagcttagccaaccccacaacatttcaggtacagccccttcggctcacctggaggggaatacaagtcaaggtgcgcctagttggttgccgtcgaatcggccaggtcaaggggcttcgccgtggagtcaaggaccgcagttcgacttcatcaatgctgctcaggcaccaaccattcggccgcaagcaccaatgtcaggcttcggagcaaaccaggcaccaaaccaggtcgccatgacatggtcacagccaactttcgacccctccatggtggctcagcaagcattaccaatcggagcggggcagccgaatgccatggcccaacctcacgcgcaagccgtgatttagccctttgccacgccgtactcgcagcaaggtgccgtgaacagggcggggggcgaaaaggggctaccgctgagtgggggaatcaagaaccgtccaatcccactccagttcaagttcccacccgtcccacgctactcaagcgaaactgacccaaaggaattcctctccatttatgagtctgcgatcgaagcggctcatggcgacgaaaataccaaggcaaaggtaatacatctcgctctagacggcatcgcccgttcttggtatttcaatctgccagccaatagcatttactcatgggagcaattgcgcgatgtctttgtccttaactttctaggtacctatgaggagccgaagacgcagcagcatctactcggcatttgccagaggccgggggagtcgataagggagtacatgcgtcgcttctcacaagcccagtgccaagttcaagacataaccgaggcgtctgtcataaacgccgcttcggctggtctactcgagggcgaactcacaagaaaaatcgccaacaaggagccacagacacttgagcacctacttcgcatcattgacgggttcgcaaggggcgaggaggattccaagcgatggcaagctatacaagctgagtatgataaggcttccgtcgccgctgctcaagcccaagcacaagttcaagttgccgaaccaccttctctcactgttcgccatccccagccagcgatccaaggacaaccgccaaagcaaggtcaagcccccatgacctggaggaagttcagaaccgactgtgcgggcaagactgtgatggctgtcgaagaagtgcaagccctccacaaggaattcgatgcccagcaagcaagcaaccatcagtagcctgtccgcaagaaggtccgaaaatacctctactgcgccttccacagacgctcttcgcacaccacggagcaatgccaaaacattcggcaacgtggcaacgcgcaagatccaaggccgcagcagggagcagcagtcgaagcacctcgcgaagtagctcaagaataggcaccccctgccgaacagcgccaagatgcacagcgcagagtaatccaagtgattacaagggctgacccgccaatccaactatcgaagtgacaaaagaagatgcagctacgaacgatccacaatatcacttcggcaggcgaaggggctccacagtatctgaaccagcaaatctcttttgggccagaagatgccgaaggagtaatgttcccgcatcaagatcctctggtgatctcagccgagatagctggtttcgaggtccggcgaatcctagtcgatggagggagttcggctgatgtcatttttgcagaagcatatgccaagatggggttgcccaccctagcccttaccccagcgccagcctcgctccgtggtttcggcggaaaagcagttcaagttcttggccaagcacagttgttggtagctttcggcacaggtgaaaacaggcgcgaagaacaagtattgttcgacgttgtcgacatcccttacaactacaacgccatcttcggccgtgcaaccttgaacaagttcgaagctatttcccaccacaattatctcaagctcaagatgcccagcccgacgggagtgatagtggtcaaggggcttcagccttcagccgcttctaaaggcgatcttgccataatcaacagaacagtacataatgttgaggctgaactgcatgaccgggtgaaacacgcgccaaagcctgcccctcacggcaagataatcaagatgcagattgatgacgccgaccccgcaaagctcgtatcgctggggggcgacatggacgaagaagtggcggcaagcatcctagaagtactcaagaaaaacagtgatatctttgcctggggccccgatcaggtgggaggtgtttcgacagatcccatcatgcatcacttggcagttaagccggatgccaagccaaggaaacagaagctgcacaagatgtctgctgatcgccaagaagcagcaaaagccaaagtccaaaaattgctcaaggctagggtcatccaagagatcgaccatcctgagtgactggcgaatccagtgctggtccggaagtcaaacggcaaatggcgcatatgtgttgatttcacagacctaaacaaagcatgtccgaaggacgatttccccttaccacggatcgaccatctcgtggattcaacagctggctgcgagctcatgagcttcctagatgcatattccggctatcaccagatccacatgaacccgaccgacatccccaagacagcctttatcacaccatttggcaccttttgccacctcaggatgcctttcggcctgaggaatgccggagcaaccttcgccaggctggtgtacaaggtcctgtacaagcagttggagcgaaacgtggaggcttatgtcgacgacatcgtcataaaaagccacaaggcttttgaccacgcgtccgacctgcaggagaccttcgacaacttgcgcgcagcgggtatgaaacttaatcctgagaagtgcgttttcggcgttcgcgcaggcaagttgttgggcttccttgtttctgaaagaggcatcgagttgaatccggagaaaatcgatgccattcagcaaatgaagccttcgtcgagcgtacgtgaagtacaaaagctcgcgggccgaattgcggcactcactcgattcctctcaaaggcagccgaaagaggtttgctcttcttcatgaccctccggggcgcgggaaaattcaactagacacccgaatgccaagcagcggttcaacgagctaaagcaatacctgcaaagcccgccagctttgatcagcccagcaccaggaagcgaactgctactatacctagcagcttcgctagtggcagtcagtgctgccctcgtccaagaaacagattcaggccagaagccggtctatttcgtctccgaagcattgcaaggagcgaagacaagatatattgaaatggaaaagctcgcttacgccctagtgatggcttcgcgcaagctcaagcattacttctaggcatacaaagtcatggtgccatcgaaatacccttttggcgaaatactccgaggcaaggaagttactggccagctcagcaagtgggcagcagagctatcccctttcgacttgcattttgtcgcccgcactactgtcaagtctcaagtgctagctgacttcgtagccgaatggacaccagcattcgcccttgagcccgagcctgtcgaacagccctgggtgatgtacgctgacggttcgtggtcgcacaggtgggcaggcattgcggcagtgctcacttcgccgaatggtgtgccgattcagtatgctgcaaggctgcagttcgacacaaccaataacgcagcagaatacgaagccattcttcttggcctaagaaaggcgaaagcattaggggttcggcgcttgctaatccgaaccgactccaagctagtggcagggcatgttgacaaatccttcgaggcaaaagaagaaggaatgaagtggtatttggaggccgttcggtccacggaaaaatgcttcaccggcataacggtcgaacattttacctaaaggccagaacgaggaagcagaccccctagcgaaatctggtgcctgtggaggcccacattcctcaagcatcttttttgaaatcctatacccaccaagtgtgcctgtggaaaggctggaagttatgacaattgaacaggcgaaactgggcgaagatccatgtgacttgcgaaca

SEQ ID NO: 14419 - DNA, 2735 bp, Oryza sativa
aaggagcgaagccaagatatattgaaatggaaaagctcgcttacgccctagtgatggcttcgcgcaagctcaagcataacttctaggcatacaaagtcatggtgccatcgaaataccctttggcgaaatactccgaggcaaggaagttactggccagctcagcaagtgggcagcagagctatcccctttcgacttgcattttgtcgcccgcactactgtcaagtctcaagtgctagctgacttcgtagccgaatggacaccagcattcgcccttgagcccgagcctgtcgaacagccctgggtgatgtacgctgacggttcgtggtcgcacaggtgggcaggcattgcggcagtgctcacttcgccgaatggtgtgccgattcagtatgctgcaaggctgcagttcgacacaaccaataacgcagcagaatacgaagccattcttcttggcctaagaaaggcgaaagcattaggggttcggcgcttgctaatccgaaccgactccaagctagtggcagggcatgttgacaaatccttcgaggcaaaagaagaaggaatgaagtggtatttggaggccgttcggtccacggaaaagtgcttcaccggcataacggtcgaacatttacctagaggccagaacgaggaagcagacgccctagcgaaatctgctgcctgtggaggcccacattcgccaggcatcttttttgaaatcctatacgcaccaagtgtgcctgtggaaagcctggaggtcatgacaattgaccaggcgaaactgggcgaagatccatgtgactggcgaacatcgtttgtgaaataccttgaaactggctagcttccggaagatgaagcagaagcaaagcgcttgtaactcagagccacaaggtataagatggtctcaggtcagctatatcgctccggggtacttcaacccttgctccgatgcatctcttccgccgaaggcaaggaaatggcgaaggagttacaccaggggctttgtggtgtgcaccaagccgcaataacagttgcctccaaagtgtttagacaaggagtttattggcccactgtgttgaaaatctgtgttgaacaaatcaagaagtgcgaaagttgccagcgtcatggccgaagccaagccgcgccccagtatgagttgcagcccatcgcaccaatctggcccttcgccagatggggactggacatcattgggccgttcccggtggcgtgaaacgggtacaagttcgcaattgtggccgttgaatacttctctcgatggattgaggccgaacccctcggagcgatcacttcggcagcagtacagaagtttgtatggaaaaacattgtttgccgtttcggagtaccaaaagagtttatcactgacaatggcaagcagttcgactctaacaagttcagagaaatgtgcgaagggcttaacctggaaatcaggttcgcgtcggtcgcgcacccacagtcaaatggggcggccaaacgtacaaatggtaagatcctaaaagcactaaagaaaaggcttgagggggcagcgaagggcaaatggccagaggaaatgttatctgttctttgggcccttcggatgacccccacaagaccaaccaagttcagcccgttcatgcttctttatggcgatgaggcaatgaccccaacagagctaggggctaactcaccaagggtgacgttctctaggggcgaagaggggcgcgaggtgtcgctcgaactcttggagggggtaagagtcgaagcactcgagcacatgcgcaagtatgccacaggcacttcggcaacttacaacaaaaaagttcgaccgacggagctgttgcctggtcatcctgtcttaaggaaaaaggcgaacccgatagccgttggcaagcttgaatcgaagtgggaaggaccatacctcatcaagcacaagtccaggacggggtcctttcgactggcgacacttaaaggcgaagagttcgaccattcatggaacgctgcctctctcaaacgtttttatgtctagaacgggtggcacccaaatcgccaacttgtaaaaatgtatatatcgttatgtaagcccttcggcactatgtaagcttttcggaaagaaaaaaaaagaggaaaatgaaaaaagacaaaaaactggatgtagggctattatccaccacggaggctcgaaccagtataaaatctctgtcctctgccctctttttatttgtttgtgcgattgataatttgcggaaaaaccccaaggcaaacgcctgatcagcgaaaaaggccaggggggcgaaacgaatcggccgaagcatcgctcgccgaacgattgaaaccgcaacagcttgtttcggagaactagtcgaacactgttacactcgatcaaaaggaaagtacgagtgcttcctacaacgtagaacaaagcggatcgaaaatgaaagccgaatgctgaaaactcaaaacctatttcgctaatatatgcaaaggggccgacacgttccgacccaacgaaaagcacgcgaagtgacaatgcaaagatagcgaaaaggaaataaaacgcacctttattgattttaaataaaaatgtatcgaagaatacaaacccatcacaatgatacaagtgaaaggaaaagagcaatggcgttacaacccagcttgcagataaattacatcttcgcccccgcgatcactctctctctctgtaaggaataatcaggcgaactaggttcgtcattactgggtaccgagct

SEQ ID NO: 14420 - DNA, 1542 bp, Oryza sativa
  unsure (1)..(1542): unsure at all n locations
aaaccttatagctacgaccgtttatcaccatttgatgataaacaggccgaaataggcatcgcaccttcggcaaatccttaaatgccacaaatttctcgttttgatttcgccaactctcagaaggaggccggatgcacaactttcgacgaacacactggtagacagtgcaaaaagggcaaaagacgaattgcatagtgagaataggccaaaaaagagaaaatattgcataatgcgaaatgggtataatcataaatacgccaaagacttcgaccacaaaaaaagtggctaagagaatcatatattcaaaatatccaaggggccatttttcggctacaataaggagggttagcggcatcctgccgaatatacatcgttcgccattcccgacaaacacaaaaagaagaagggaaactacaaaaatctaaggaaggggcggagggcctcacacctctgggtgatcctgggcatcgcctccacccccttcggctgtcgcatcctcttcttcgcaccggtttgccgcctttgccttcgcgagttgctccaaaaggcgcgtcttggcggtggaccggccgtctttctgccagaactgttttcgccatgcacgaagcgcgggcgaaatgttctgcgcactgatctcccagtcccccttcgcatagttagggaactcggcgacgtgctcgcagccgaactgttgcagaaggcccatagtaaaggccaccgatacgcgcgcacagcaatcgccgtacgcagtggtgaagtccgaaaccgaaccaccggcctgctgagtccactcggagaagtcgaaggccgaggcatcttcggcagggacccctcgcacctttgcacccatgtcagtaagggcgaggcgaagcgtttggcacgtcgttctcgcggattcggtagttttcgccatctcccgcgaaaactgctgtgactccgccgcagcgttcgcgtcggccttgctgacctccaggcgaagagcctccatctttggctcagtaagattataataatccgtcagcacggcggaatgggctttttctttcttcaatttggcctggaggcgatcaacctcagctatggcctctcttcctttctccagttcggccttgaggcgatcgacctcggccctagcttcctttcctttctctaactcggattggagccgcttgttttcggctttcgcctctttcagggtgttggcgagggcctccacctgcaagttcttgcggcctatttcgtcatccttggcccgaagacggttcttgaatccgtcaagacgggcccgcacggttcactctgtcgaatagtgagctacaagaatctggatgcaaggtaggaatgggcaaagagaacaaatgttaattatgtgacatgtaaaaaagaagaggaaaatcaggaagagagaaaaaacatacccgaactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14421 - DNA, 549 bp, Oryza sativa
gaacagatctagtgaaaatcaccaagcatcaatcaaggacgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggccttgccgacgagccctcttaccaccaccttcaccccccgcgcaacggcgccggcgccgaccttcgccggaacagccgcacggacggcgactcctgcatcacccgtcgacggcaccggcggcaccttagcgccatgaaaacaccgcagtgggagctccatctttctcctgcaagaagacgacgacgacgatctagctagctatggacaccgagcttttatcagctacgcgaccatttctttctttatacggggggcg

SEQ ID NO: 14422 - DNA, 1673 bp, Oryza sativa
tctcaagcggcaatatagttttatcagtgtaactaccccaagctttcaacaagcctatacccgatccgtcgtaaaaagccagcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccaggtgttccggtgcgggtagccaatagccaaagcccaaagagcccagcaaccgaagcggccgacgtggcgcatcctcagccgccgcctcacgccgatccaacggtggccagatcgatccgtgcaaagtatacgtggcttcgcacggacccatccatctgtgccctagtttaatcccccggggcgcgggcctaatcaacttgattaagcgccactaaccaccccctggaacgatctccccgatatttaggcggagattaacgaggcctctgtgcctcgtggggagtaattaatggcggagaaagttttggttaatcaaagagaggggggtaattagatcgatgagtggtcattaacaaacaggtgtcagcccgacacggaggagcctggtcgtgacacttgtcctccccgggatccatgttggcccatatgggtgggctctcattggccgaactgcaaaagctgatcatttcccttgtgcggaaatgtgttgttcatttttgttttgtttttgttttttttacgccttgtgagatattgtcaatatttcaagatgtactccctccgtattttaatgtatgacgctgttaactttttgataaacgtttgacctttcgtcttattcaaaaaatttatgtaattataatttattttattgtgacttgatttatcatcaaatgttctttaagcatgacataagtatttttatatttgtataaaatttttgaataagacgagtggttaaacgttggttaaaaagtcaacggcgtcatacattaaaatatgagggggtataaaatatgaaataaagaattattgtagttctagcttgggtcatgcgtgacaccatcatagtacggtagcagccgcagtagcaacagggtggattataaaggaagaagttgaatgcatttatgactctatttatcagggtttaaattatgacacatataatggaaaaattgtaaaaccatctcaaatgtcactataagtttgagtttccccctataagacgatttgtggtaaatacacccccctctcttagttcacctttgatttgagattcccctgattggcattgctcgtccattctcgtgacaaacccccccccacatgtgttcacatgaatactaatacgggaggagttgtggtcaccactcatgttgatcaagcctaatgacaccaatggtgacattttttacacatgacacgcccacacc

SEQ ID NO: 14423 - DNA, 11194 bp, Oryza sativa
catttatgactctatttatcagggtttaaattatgacacatataatggaaaaattgtaaaaaccatctcaaatgtcactataagtttgagtttccccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatgagctaagtcgtataacacatgagaaaagagaaaaaaaatagtgtgagcaactggggaggaatatcaaactaaggtgaactaggaggtgagtattcacaaaagatcatcttatagcggaaatcttaaactcagtgtgacatttggagtgatcttctataaatttccctaaatataaaatgtacgatcggggtttaaaaaaaatgtacaatcataaatattgtttcacctctgtatgttgatcgtgctgataagagtagtcatgagcaggggcggagacaggagtagggcagcttgggcttgcaaccctattcctagtcctaaatattcattgaaattccattttaaaactttaaaaactagaagataaaggcaaaattatatatattcaactaattgagccctaagtttagaaaaattttggctccgccactagtcatgagggtgtgcatgcacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgctaggaagagcagtataagatggtatggcagcaatgaacacagcacacatacactaccagagaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattataatttggttgagataacagtatatatcgtgtgtctcaggaaaagctaagaaatccatggagaaagggtagactgtgtagatcattgttctaaccttcaagtttaaagaccaacataaaggtaagagcatactgtttgctatgatgagaacaaaagggtttaggggcttggtacctgtctcaaatgcagcatcataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaagaaaggatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattaacagtaatagaataaaaaataatactacatatgcatctattcacaatcgagatttaatattcaataatacctcattcaaaggatgcataatatctgtaccaccaccagcaacaaagtttaagtttatccagtcaagtgcacttgctattgatttctcatttactttctccaaacacgatgagaatgagtgcagctcatcattaaatgttataatgttgaagtaatctccttctgtgagttctgacagagcagtagacatcgcattcttcacattctcaagcggatgtccttgcatgcttccacttgtatcaatgacaaacacaactgcttttctgaagacctattgaattgctcaggtgagatataggaacaaggagagagattttgtgaaacacagaagaaggaaaaagggaatgtacttctgtgtcaataaaccaaaagtgctatgaacaaggccacctcagtaacatccttatttactataactttaatgatttacaatcgcaaaatatcctgatagtatttgctaaaagaagtccagattgtagtttgcacatagctagtggaatttcactagaaaaagatcaccaaatggcagtttagaatggtgggtttgttgattggttctataaaaaagtagttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataaacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgattacagctaataaagagatcacaaaagggaaactcacactgtatgaaaaattgaaatctttgcttgaccaattctcaacagttgcttcatgccggaaagacaacttctcaccctgcctacctttttcctgaaatagtaagggaaactcttttgaagattaaatgttgtaaaagcactgatgccaattgcccggaaatcaaaagagttctagcaaaaaaaaatgattaccttcaatgggtggcttgttccctgcagtaaaacctctttactgaaaccactattcacagtcaactgaattttctcccttttcatgaatacttttggcaatgggttaacataatatggaaaacggaacggtatgtccactgagaatcgtccattgtcatagtgtagcttctgagaccatctgattgtggcagaaatatccgccccaccctcaatctttatcggcaagatggcaatgaatcttcaaagtaagactccaattccaaaagttcaaagaagagaacaaaagacagttctgcatttagcatgtacctgtgatattgtcaaataaaataattggggtttcaagagtccgccactatcagcttttggagcattctctgtagtgtgatcttctacttcaattacttgagtattatatgatcttcttccaacggtaacctcggctcctagaattgaaccctattagccaaaccgttcataggttgagaacaagacaaacatggaaattaatgcaactcatataacataattaaacataatatactagtagatgcctaatgttcatttaatggtgatgtttcctacggatggaaagtagaatcagatgtttcaaaatatcaaatattagtgtatgtgagttatttattacaaatttccaagttgttgttaatcaacttcgctaggcaagataacaaccacccaacaccaatgaataatatgctatagtcatccaagacaaataacttcaccaccgaattatctccattctgcaagccattatattctacaaccagacataaaaggagcaatggagcatcatgtgtacttctagatgctgaagtaaagaacaagctatacaatatgtttccaaatgacacgaagcaacatatttcagtacacatcaacatatttcttcttcctagctgcctcatttttgatacacaagccaggttaccactctgctaaaccagcacattccttcttgtgtttgatttccataggacaaagcaaggaattactttcacttgcttatgccactttttactgaaaattgctcttgtaatataaccaaaggcatccatttagtcagctggaattcataaactagttataaagaaagtacagaatttagtgcagagcacgccatgatttgcggtcaaccacctcaagacaactcaatcaaacgaaccatatgaacaaaaaaaaaaaagagaacatattccacttggacaaacactgggttaagcaaacacctgaataatgttgccaccaaccattccaacagcacagtcaacaataaggtacaaaaccaacaaagcatccatgtgaagaaaacaatagaactaacggctcaatggagaatcaaaactgcaaatcgagaggcacatatacatgccgcaaaaacaaatccaacaaattcatggttcccaactatgtaataacactagccaaacagccggaatcatacatagcacagcaccaatcatttcgaacctcaccaaaccaaatctacgaggcaggagaagggaacaacacagctacactagggggtaaaacaaaaaaaatcgccaaaatgtgatccgatcgagatttacctggtcgcccatgggcacgacgatgcggacgtcgcagtcgcggctgcgggtgatgcagtgcaaccaccaccgcgcgcggacggtgacagcggcctcgccgagcgcgcagtcgacggacaggtcgacctccttcatctggagcgggatcagcgcgggggggtcgaggcggccgtacacgtatggctggtagctgggcacgtcgggggtgtcgaccgcccccgggtcggtcaccaccgcgtacgccatcggcgccgaccgcagcagcagcgccgccacggaggcatcacccccacccccacccccaaccccaacgccgcggtccatccccgccagtggcctcggcggcggcagcccccccggcagcaccagcctcttcgacagcttcagcccgtcctccaccgccctagcgaacccctccatgacccagacgcgggatgcggcggcggcggcgtctgcctcaggtagggttccggctgcgccgacgagaggaggagattggtgtggtcgattgatctgggggggaggcgatcggcgcggcggcgtgggcaagggagcgagacgagtttatttgtggagatgaaaatgatgagatgagatgggatgggaggcggtgagattaacgggatgggggggaggtttgattcgatggatcgttgtcacggaagatttgattaatgtttttaactgattacacggaagattatggtggagttggtttggtatcttcgtttggttatgggtgtttcctttccattgtttatgctgtcgctttgtccgttgaaaaattgaaaactgtaaatttattagaaaagggggaaaaaacacgggacattaacatgagttcggagtgaattagcgcttccggggcaattaaaaaacttgcctaatccagttatagtatcagccatgttacattactcggaaagaaagaaacatgttacatcatgtattgccttctgatacgttcacacaaactgaactttgctttagcaccgccttagcgtcagactaaccattagctttattgtttaaccacaacctgctaaagagagtaataaagagacctttgctttttactaaatgatctgcatatagtttttttatagttttttttatttctaaatgatctacgtatttatattcattcattaggtctattcgttatttgtgtataggagtaaatggacatggatacacgcatccatacacacaagtatttatagctcacatgtaatatcttgatttgctattggctagaaaatagtggggatggtgtatgtatcgagtttgttatatattatgagagagttattagttttcgttggttttagtgtacctatgaaatatttagatcaatttaaaatggagggaggatcatctttggagaagttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaagaaaaggagcaacgtatacacgcggtcaaaacacagctgcggaaaaaggccctgggccccactttgtgggccccgctcccccgggccggccacgcgcgtcaagcacgcgccacgtggcctccaaagggacgacgacgcgcgggagatccgatcgtgacggctcgtttcggcttcgacggtcgggatctccgtctcgccgtcggcaacgcggcgtaacggctagttttgtgtcgttttctggggggaccgctccaggagccgtgcgtgtggtgtgaactccgcaagtccgttatacaggagtacgtacgtcgcgccatcaccagctgtgaccgcctggcgcccggtgaacggttttgaaacacgttctcgcttgttttttttaatggtgcgaagttctattgagcaggaaaaaattactccctccgtttcaaaatatttggcaccgttgaccttttagtacgtgtttgaccattcgtcttattaaaaaaaacaattatttattcatatcatttgatttaaagcctcatcgtttggcatattttctgaatatgtcaaatgacatattttgcaaacgaaaatcaatttgtgaataaaacttttatatatgtgttcttagcgatctaaaagcaaaggctgaaaaataaacttcgatgaaaaaaccccaaaattagcttcaaatttaacgttgaaaattcaaattttggctcataagcatatgaatatgccaaacgatgaggccctcattgttaaatatactttcatgtacacatatagttttacatatttcacaaaattttttaataagacgaacggttaaacatgtgctaaaaagttaacggtgtcaaacattttgaaacggagggagtacaagattacaaccctgaataccaccacccacacaccgatagcgccaacacacaatccggaagaaggctagcaccgaaccggccgccgctaagcgtgaccgaccgccgttagaccaacaaatgaacacatacaagatcgccccctagggatgccaaaacaacgtcttcaagaagagaagtgacagaaaaaccgttgctgccgtccgtcggggctcag

SEQ ID NO: 14424 - DNA, 1603 bp, Oryza sativa
caaccaccacggccgttgcctcgccagccaaccgtcgcagtcgatgccgccacagccgtcgccaccgtcactgctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtcaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgcagccggcggccgcgaggctggggaacgttctcgcttgttaaagcagatttaataatatcgtcaacttgctgactataagacaaccacatcatctatagcctgttagtataggctgctcatatagcaatggtctttattactatcatatcatttgtagtaacagataatatatttttaagcatgaaccaatctccatcaggcttatttctttttctttattgaactgcgtgttgcagccggtgataattctttcgtcgactcgtgttctcgctctaccattccctcctccagcatatcagtgagactgacgtgatcacgctatcgccgatcttggttggcctattagacatgctcttacgctctccggtttatgttgtgacacgatgggggataaacgcgtgacgagacaactatgaggctgttcatatggatgtcattttaaactatacaattttttaataaagttatctagttatgtacacatttagtttagttttgccaaattttggtctacatataaacatttctgtcaaaattttgatagcattgttaaggtaaaggtttattttatctaaaatctcaacaacacctacgtttttggttgccacgtgttcacaactcccaatcagcaatgagccaagtcgtgacgaaaaactcgatagcgatcgaatccatcccatccacctgtcaacgcatccgatccacgtggttcttagactagtccaggtcgttctcgacggtttggatcatgcaccggccaccggaaaagcgactcccctcgtctcaactctcaagtctcaaccgtgcatgaggcgatgtggggaccaccggaccagcaccagcaccagcagcaacggtcacgggctcacgacacgcgaggtcgtcatcgcgtagatttgggccggaatacctgcggattctgggcccactcctgcctctgtggtgcgttgctcacgccgccacgcgggcctcttttgggccgcaagaaagagaggcgagatgggctcctttgctcttccttgcagcggaagaagccgcgggccgtttcctcctccccgagaccaagacacaccaccacgccaccattcccacgcctcacgcggcggaaagagagagagagggtgaatttgctagcgagatgcc

SEQ ID NO: 14425 - DNA, 5402 bp, Oryza sativa
cgcttcatcaccctcttctccccggagggccgcctctgccaactcggtgagtgcccgccgccgcgacatgccccctccacgccgaccaaattcgctgctggtgtctgcgctttggctaacgatctgctgcttcaattccgccgcccgcctccccgtgcggccgtgctgtgtgctctcgcagactacgcgttcaacgccgtgaagctggccgggatcacctccgtcggcgtgcgcggcgacgactccgtctacgtcctcacccatcggaaggaggtgagcacgtcgcgagagcggaatccccttgtcccctcatttgtgattcattctgcggccgtttgatttgcttcgttcccctgatcaggacaagttgcacgacccgacgaccatcacgaacctgttcgcgatcaccgaccggattgggctgctcgccaccgggatgccaggtgagccacaactttgctctctcagattctcagttctaagtgctgcgtggaacatgcggtgcgcgcgtttggatcccgctggcacaatatcatttacgagttacgaattgcgaattggaggatcactcgactttatcctgccgtagaacgtctcagcgaaaccggttccaataattaatctctgcaactcttggtgttcatgagagcattgcgatgtgataaggatgttttacataccgatgatgcgcttgttcgactggatgctaattttgctgactccctatattgaatcagttttagtataggagtagtatgcacttccaggatacgtcatacatgctgattagatgaaatgttcagtgaatgagtgaaccactgtggtgtgattggatcctacatcctagtagtatgcactagatagaatggaatcttggccttggttgcacaatatactgacttatttggcagtcgatcgcccctttactaccatactctcatctattttgtgtttctgaggttgtaaatggctaatgtgacaatgtgagccagtactgtaactactgtactgagctattgtcttgtttgatttaacctatgtgagacagtaatgtaactaggcaacttttgcttgctaagtaatcaatcgttctatttgactactttcttgtatgatataatgtactgttttgttactaatgcctgataacttgttatatcattctgttggtggacagttccttcagtttagagggagttagggacttctcaattccatagcatgtgatttgtcactgagctctaaatatcttaatatagttctgtttagaattttatggaacagctagaatggctcacatcatcataagaaacactctagaggccaatggcaggacataccatcgcagtatcattttacttgtctgcttgttctgatcttttgagttttgacgggctatatctttattccaggtgatggaagggcaatagctcaggaggcaaggaacgcagctgccgagtttcgcttcaagtggggatataaaatgtctccttgtatgttagctcaatggtaagctttggtctaaatgaaatagatggctcattgtacaatacctatgtcttacaaacatctaaaatgatttgatcatcacgctattttatataatggttatataattatctctaggccgctctctgcttgtagggattgatcatttgccactcccattagaatgtcaaaggatcaatttcgcccattcacattaagacttagtattggatatatgagaaaatatggtgagagttcatatgagatcaacgggctgggaacttttctgaattctgataagcatatgctcgtgctttactatcaaacctacccttattttgttaagctacgtggatacattactctgttcaatcttcaatagcctaacgttgtttactaatttcactgaactgttctgcattttactagtggtgtatcattgcttgtttgtaggattgcagacagagcacagatccgcacccagcatgctcagataagaccttatggagttggttagtgctatccaatttgtgttttgtgagtggtgaaacctgccatcatcgtctaccatcaaaggattacaatgattactttgatcctacacattttcctctgcagtttctatgatctttggaattgatgaagagaaaggaacccccgagctcttcacatgtgatccagctggacaattctttgcacacaaggtattctaggaattttttgcagttcattaaatagctcttttcatcataacacaagttagtcgtgtttttttgtgaatgactacaacaaatgcaaatagcatgctgtattttttttcagttatcatgtgcaactagaaactgattaggtcacagagccactgaacaatctagatggagaaaccaccccataagctcaagcattttctgtatctgagaaacatgaatctcctatgtcattgcaggccacaagtgctggtccgaaagagaaggaagttatgaactttcttgaggaaagaatgaagagcaaaccttctctatcatctggcacaacaaaaggggtgtgtgttactattcttagcaaaccatgaaattgaacttatccaatgctgactagaaatgtataaaatggcattcagattagtgagtaaactaggtaagcattgatctgtaatggaaaaaatgttattgaattttttagttacagtaacatgttcatatgaaatgtgatggttcaacaccaagccacacattgcagacagtacaagatatccaaatctcatacatgcttaaatactagtaactagtatttaacacaacaaaagttcccttttctctgaagctgaatttgagaacatcattattaagggcaccactctgttagttctctttggatgcttaccacatgaagttttagctgtttctttaacaacagagtgcgttttgggatgtctatctgtgcagcatcttcgacagactactgtcaataatgcatgcctgcaagttcttttttccctcatgctgttgcgtatttatttgtacattagcacttttgtagtcacaagccctatccaatacggtgatccaatattttgatcccctttgtgattaatttttactgactttgtttccagttggcaatacggtgatccaatattttgatcccctttgtgattaatttttactgattttgtttccagttggcaaaatctgcgttgaaacatgtcctggagggggatttctatgcccgagaatttgaggtagtgctcattcttagccctattgtagatatgttctgtttgcactcactattgttaaataaaagagtgattttacggttcttgaggagataccgaaagataccatattttctagtgtaaaatttagtacatcccagtgtaaggtaaaaaaaatgtactaaaaattttggaattcttaaagaatgtaaaacttctctaaataaaacgttaagaaatatttgcactgccattatactgaacgacgcaagtcaaactttcttgtcagcttggatttatcaagaaaggggatccaactgtaactctgcacccagtgaaattcaagcgcacgcggaggtgaaggacgagagcagaacaaagtgctcgatataggacgatcaccagtctttcaaatcttttacagcatggaagttatgcaaaaccattaccgctaactgattactgtacgctatagctatatgtatgactgcgctcaagctgtgtcaagtgtcaattatgagttgcccccggatttacgataccaactgatgatcacacatcaacacttcaaactgtaactgtctacgaaggaactgcatcctcctgctcccgtgtaaccttagccagggataattttcctatgaagttggtcgcaaggctgccgaggaagagatctccgttgaactctgtcaccgaagtgaccatgttgatcacattcccttcagagtcaccaagaaccctcacgatctcgccgttcaacgacacctgagccaccactgctcccttgagcgtcgccttggtcctctcgacgagcgccgggaacgacgcgatgaccctcctcgtcaagctccagcgagagatcaggtccagccatggagacctcacctgcagtttgagcacagaaaattgtaagtttgagcactgaaaatgttgtgtagatgcttatggcagcagaaaggttagagagcagagacctggagaagggcaatccagaagtgaccatctgaacccagccgaatgttgtctggattccccggcaggttgtccacgaagatctctgcctccccagccttctcccctttcagccacactctcaagcatctgaacctgcacttgacaatatcacttcatggtcacttgacgatagagtgaacagactcttttttttatgagcaattttaccgttcttaaggagatacatgagatactattttttttctattttaatttgatatctctttatatctagatactataagataccaaattttatactaattttttttacctcatggtacatccttatgaaccgtaaaattactcgttttttattattattttagataagggtattttctatccagattctacatccaatcagatatatgcagccatttaaattaggaacttagccccacaaacaatccaatctgaaattcgttcctaagaagatttgcactcgtaaccttaaaatgttactcaggtcactgcacgtgtcatttcacagatgagaagttgagcttgttactacctcatcgtctcgcagacgacgacgaaggcctcgtcgggcggcagggcgacgccgttggcgaagccgaggccgtcgagcacgacggaggcctcgccggtgcgggggtcgtacttgagcaggcggccggtgaagcggtactcgaagaagtcgaggaaccagttgtcgaagctgaacctggtgctggcgtcgctgaagtacaccgtgccatcggaggcctcgatcgccgcgtccgcgaacctgaagacgacgaacggagaagaacagtagagaattcgcagtcgcagttacagatttgcactgtgcaaattgcatagtagtttgcagtgaaacaagtaatttgcaggaagataacctgatcgtggagccttcgacagtcgaagcaagaagcgtcacgcgtccattctcatccactttcaacaatccctgcagattttaattagtactccctccgtccctaaatgttgacgccgttgacattttttaaacatatttaaccgtttatcttattaaaaaaattaagtaattattaattctttttctatcatttaatttattattaaatatatttttatgtatacatatagttttatatattttataaaagtttttgaataaaacgaatggtcaaacatgtttaaaaatactttcttatttagggaacgaggg

SEQ ID NO: 14426 - DNA, 1182 bp, Oryza sativa
catcctccgcacccacccgtcccttgtcgccgtgaacacctcgccgccggcgtcgtccacgtacacgtcctccggcgcgctcagcatcccttccccaagcttctccagattctgccacatcgcaaaccatgaatccaccaacggccgacatgagcgcggcatggcgcggcgagctagaacgcaacgtaccgtacctggaggaggttgttgggagggaagcgagcggcgccgggtgggcgtgcgggcggcggggcgagcggctggatggggcagtggagcgcgacgtgcacggcgagcgacacgaagacggcggcgaggaggcccagctgctgcgccatgccgccgatcgacccaccaatgtgtagccgacgacgagctcgatcgatcgatcacgctatcggcgtcgactcgactcgccctgtagataagctggaggtgtcaggcatggcatacacgtgacgagtgggcacacacctgttatcgttagcccaagccacgtctgttttggacttgcccattattgcaccacataaaaggttctggtccaaacaaataaccgaaatttacttttctgaatacgtaaaaaattggaatccatagataccgtggtttaaacctgtaatgctcccctcgttccatttggaccatttagaagcctcaggtcactcatggattctgtaaaaggcaaaacgcttgtggactagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttt

SEQ ID NO: 14427 - DNA, 6620 bp, Oryza sativa
  unsure (1)..(6620): unsure at all n locations
ttcagtgtccaaaaaaggtgtagatccgcatacaacctatgcaatgtacctttgagaacgaataccatgagcatgtattggctaagctagatacacacactaaaatccagtggccgccttatgaatggatggatgcattcaaacaagtacgcaatttggccactaaactcgctcgaccgatcgagattagccaatggctcgctgacttaatctctgtagcactctcacttcacttgtaacccttcctatttaaattccatggggggtaggggaccctgaatcccacttcccatttcttttacaccccaatctcaccctctccatctctctctctcaagctctaaactcaatggtaatgggcacttaatagtagcactaatactagctactgttttagcagcagcatccaagcccaatcaaatcaagctgcctcactgaaagtctgaaactggccaatcagagagctcctgcaaaaacaaccctgaaactactctggtttgctatcatccagctagattctgttgcctcctaacatcgtcgtttcgccgccgtcactttgctcgaatcatcagagctctagggctacctgctaattaaccatagccatgggggtaagtaagctcgatcaagtgcatgttaggtttcagtaaattatgtgttttcatatgagatatatgtttgatttttttgtaattatgttctgtttgcagattattaactggatgcagaatcgactcagtactgctaaacaagacaagagacgaactgaagctgctgctgtggcctcgtcagctcgcagtaagttttactttgttttgatttgaacatttgaactgttataattttcatgttaaattcttgggattcaaacgtgcatgtgtaagttatatacgtatgtaagtggagttggatatattttgcatggtttttgacgtttgttcgtcgacgtggatgcatgcatggatgctacaggacgaggaggagggggaggagagagtttcctccaagaagaagctcgcgacgagatcaagatcgccggagatcacctcctctccatcggcacgctcgggaacgagtcgccgccgcgaccgccggcggcggcggcggcgacggcggcagaggaggtggcggacttcaccatcgaggaggtgaagaagctgcaggaggcgctgaacaagctgctccggcgagccaagtccaccaagtccggcagccgccgcggctcgacggcggcggagcacgacgccgacgagcgctcctcctcctcctcctcctccggcagccagctgctgctgccgctcgacaggttcctcaactgcccctccaacctcgaggtcgaccggcgcgtggcggcggccgacggcgagttctcgccggacacgcagatcatcctcagcaaggcgcgcgacctcctcgtcaacaccaatggcggcggcgccatcaagcagaaatccttcaggttcctcctcaagaagatgttcgtctgccgcggcggcttctcgccgtcgccggcgccgccgccaccttgaaggatccagtcgaatcaagaatcgaaaaggtctcaattaaacagtagaacaagttatcatctactcactccatttcatattataacatattataattcgttttgaattttttttcctagttaaactttcttttaagtttgattacattagtaaaaatataacaaacatattatcgaaatatattcaatgttacatttaataagactaatttgacgtcgtagatgttgataattttttctataaacttggttaaacatagagaaatttgattaggaaaaaaaagtgaaaacaacttatgatatgaaatgttggttaaacatagagaagtttgattaggaaaaaaagtgaaaacaacttatgatatgaaatggagggagtaactaataatgatatgatcagtgacgaaagtatgaaacagtgcaaactaatatggtttgttttgttttgttttgcattttgtgttcatatgcagttgttcaggacgatgcttcacaagaggatgaacgctcgaccgagtaatgctgcggcgtcgtcgtcgaggaaatactatcttgaggataagccgagggagaagatgcaaagggagcatctccatgatgatgaagatgatgatgagaatgcagaagatatctttaaatgggacaaaactgattcagattgtaagtgagagttaatattcttcttgctgcatatatttgtttgcattcatggacatattttcaaacatatatgcatgaaaagattacatatatattgcagtaagtatagtttgtgtagaagtaattgattaagcatcaacttatgagtggattttcttgatgttttttgcagtcattgttctggagatgtagaccgagacgcacgattcaatgcgatcattattgtttgcacaatggtaagtgatatatagtggaatgtgaaccctacactcttgctcagtcaaattaagcactgaattctggatgccattctgttttcttcagactacatgatggtggcctggtgtcctgatttacgcggaggaaaattcgcagtaattttgatgccacaataatccccatttgttcatgaggttcagttgaatggcgaatcgatcgcacgggacaacatacagaaccgaatgcgatgcgcgacggtgtaattctgaacgaagatcaaacgtcgactggctggctagttcaatcattattggatttgagctgaaaataggagaaattttcaagctctgttatctttttctttttttcagatttcagatacagttggtgtacgtttcaccatatagtactactccccccaatgtatactccatttccattaaatttgtgggatacagcaacaagttttcatttcatttcatctgctagtgaacccctcatgctcttattctacctacccttgatcatctcaagaacattggtgcatgataaatatacaccagaatgtaccgaaacagcagtgcaactagggttcttggggcatgcccatggccgaaatcggtaagccaacctggagcagaggctacaaaattcccaaatctccatcggcatcctgaatttctctgatcaggggcaggccccccggccggcacatttgtgtgtgtttgtgcccaactttgggaaaaaaaggtggccaggagtggctgccaagcaacattctacacctttggcaaatgccgatgtgccattgaatatatatgtgatcactactcacttgtgtgtgtacatttatgtactgtatcttatgttcagatgtactaatatatccatatatgtactctactagtagactactagtatgctaaaatacattggtactcccactatccaataatataagagattttgagtttttacttataacgtttgaccacttgtcttattcaaatttttttaaattattatttattttatttgtgacttactttattatctatagtattttaagcacaactttttgttttttatatttgaaaaaaaaattgaataagatgagtggtcaaatgttataagcaaaacctcaaaatcccttatattatgggacggatggagtacttgatttggatgattgatgaagaggcccttttctctcatgagacatttggtctttgttagatgaggaaggatcctagggatccacaagatgagagataaacttaaataggagctatgcatgatactatgctggtagagtttgttatcaagagctaatagtccagattaatgtgcattcattaatctctgactcttgaagaatgtctggacagaaaagaggcacccatcatcattcaccgttggatcgatgaacaaaataaaagtagtacacatctgggtgtgtgtggagttctagaatgaaggctagagaagcagcgagaagctgccgcgatgtggtcctgaatcccgtgtcgcttttcggctagaaaagaaatgcatatatatctgaacatgcggtttctgaatctacaccgagcttagatatcatcgcattgcatgcagtcctatagattatctactactaatctatggtgttagggcacccacaatggttatctataggctctctataagagattcatgtcagcatattttcctacttggaatgtattaaatgaagagagagagcaaagctatctactaacttagagatagtctatagagaaaaacgagacaatgcatgagagagctatagataccaatgtagacatactattaaggtggtttactattaatcgagtctattgctgagatgtacatgttttatagatagcaccttactttaccattgcgggtgctcttagtaactgatgatggtcaacttctgatgggtgacatatctgcggtgaatcactcagatattgctgtatccctctgggaactagcagttgactagctagtgcctagtagacactagtcgaggatttccagggtagactgacaaagaattaatggaaagagtgaaggttactaggtgaagcaggaaattttactgctcaggatcatatgctgcctatgtaggtcaaagatcggatgtgcttatcgtaagctgaatattccttgagcagctttcaagaggattgtgaagagaaactttatttatcgcatgttgcataagtgctgcttcagcaatgccagcccacgagccacgagtcagggatgccaatggaagaaaaccgataccgagaggtgaaaccacctattttgccatgataattgttactttgatcgtgatatatgcaccaacactcagctgtgaattcaccaattcgaacctgataagtgataacagtagacaatgctcttcattacagaaaagaaagtagaagatatgtgtgacaaaccgaacatcgataccgaacggaaatcacgtatttcaggacaggcctgatgagagcgcacagggctatacttcagaagagcgaaaaaaccaggctgtgcaatgcataagagatagaacaaacagcacaaccaaagtttcccctacagttttggtaggagcagaaaaactttagccgcaaaagcgatgaagcaatcaagcaaagcgaaagacgggagaattgaagaccgcatcaaaactggatcgaccaacaatgccgctatggtgacacaggcagacacagtaataataacctgattggtctttaaacattaaaggaggagaaaacgatctcagtagaagtagagtgctacaatctcaacacaaaacgggctcaagtactagttgacaccacgaacgacacatcaatggtaattcaaacttctagattgaagtatcaacggtaattcaaacttccggatttttctttttatctttgtgcaccgatcgccatcacctgactcaaggaagatctctgcaataaaacataatcaaaacattagttctgaacaaggatggctcaaggcagatgaaatttacatgaccatatgaaatcaaattgatgtgctgcaaatgagatatctagatatgagcaacttgctgaataaagagagtaatatgcagcaaatcaggtatctaagcctactgaataaagagagtaatgtgcagcaaatgaggtatctagatatgaaacatcaggacattatcatttacagaataatatatatggcatgcatcatcatttaaagaataatataggatcgattccttaaaataagacagctggtcatccgattgcttcagtataataacaagaacaacgctagcaaataaaacgacgggctctgatacttatggaataacttacagatcttgttgaacgcaacaatgtcccagctctggatgtactcattcgctggttcggtgtagaagtagtcctcaatcaaactatcaaccgacacaagatcatcgacaatggtcatcatgatttgcaatttcttgataccgtaaccaacccggannnnnnnnnnnnnnnnnnnnnnnnnnnnnnnnnnnnnnnnagcatactgtttgctatgatgagaacaaaagggtttaggggcttggtacctgtctcaaatgcagcatcataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaaaaaagaatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattacagtaataga

SEQ ID NO: 14428 - DNA, 843 bp, Oryza sativa
actagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttttcaatgcacaaaactgatcactactttttctaattatatgtttaaaaaagtattaaaattcatatataaaagtgttttcatgactattctactactaatagtcttttattgtgttaaatcctattattttttgcattcattaatcatctaaagattttgataatacatgacgacatatatttgacaacagagaggtaatacaaatcagttaaacaaaaaaaaaagtttaaaagtattaaagtaataatgtctaactctgggggaaaaacggattggattcagatagatagtggtcataccatatcctaaaaacatatttttaagagttaattttagaaaactgcaactttaatgacaaaa

SEQ ID NO: 14429 - DNA, 589 bp, Oryza sativa
  unsure (1)..(589): unsure at all n locations
nnnnnnnnnnnnnnnnnnnnnnnnnnnnnnnnnnnnnnncgttgtgctgtgaattatgaattgatcgctctctcactctgcatctcactgaaacaaacagagtacagggatgcatgcaaatcctaatcaaatcaccagtgttactactagacctcatcacacacacacacaatgttcgtcgcacacgtggagcaaagcaaagcggcggctgacatggcgtgcgatgcaacgcgccacgtgtcactcgctcacgccttgtggtcggcggggacgtgccacacccagaactcctcgttccggcaagcagcggcgacggcgggcttcctcgggctgcccttgggcgacgtccggaggcggctgcggcggcggtgctgctcgtccttccgcgtccgccggtgccgccgccgggccttgtcgtcctcgtcgtcgtcggccgcggcggcggcgtcggcctcctgatccggcgcgacgaacagcacgacggggccgagggggacgtcgtcggtggcgacgagcagcggcttgagcgcgtcgacgacggcggacatgttggggcggttcttggggctccccctgaggcaccggtagg

SEQ ID NO: 14430 - DNA, 461 bp, Oryza sativa
  unsure (1)..(461): unsure at all n locations
nnnnnnnnnnnnnnnnnnnnnnnnnnnnnnnnnnnnnnnnnnnnnnnnnnnnnnnccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatg

SEQ ID NO: 14431 - DNA, 1989 bp, Oryza sativa
tatatgccgggggcttttgactctgagagatggcatgatatggagagttggaaatggggcggccattaatatctggtctgacccatggatcccaagtgatcatacgagacggccgatcacaccaagagggagaaatcttgtcacaagagtggaggaactaatagatccaagtacaggtagttgggatgttgagctgcttacacagactttctggccggaagatgttaatatgatccgtactattccggtgcacatcgagatggatgacatgttggcctggcactatgatgaaaagggtttgttctcagtgaaatcagcctataaggtgcagcgagatggggagttacagagaagaaaaaggggaagtgcaggtttgtcaaatgggagcactgaacgggagatgtactggaagaaagtatggaagatgcagcttccccggaaggttaagcatttcatttggagattcagtcataacattttggcgctgagagttaatttgcaacaaagagggatggatctggacagtagatgtataatatgcaatagaatgaatgaggatgctgggcacctgtttttcaaatgtaagaaagtaaagaaggtttggcaggagaacaacctggagattttgagacaggagctagcagaaaaaagatcgggaagagaggtgatggaaacagttttcaatcggccagcaaaggaaattttgttagcatcgattactttgtggcaatggtggtcagagcggaacagggtccaggagggggagaggggaagatccccgtctgaactgggcttcattatagctgccttggctgaggaatatatgaagttgaataaaaaagatagcaaaagagctccgagcagaaatgaaaagtggagcaggacagaccagggggtgatgaaaataaacactgatggagcttttgatcctttcaccagaacaggaggctggggttttgctatcagagatcactcaggcaaggttgttaaatcgggagcgggtaaagttcagattctgatgaatgctttccacgctgaagccctagcatgtgcagctggtataagagccgccagtgaatgcgggatgcaaagggtgacggctgaaactgattcaacgatgttgaagtcggctttggagaagaacacttttgcttcgtcagctcttggcgggatcatttgtgagataaagaactttgtaaattttgctttcctgtctttcaatgtaagctactgcccttgaggttgtaatagggtagcgcatgaaattgcagctctgggttgtaaatcggaagtccaggacattcttgggtgggatgaatgtcacaccctgaagtttcccccccttttcttgctttaaaaattggttaaataaattgcccgaagaaattatcttaattaacctagagctaaatccctaattaataaatgcatttaataatcgaattcggcgtggtggaatttttcttgagttccccatactccaatacattaagatgaattttagtggaattttcagagccttgaaaataattttaaccaattaaaattgagcaagtgcaatatttttaaatcccaggaaaaatcctttcccctttttccccttttcccttttcttttcctctttttccatcttcttgggccgtcggcccagtccaccccccctttttctcccgcccgcgctcgcccttcttcttgttgggccggcccatgcgcccctccctcctctctctgggacgccgacaggtgggccccacctgtcggtcgtctcccacctccggccgttgaagccggagctccaaccgctgccgccgaaacagccgcgccggtgcctcctccgctctttccgcgcccacgtggtgcctccactctgcgcccaaacctcgcgcccacgtcgccgcccctcccccgttcctcccgcccccacgcgcgcccgagagtgggcggggttcaatttgaatcccccctctctcttcctccccactcccccac

SEQ ID NO: 14432 - DNA, 3768 bp, Oryza sativa
ccccctctccctccccttgtgcgttgacaagcggggcccacctgtaagcgcagccacccctccccccttggatgacgtcagccttggaatttattgcgcaataaataattaagaactttttctttattagtaaaaacacggtttatcttctaaaattcataagtaattcatccgagcttcgtttaagtccattcaagtctcagtaaattcataaaaatccctagaatccattaaaaatggtttggtttcctgtttcagtagtcttatagcatgttttgcttgtgtgctttgtttgtcgcgtagatttcggccgtttcgtcgatccgcggtttctcgaagacgttgctgaggtctcatcagtgcgagagcaaggcaagtcatgcattacaattgatcatattgtacccaatttacaaatatcccgcatttctattaaatgtcgcatacttttacaatgtcatgtgagatgggtcctattactcagccatttattgttcatatgccattgataactttggtatcaaaatgattagatgttggtttaggaaatacttagccatgcttagctcaactagtacacaaatggggatcacattattacatagactctgactatgagcatagttttggattggtgccaccgcaatggtgttagttaattaaaatacaccgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcataggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccaggttcaccgtgattagtctcacccctagtttagcttaatgaactggtgtagttcaggtggttggttgggcatgttgcaacgtggtgtagcgttggacagtgattggttaatattgattaatttactacagctgttttactactttcaactactgcttttaaatgctagttttatgcagaagaacccctagcctcctttggttatatcctgcatcatacctcctcttccggtatgatttgctgagtacagtgggtagtactcagtcttgctctctgttcccccacaccagagctgaagatctttctagttggagctgtcttgttgaagttggttttgtcgctgccgtcaaggtttgcctgtggagtggagtcgtcccgctgctgaagtcaagcttcccggtttagctcgcttttatctttccgctgcatttgtaatcttttatatttttgtaagacgtggatatgtatgtcaacaattgtcgtttgtgtaccctggctggtcctggacagggatttaatgcacattcagcttagaaattctggttcgtgaatttctgggcgtgacaatgaagccccatccgaggtggacgatttggtgaccagtgatattactgagtctatggagtaatggaaatctttccatgtcaaaaaaaatattaaatttatttttcatagggaaggggctcacaatagtggcttgccattagagcccttgagcgtcacttaagcgttgcactaccgccaaagcctggcgcaccccaaccaaaactcaaatttcaaactttgccaaaattcatgtgtttcgggagtttcgttttggtttgatttgctacaagtaaattttttgtttggaagttttgatggatctaattgccaaagagatgatttttgagttttaaaagttaagtttgggcctgcaaaacttaaacttaaatgggcccttaagcaacaacgtcgctacctctcaacatcacgcctgccgatgaagcagctacgatgtttgacaagagcttccacgtacgacgaactagctatcacactccatttcgacgtgcacaaacgccatacatattttttgtgttgctgcgaacgctgcacgacctgcctagctaaccctactcaccatagacgtcctagtctgttgattcgtataaaatctcacattcgatcttagtcgccgtcgtaattaacagaggctcacgtacttacggtactagtaggacagacgacgatcgaaaggaacgcaatgcttacatctgcgcttaatagataggaagtggaaattctaccaaacacaactataatgctcgggcattatcgggttagagttggtgtgaaaacgaatcggataacatcttatctgatccattccaaatccgctcaaaacgagaatatggtacgagtttatagaaatccgatagatatggatgtggatgcggatagtgtgatatggattctgtgtggatgtggtatctttaaaattcggcggatatagattatctggtaggccgtttgctagataatctgaaattgtcaacccatgtaaccgctctatatgttaaatacatcaattaagatagactccttaatctatgggtctgtttggggagcttctagttgctgcagcttctctcagaatctccagctccccaaaacagtccaaattgtcacccagattatgagaatatatagttgtagaatccagaaaatgaactagaacccagaagctggaaaacccagattctcagaagctggctaccaaccaacagattctcagaatcttaagctcccccaaacagggcctaagactctcaccgtctcatcttacacttacaaaggttaaagcctgataataaatcaggatgttcttggcaaggaagttctgatcattgcattggcattccatgtttgtaggtagctcttattgagctggggaaagctactttaccccgaaatgcaagcactaggtaggccctttctagcttttggaagaaaaaaacgatgatgacatagttgtcagatacgcttctatggatgaaatagttgaggtggaatgttttaaggtttgtcttgacgatagcggaaaatgatgaaagcttgattcttgggattgagaaataactttttttcgtttgggattgccctctttcaacactaatactattatgactaaatcagtcttagctacgtttttatgttatggccgtcatgtattcatattgtttagcacttaaatatatagttatcacgatggattgtccattgattactctattgttgtccgttgctttgttaaatgcctaagttgatgttgtgttgattacatatacacaaaacatctgtcaaatttactccgattccgaaccaggtccacaccgactctacaccattttcaacatccgaaataatccactccatgttcgcatctgcacaccatccacacgggctgtgaatccgctttaaaaatagagtaaatttcataaaactatcagtttgctgcaacattagcgacatgtttcagtttgctgcaacattagcgtaggaaattatcataaaactgtaacttttacgttatatgctgctacagtatataggtatactgtagcagcacatatatactgtagcagtatat

SEQ ID NO: 14433 - DNA, 890 bp, Oryza sativa
  unsure (1)..(890): unsure at all n locations
ctctagccagatctagctggcggcggcggcggctgccgacggcagcagtgacggtggtgacggctgtggcggcatcgactgcgacggttggctggcgaggcaacggccgtggtggttgaggcgtcgtggaggcggtcgtgcggcctcgtgggtggcgaggcctgctgtgcaggcgtcgtggaggccggcggcgtgtggttgtcgtggaggccagcgtcgtgcggcagcgggagggcgtcatggaggccggcgacggtgtggagtcgcgaccggcgacatcgggtgctggtggctgcaggctgcgatggcggacggcttgtggcattggccgtggcgaccgtggacgtggctgcagtggaggaggtgaggatggcgacggcgaggtggctgggcattcggcagcagcggctgcggtggcggtgaccacggtcaccggaggcatggcggcttcggacggctagtcgagggtgtggcagacggctgcatctggccagcgtggcatcgtttggaggaggagtcggaggccagcttggcgcagagaggcgcagctgatggcagcggaggccgactcagcgcgagaggcgcgggcggcggagaccgaggtcggcttggcgtgagaggcgcagccgatggagggaggccggattggcgcgagaggcgtgtccggtggaggaggccgacttggcgcgagaggctcggccggtggtggaggaggcgacctcggtgtgaggaggagctgccggcgggtgtggcgcggtcttcggcacacgaaagctggccggctggggacgccggtgcaggggtctcacatgtcggcagagcttgagtggtggtnnnnnnnnnnnnnnnnnnnnnnnnnnnnnnnnnnnnnnnnnnnnnnnnnnnnnnnn

SEQ ID NO: 14434 - DNA, 694 bp, Oryza sativa
attgtgtccaagatccctctcgatcggtgtttttcccccataatcaggttatgccattgaaccaaaaccatctatcttttcatcaagtagagccgatgcttgatcaagttgaggaaattaaagatgatagttctaatgataatgtcgcctctcttgattccaattgtatccaagatccacattatcaggacatgttattgaaccaagaccacctatctgtccgtggggtagaaccgacacttgatcaagttgaggaaattgaagatgattgttccagtgacaatgttgcctctcctgattctaattatgacaaagagaagaatgacagtaacaaacagaagccttctaagaaggtttctcaactcaatactttggttgctgcaggtaaagacaaagtagattgctcaactgaactttcttagatgatcgtccaatggatgaaccattccttttcttttgaaacatgcacaatttttaatcttgcatttttattgccttttattaaacataccatgtgcctaattttagaatttaatattctcatcatagcctgaaacattgttgtaaagattttaatgcaaaacatgcatgtcttggtattgggtctatgtttgaattaaatattgtattacatggttactatagttatcataagtagtcatatatatggtcccctatgcccttggggggttgg

SEQ ID NO: 14435 - DNA, 592 bp, Oryza sativa
attggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcagtaggcggacagataccagtatccagtacatcgcatgccattcgcatgtaccgttccaaactcctccatctcacacacttttttttttcccttcaaaacgcagtagagacatacaaattcgttttttttatgggagggaggagtagatgttaatcgtgcgtgcatattt

SEQ ID NO: 14436 - DNA, 1866 bp, Oryza sativa
gcagctcctcctcctcccccgctggaggccgctgtcgtcgcccctgtccttcgcgcgacccgccacggaacgcgtggccgcgaggcgagcccgcgccgccgccgtggcgatgaagttggtggaggacgccacccctcccgcggcgggggcggtgcttctcgccggggcgcagtcgaggcacgcgatattcagggacgagctcgtgaggagggctatatacgccgccgaggcggctcaccgcggccaggtgttcgaccgtatcccaccctccctccctctcgctctttagcttctgacatgttgaagtgaccgaggctgcttgtgtgtgggggtggggcgtttggtttcctcagatgcgcgcgagcggtgacccttacctgcagcactgcgtggagacgacggcgctgctcacggagctcggcgccggccccgccgtcgtcgcagcagggctgttgcacgacacggtcgacgacgcaggcctcggctatggctcactctccgtccaatttggcgctggtgtcgccgaccttgtgaagggggtaattatttcgatgattcgatctctcgatgattcgatctccttagctactactaactgttatttggatgacatgagcatatgcactagaaaattatatgctgaagctattttctcttgcaaaacttactgaatgtaccaaattgattccagcatgtcaacaacattagtaattagcagatcagatattttattccttgctcaactatttttgtaccatcatatgatctgcataaatttccctatgtttgagcatagtataatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtaggtttcaaatctaagtcatttgagcaaactggctcgtagaaatgatacagccagcagagtagatgaagctgacaaattgcgtacggttttccttgcaatggaggatgcgagagcagttctcatcaaacttgctgacagactacacaacatgaggacgttggattctttgcctaaggtcaaacaacagtgctttgcaaaggaaacgctggagatatttgctccgttggcaaatcagcttgggatcttgaattggaaggaacagcttgaaaatctgtgcttcaagtatctttaccctgagctatatgaggaactgtcatccaaccttctcgagttctacaaccaagatatgattgcagctgcaataaggcgactggaacaagcccttcaagtgaggggactatgctatcatactatatcagggaggaacaagagcatgtacagtatctacagcaagatggcaag

SEQ ID NO: 14437 - DNA, 19545 bp, Oryza sativa
  unsure (1)..(19545): unsure at all n locations
ttataggaagaaactggacatggatgaaatctatgatatacatggggtgcgtgttatactcgataacaaagctgattgtttcaccactttagagattgtccatcacttgtggcctagaattcctggcaaattcaaagactacatcaacagccccaaacccaatgggtaagactctgaaaactaatactattatgcaaaaaaaaagagtaagtcaccgtgataactgtatgcttgctaacttgtaggtatcaatccctgcacacggttgttctcagtgaagaaacactgccattggagatccaaattcgtacgagggacatgcatttacaggcagaatttggaattgctgcacattggagatacaaggaagctgttcgaaattgttgttcatctgttcctgaaatggtggaatgggttagatgggttgttacatggcagtgcgaaactctgcacatagatcacccttcctctcttacacatggagctccaccaagggcaatatgcagttgttcttctcagtctgatgactgtcctttttcgtattcaaaacgatgtgaccacagtggaccaatcctagtaatattactggagaatgaaaaggttggtaaccttttaaattatttgtatgttccaatgtttttttttacctgttgcctacctggtattgttgttgagcaaggaaactaaatttctgaatggtgctttcagatgtcagtgcaagaattccctcaaaattcaactgtactggacctactgaagaggacttctagctatgacatgcagttgaggttaagactgaactgccatgtcgtgcacaacttgaaccaagagcttaaaatgggtgacgtggtcgaactgatccctttggctcaatgcaatcctggagctggaggttatgcgagggagttccaccaaatgtatgaccaccggctcacagtttcgcagtcgtgacaactctaggataccaaaaactatgtacatatatatacatgacagattgacagcccatcaagatcgtcggaagtttaggtttccctttactgacaaatagaagcactactcgggaatcatctgaaaaagatcaaggaatcgtttccctgtgccaaatgcgcgcgcgtgtgtgacatatcttttacatttgtgtttgtttatatgttaactaaagaggagtagagtgtcaatacgtgaaacatttctggagttttagtccaagaaatgatccctgtttgggacagtgtatcattgtaagcttctatggctgtgcaatgtgtgacgtttcttcaactgaaatatatgaaaatatatgggtttcctgcctgcatctgcttgctctgactgatatagcatactacttactaacccagatttgaagtgcagctgagtttaaccacttactgtcacatggaacaaacgaaaagtgtatcattgtaagcttctatggctgtgcaatgtgtgacgtttcctcaactgaaatatatgaaattatatggctttcctgcctgcatctgctattctgcttgctctgactgataaagcatagtactacttactaacctagatttgaagtgcagctgagtttaaccacttactgtcacatggaacaaacgaaaaataagtatagggagaatagatagggagaaaggagaaaaaaaatataagttaagggagaaatagatagggataaaggagaaaaaaaaaagtgaaacgacgcctgagagatttgaactctcgcggggaaaccccatgtacttagcaggcacacgctttaaccatttggcaaaagcgtcgtgtgtgcttgcttgcacagcaatactttctatagcatgttcaaacaaacactaactcactaaatagctctggattagcacttaacgcattctcaattctggttgtttgctttacaattggtttgcacttggcagattctcaagacattaatctgacgatctcagaacatgctccaagagcgtcaggcggggaggaggagncnacgataacagttgaagacattgctttgcttctcccatttattaaaccccattggtttggattcagaggttaggacggagatggatagagattagggaaatcgcagcaaggtgaggaggaagaatagggctaaagatcatggagacaacaaagctgaacctagaagaagagatgaagcgagcaacaggtacgcgagcacaattcatcgctggactttgcgcttttggcacttacatttgaggttgctgctggtgctccagactgtcagcaatgtgtagtacgctggtgtgttcttcgtccagaggagtagacttcgaagtggttaatggacggcacatttcagattttcactcaacaaatcctcttgatcgcacgaagtacgaaccactattctgcattccggacatctcctgtttggctggctccatggcattagcggttcttcctcctcaccttgctgcgattatctccgtcccagcctctgaatgattgttaatccaaaccgataggtttaaatggcagaagcaatgctttgtcttcaactgttatcgtcgcctattgacgcttctggagcatgttctgtagttctaggatattaaggtcaccttaaatactaaaaaatggtttgcaaaattaaatgtgccaatgaatcgtagaacaaacaattaaaactgctacatgactgtggagtaccattgtttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctccttcttctcctccccctgtggcggccgcctccgccgccgccgacgagccgcgggacctgcgcgtggtgcgggagatcctccactcgctggggctccgggagggggactaccaggaggcggccgtgcacaagctcctgctcttcgcccaccgctacgccggcgacgtgctcggcgaggcgaaggcgtacgccggccacgccgggagggagtcgctccaggccgacgacgtccgcctcgccatccaggccaggggcatgtcctccgccgcgccgccgagccgcgaggtaattgatttgagcccgaagcccctcttcgcttttgtggaattttttttcgccggtgttgtttgctgcggaggacatcgaattttccatcgtcggttgcgaaatcgtcaggactgcgtggtttttggggttggatcttgcggttttgtgtccaaatcggagccttttagtcttaggaataggtgaatttctgcaaaaacggaatccttttgccttcggatcaggggatttgtgctatcaaggcagctcactaaccctttagcctttggatcagtgtatgttatacagatacgccatttgtagactaagacccctttaattctaaggatttattgagaaacttcataacatttgaaaaaaaaaacatgttacaaaagcagacactcattcacccctatgaacacaaaacctatccttatgaacaccccctaaaagactgaaccggcatgtgttgtgattcatgaagtcaccacaaagatgtctcgctatcaatggatatgttgcctatcaatgaaagaataattaatcataaatgcaagcacatgtaagtctagaacttgaacctgggtaggctgattccaccacaagaacctaaccagttgagctacgctcactttgctcctatttggccctttgatataaaggattggagctttttaaatcctataaaattcctatggaatgacttattacatatagattttgaaaaaaattagcaagatctcatatctcttggaaaattttcttcgagtctatttctctcttctgatacatgcatttttttcttgtggtttataaatcaaatgactattcctgtctgttttcctgtgctttatactttcattcctatcaaatttcgtgcttttcctattctccgttttttaatccaatgtttcaaaggagctttaataggtgtggatggtatacttttttggcaagaagatgatataactaaattaatgctgacaagattttttctttaaaatacttgagcttctaaccctacttaattgtcgagtgctctccaaaattcacaaagccgcaataccaaattggaaaccgctctttagcagttttcttggtttttgtgaaaaattgataaagaaatgatgaaattcagatatatttcatttaaaattggaaattcacttggttttctatttgactggttaacaaagctgttttgttaactcaagccagttcaaaacctcaaaattgcatgaaaatcaagcagtttttgttggttttgtaaaccgtgttggtcccttttattaaattttaatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagataggatcacacttgggttggaggaggttgatgtttgtggcaaaaaaaaggagcattgaatgtggctctggtagcaaaagaagaagatcaatcacaagcataggtaatttgatggcatcaatcaatgtaaaaaaaagataaaatagcatatgagagggcaaaataaggaagtgaagctagaaaataagtgcaacaaaaggagaggcaattttttacaatggaaaataaggggcacggtcaattatagaggaaaaaataactctatattacttatcttttttttaattcataaacttcataagtagagctaaaaatatgatatgatgttttgggggttatatatgatgttttttagccaaccatacattgtcatgtcaatcctagaagtctcttatctattcttgttcaaattgaattattttgcaacgtagaaatgctcggttgggcctatacaaggtcgagaaagtgacctaaactagccaccctaacatttctattatattatgcaacaaaatcatcttaagacaagttgtttttttcccaataagccagcccattaagggctttttgtgggtctattcttaaggaattttataagatcctatgttcaatcattatttaattggttgctataacgtccatatacacatgaaaaaattgtcgtaacatgacggatatcttcactttggacaggagatgcttgatatagcacataaatgcaatgaaattccaatacccaagccttgtgttccttctggatcaatctctcttccacattatgaggatatgctattgaacaaaaaacacatatttgttcctcgagtcgagccaacaccccatcaaattgaggaaactgaagatgattataatgatgatggttccaatgctaatgttgcctctcccaattccaattatgaccaagatctttttggatcgatctctcttccacactatcaagacatgttattgaaccaaaaccacctatctgttcatcgagtggagccggcacatgatcaacttgagaaaatcaaagatgatggttccaatgacaatgctgactcttctcattccaattatgtccaagattcttctggatcagtgtctcttcaacatcatcaggatatgtcattgaaccaaaaccacctatttgttcatcaagtagagctgacgcttgatcaaattgaggaaattaaagatgatggttctaatgacaatgttgactctcctaatttcaattgtgtccaagatccttctcgatcggtgtcttttccacattatcaggttatgccattgaaccaaaaccatctatcttttcatcaagtagagccgatgcttgatcaagttgaggaaattaaagatgatagttctaatgataatgtcgcctctcttgattccaattgtatccaagatccacattatcaggacatgttattgaaccaagaccacctatctgtccgtggggtagaaccgacacttgatcaagttgaggaaattgaagatgattgttccagtgacaatgttgcctctcctgattctaattatgacaaagagaagaatgacagtaacaaacagaagccttctaagaaggtttctcaactcaatactttggttgctgcaggtaaagacaaagtagattgctcaactgaactttcttagatgatcgtccaatggatgaaccattccttttcttttgaaacatgcacaatttttaatcttgcatttttattgccttttattaaacataccatgtgcctaattttagaatttaatattctcatcatagcctgaaacattgttgtaaagattttaatgcaaaacatgcatgtcttggtattgggtctatgtttgaattaaatattgtattacatggttactatagttatcataagtagtcatatatatggtcccctatgcccttggggggttgattttggtttccattaaaatctacatatgatgaaaacttgctgagctttttagcttgttttcatatcttatttaattatcacatgagcataatacatattgaataaaaaaaagcaaaatatttattggtaatgagtcgcatgtctttttgtgaagtaccacagttgttccatttgaatattagaatctacaagtttcatgaaaactgtgttgaggtgagcaaaaatactcaaaataaaagtgttgccttttgggttgagttaatgcactaataacttcaaagtaaggatgtgtagactggtcaataaccggctactagtgttgtgtttaggatggagcgttcatcatgttataaccaatacatagtttgtctagttacttaagaaggttctaaacatgaggttaaaggtgatcttagcaacttatgcaatttggtctagatattgaatgattttgagtggtttggatgagcattcatacaaacttggctgagaaagtgctattataggggagggttaatgcaagtaatgttgcatttcgacaagcgaaccaaagagacgatattctaaaatctaggaagccaatatgaggaaatgttgagtagtggcgtacaagcaaccaactagaaaagaaagatatcttgaaagtagagtgatcagggtcgacattgtgtaggaaagattataatgaaatggaaaacatacgaagaaaaactaggtagatcacgagggtgaaaaggtatgaaaaaatggagagagatagagggaaatgtgctaatagtagatgaattgttgtgacatgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctttttttagaactacttcaagcctaccatcatcgagttatgcctggtgtcgtggcagctcggtagagccatgatatcgactgcgcagcattgtcacgtgtgtcatggatctagctagcctgcctttggtgtgttggtaaggcttgaggccatggggctgcgggttcagctttgtggtgttcttgaattggtggttatgtctggcacatagggtggttgtgtgtgaggatttgattgtggaatgacgaaagctttgtcaaattcttgcaagctttgatgacggcaacaatcttgagcgtcgtcacgacatcccatttctccacacaagtttccatattagaatcttggtccgatttcccaaacaagcaacggcgacgtgagcgtccccatggaattgttgctttggagaatcttcttcctatgacagtggccattattaggaacttagtggcatcttggaccatcttgtggctagggttcaccttttcgtatcggaaattatacccgcttatcaacggtttatagaaacccgataaaaaccaacaactttcggtcaacacggtatgaaaaccagctaaaactgaccggttttgaaaacatagcagtgtgcacgtgttttccgtgtaacagacaaaacaaattaggtctaatgtctagtttcacgtaaaaccgttttgttctatcttcttgatgaaaaggctatcttttgctatttaactttggaaattgctatgcatatgacccaactgtccgactcacgtacgattgaatttgatcaacggttgtaaacggctgcagtgtatatgaatatgctatcatttgattgatctataattgcttgtctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccggcccgcccctgcactgcaccaccctctcgccgccatgccgtcgcttgggatcgcgccgctgctcgacgcctacttccgccgccgcttcgccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctcctcttcttcggcggctccggcacagcggccgccgacgcgcgctcggaggcgcaccaggccgaggcggtggcgaagctcgtccccccggtcgtgggggcggcggcggcgcgcgtgtccgtggcgggcaccagctacggcggcttcgtggcgtaccacgtggcgaggctgctcggccccgcggccgtggcgcgggtggtgatcgcgagctccgacctgctcaaggccgacgccgacgaccgcgccctgctccgccgtggcggcgccgagcgcgtcgagaacgtgatgctcccgcgcacgccggagcggatgcgccggctgctcggcctcgcctaccaccgtccccgccgcttcagcttcaccccggccttcgtgctccgggacctcgcccaggtaacaccaccaatccaatccaccatacattgctgcctacatttgctgaacaaactcgaacaagttcttgtgcttgccatgatgccatctgacatcgagatcaagtagttcttggatcatctggatgatccgtgatgtcacctcatggaagtgtgacgtagcactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctgaatttcaacaaacaacaggcctacctgtcacctttccccaacctatccgagctggattctcaaattaactcgtcgtcctttttcacttttttaagataaaatgccttattcattaattgttcctgagagtcattatctttgctgacagcctcttgactttagtaccagtaacttgttctctaaaagaatataagaaatagtaacatttaacactgttgcagtatctctacaccgacaaaatagaagaaaagaaagagctgatcaaggggataacactgggggacaaagaaaaattccagctcactccacttcctcaggtatgcatagcatttagcagctgacaaataattacagaagtgctttacttgccaagtttacctttatcaaatgtctctgtctgtctaatctttcaggaagttcttgtattatggggagagcatgatcagatatttcccatagagaaggcatttgaagtagcaaggtcagtacttattccttctaatataattgcattattaatacatatgaagcaaaacttttgccctctttttgtttaaaaaaaaaacagtagaattacatgttgaagttgcaccttgtaatgttacttacacaagatgaattaacgcaaatgcaggcaacttggtgcaaatgctaggttggaaatcataaagaacaccggccatatgccacaggaggaggacccgaaacggttcaatgaggccctcctgaacttcttgttaccagctccaaattcgtcgttgtgatggggatatcaatgccaacttcttgagcggctatctgtggagagtacttgatctaagttgtacattgtcttatggcacagggtaaaacttgtaccttttgagataaaagtgggaaatatgatatagagtatatgcattgtttttcttctcatatacaaaattgggttgaatcctctgcacttgctagtttctacagtaaaataaggggggaaaatgaagttccctggatttaataaggggaaaaaagccgcctctaagaatgaggggttacatacattaaaccaagcactggtaaaaaaattctattctgcgctaacttatgcgacgcctgatttgtcggacccagccaacctttacctcctgaagtaagaggagtttcgctttgatatcttgtgctaaggctccataagctgatctgttgagatccctcccctcaagcattctcactacatctggattgtctgtctgtccgactgtccctaggtaacactctgacttccttggcctgtttcaattgctctcttgcatgcaattagctcagcaaagcaagcatcctcagccgggatgatggaagaagttgtcctgcaccggatcggatcgacaagcgctcttggcgcgggtggtgatcgaatacgctctgctcgggtgcggcggcgtcaagagacgcgatgcttttgctgacatgatatgtaaacgatgcaaaatcgtattagtgtgatcattagggaatgaagacaaaagtgcaattaaaatgcttgtcagcatcacctctttctttctttctgactagctgctttttgtctgcaactcggcttgacgcattgctttgtcacgcattgagaatagttcccttctcctctgttctcatccaaagaatgatgaaaattacattatgttccccccaaaaatatggtgcagcttgttggaaagatttatgcatgaagctaagccttcatccacactatcttatgaggattgctaccgtccagcaggttgtaccgggcggtactggtaccgcgcggtaccaagacacatctaaccgttgaatccgggatgggtaggatcgggagagaaaagatgagcaagggtggatgagggagtacctgtttcgagtcgtcgttcccggcggcggcggcgtccaagtcattgtcattcccggcggcggcgcagagcaacaagggaacgctggcagcgcgggagaggataaagtctggcggcggcgcgagagagaaaaaagggaacggcggcggcgcgggagaggaaacaagtccggcggcggaagaggaacaagtccggcggcggaagaggaacacggcggtggtggcgaggaagaggaacacggcggcagcggcgaaaatcatccagcttcgctagggttcaagccgctcgatctcgatccagacccatctattgcacgcgaaattacaatactgcccttccaccgattatcatcactcggtaccgcttcggggacaaaactggtaccccgcggtaccgatctacgccagccgttcgatctgcctcgatccaacggtcaataatcggtaccgcaaggtaccgttggactgtaaaaatcctcctatcttataccacttgcattggagctaagcttcagcgagttcggtttaggattagactatggtactacaaagagtgactgagtgaagcaaaatccaaacagcaaaagtatttttcatatgtactagttacacagaggtaaaattaatgcatctcacagtttccttgaaaaatgcatcttgaagctaatgctaaagcattaaacactcagggttttaatgttcatgcatgatacagcttttctttttatcatatgcagttaatattaaacaagaacaacaaataataactaacaagaacagatagtgtcacacagtattgcaatgcacatttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaattcgctaattataaagcggcatatatcatgcgaacttatagataaatatatgattgcaggcttccaaattaaacaagatctgatactccttctagtggccatactgaatgaacaacaatacttgcgcagataattagggatagacattgagtaccttcttcacggcctcgcaggcattctcattatggcgaatatcgttaccccgagcaatcatagtgtggacgtgatcgagatacccctcccagtgtgattcatcagccagagtacccagtccgtccaactcttcttggctgtagtccgcgagttcgttaggggctaaaggggcaagtaaagagcttcgcgttccgcgctcggcgttgaacttgtcaagggccttgacaaccttcttgaaattctcataccgatgagccttctcctcctcggttctgtatctccggccgtgctcgctcatccccagtcctcaaattttgccttcatggtcacctcatccaccacattgtcctcctcggcggcatcatcgacgacggcctcctccttgtcggaacacttcttgtcatagagtggtttccccccatggttcatttgggagttgaggtaatcgatgtagtcaagataggcaaatgtgccatctttcctggtgaaccttgccatgacggatggctcgatcacgtccctccaattaacagtcacctcctcctcctccttcctggtctcctccccggctgctacaggtaggaaacaaattggagctagcaacgacgaggaaccgaatctaatctaatctaatggcgctttctttcaagaacaaggcatagatagatacctgagtcatctctatcttgcttgaaatagaggaatccgagcagcaatccagccaacgaactcgtcaaggcaagaacacctttcactgcgccacggccgacgccgagatccctctgcgcggagatggacgggagcgtgagccgctgcgcgcgagtgaagaaaattttgatctgagatctgggggaaacgggagagcgtggtgctggactactccccgccgtcgccgccgccgccgatcgctgcgcctgcgcgctgcgtgcggagaacctccgggtgaggaggggagcaagggcccggaggaacatggacatggcctcgatcgatcgatggaatcgctcacctccgccgcgcgtcgccgcgatttctagggtttagtgtttgacggacttcgccgcggatgcgcacggtgtcgaacggaattccgacaaaatccgatcaaattttgtcacagtttaaaactcgatcagtttgaactttgaagaggtcgcatgggccttgcgcacgcgcaaaattgggggccgggccaagctctaggggttacaaccatccttatttgatgggccaatatgggcttctaccttttgtctgactgccaactaaatgatattgggccgagatgttctcctactagaggcagcccaacagatttatctcgaccgaacaaattcgatccgacggttgaacagatttatctcgtccgctgttacattgttttttttaatggaaaaacctgtcacattgttcagctcatttggatattacatggaaattttctggcagtgatgagtacaatcatgtaatcaactgcactaattgttcttgagagtcattatctttgattacagcttcttgactttagtatcagtaacttatttatcaaaaagaatgagtaacagtaacaggtaacactgtgttgcagtatctctacaccgacaaaatagaagagaagagctcatcatcaaggggacaacactgggggacaaagacaaattccatctcgctccatttccccaggtattccatagcgattagcagctgatgaataattacaagagtgctttacttcccaagtttacctttatcaaatggtctttgtctgactgtctcacctttcagcaagttcttgtattgtgggggagagcatgatcagatatttcccatggagaaggcatttaaagtagcgaggtcggtacttattccttctaatataattagagtaatacatactctctccggtttcacaattctttaagatttgaaccacataatcttcaaaatacatatttaactataattttctattataatatttataataaataaatatattttacttttattataatactttgtaatgttgttttactgactttgaactaagtacttttaatgttattgttcgttaatgatataaaagtttgaatttaaccctgtccaaaacatcgagtattatggaacatgatagagtatgaagcaaagcttttgctctctttttcaaaaaaaaaatattaaaataattgcaggggaattacatgctgaggctgcaccttgtaatttcacttacacaagatgaattaatgcaaatgcagaacactttcgtgcgaatgctaggttggaaaatcataaagaacaccggccatatgccccacaggaggacccgaaacggttcaatgaggccctcctgaactcttactaccagctccaaattcattgttgtgatgggatatcaatgccagcttcttgagcggctataagcacttgatcaaaatcatatattgtctaatgatacagggtaaagtttgtaccttctgagataaaaatgggaaatataatatagagtatatgcactgtttttgttctgatatacaaaattaggttgaaatcctagacttgctagttgatacagtaaaacaaaggggaaaaatgttctctggatttaattttgagaaacagctgcaccctttattagtggttgtaggcacaataaaagactaagaacgagggggtaaattaaaccaaatactggtaagaattttctatgcagctattctgccgtaatttatcgctgcctgatttgtcatttgtcagaccaacccaacctttacctcctgaagtaagaggagtttcgctttgataccttatgctaaagctccatacacttatctgttgagatccctctccagaagcattcacgtactacatctgcaattatgcattgtctgtctgtctctacgataaaccttgacactccggacttccttggcaagttcaattgctctcgtcaagggacacgatgattttgctgacatgatctgtaaaagaagcaaagtcgtatcagtttgatgatcattaaggaatgaagacaaaagtacaaattcaaatgcctgtcagcatcacctctttctttccgactagctgctgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggtgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgccccggcatccagcccagagaaggacggcttcgccaggtccagttcgcccccgcgagggccgaagtagccttctcggcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14438 - DNA, 687 bp, Oryza sativa
cgagctcggtacccccttcgtatagatctagcatcagaagttcagaaactacttggtaaaggccttctgttcatctgaccatcaaattgtccatatatataaaaaaaagaaggaactgcagatctaacagaacaccaaaaagttaaacaaccttaataagatcgatgttattacgagcgtatttcatacagaagaagaaaaaaaaaagaaaacgtactaagtacaagaactgaagaacagtgtaatctgaaaagtaccttgtacctagcatgttctactatttacaagtcgtatgaacagatctagtgaaaatcaccaagcatcaatcaaggacgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggtcttgacgacgagcccttttaccaccacctttaccccccgagcaacgccggcgcgcgcgtcctttgtcggaacaggcgcacgggcggggaattccgcatta

SEQ ID NO: 14439 - DNA, 512 bp, Oryza sativa
aaatttacagttttcaatttttcaacggacaaagcgacagcataaacaatggaaaggaaacacccataaccaaacgaagataccaaaccaactccaccataatcttccgtgtaatcagttaaaaacattaatcaaatcttccgtgacaacgatccatcgaatcaaacctcccccccatcccgttaatctcaccgcctcccatcccatctcatctcatcattttcatctccacaaataaactcgtctcgctcccttgcccacgccggcgcgccgatcgccttccccccagatcaatcgaccacaccaatctcctcctctcgtcggcgcagccggaaccctacctgaggcagacgccgccgccgccgcatcccgcgtctgggtcatggaggggttcgctagggcggtggaggacgggctgaagctgtcgaaaaggctggtgctgccgggggggctgccgccgccgaggccactggcggggatggaccgccgcgtttgggttgggggtgggggtg

SEQ ID NO: 14440 - DNA, 638 bp, Oryza sativa
cgaattcgagctcggtacccaaatgggcttaactcgggttattttatcgcgtgaactgtctttagaggaaattgctgaaattcgtcaacaagtgccagaaatggaattagaaattttcatacacggtgctttatgtatggcatattcaggccgcagtttactttctggttatattaataaacgcgatccaaatcaagggacttgtaccaacgcttgccgttgggaatataaaattgaagaaggtaaaaccgatgaagcgggcaatattgttccaaaaaataccgtacaacaatatacacctgaaattcaagttaaaaacattgcgccaaccttaggcgaaggtgctcatacagataaagtgtttttatataccgaacctaatcgaccagacgaacagatgaccgcctttgaagatgaacatggcacttattttatgaattcaaaagatttacgtgctgtgcaacacgttgaaaaattaacgcaaatgggcgtacattcattgaaaattgaaaggcgcacaaaatcattttattactgcgcacgtacagcacaagtttatcgcaaagcaattgatgatgcggctatgggcaagccattccacccatcattgatggataccttagaatcacttgctcacc

SEQ ID NO: 14441 - DNA, 349 bp, Oryza sativa
cttggctcccttctcctcttcctcctcctcctcctccgccaccacccccataaccggacgcttgtctagggcgcccacgagaccaccacaaccacctccgtctcccccaccttcgccgggagagaccctcatgaccggggagtagggaggaaggtggaagatggagagaaagaatcggagagaaaggaggaggagaaacggatctgtggagaagaaatggatctcgggtgtatcccgtccccacgagattccgtccactagtttttctcttttttctaggttgatttttttaacggagggagtagttttcttgtttttattatcaaattactataccggacattctatg

SEQ ID NO: 14442 - DNA, 406 bp, Oryza sativa
aaaagcgaattaacttcggccgaagcaaaaattgaagaacaaaaacagcaacttgagcgacactttgaacaatcagcgaatttgttggaaaatttagcggaagattataaaaaactttatacccattttgcacaaaattcagaacagttattacccgagtcaaaccaagttgaattttttaaacgactaaaaaatcatgctaatggtgatgaagataatcaaccacgcgattactcagatggatcttcgggtttacttaaatcataatggactaaaaatagcttgtttagttaactaagcgggctatttttagcattaatgcgctaattcagttcataaactgcatttaaggtgttttttttgatgcgctgatagtgcagtattttgtttggtgggtaccacaaat

SEQ ID NO: 14443 - DNA, 9128 bp, Oryza sativa
ttgatactattttaaattatattatttttgataaaattgtcaaaggtgtgtatacatttagcttcttgccaaagtttggtaaatacataaaaaaaatcctgccaaaattttggtaacattatcaacttaccgaaaaattgataagggttattttggctacaatctgattaagccctagtttttttttctaattatacggatgacgcatacacatcttacgtacattcctgattacactgaagacacattcacaccagtgtacattcttgattacatggaagatgcatacacatccctgtacacccgcaccacactcgtgcctgttttacacctcgtattagtaaacctttagatttggaaagttaatatactcatgcatttgcataggtgttaagccattagcttcttttcttttaaaatgaaaacacatactcgctcggttatacatgtgtatcacacttacatacctattgaaaaccttatccgtgcgtgcataatattcgtggagaaccaggatttaaacatggtcaactccaccatcaatgttagtgttttctcatcggtttgtttcatataatggacataagtaatgaaatatatccatgcaaatccattagatgaaagtattttttttctaagatgtggtcagtgcttataacccatgatagtatggaaccttgagaatgtgacactccaaagcacatgaagggcccctttgatttgtaggaaaaatgtaggaattttggaggatttcaatcctatggaaaaaaatcctatgaaggcctttgaaacaaaggattgaatcctattcaatcctttaagggattgaatcctattcaatcctttaagggcccttttaaatcgtaggattgagaaaacgtaggaataggaaaaacgtaggattttgataggaatgtaagtgtaaaacatagaattgcaaaacgcaggaaaaacacaggaatgatcgtttgattgaaccgcaggaaaaacacatgaattggatgagagagatagactcaaaggaaagttaccaagaggttctacctcatgttaaatttcctccaaaacttgcatgggaagaggtattccataggaattttataggattttataggatccattcctttgattcaaagggctatataggaaaaattcctataggaataaaatcctctaaaattcctatgaatttcctatggaatgggtaatcttatgcatattttggaggaaagttagcaagaggtctaacctcttggaacatttcctctgagtctatctctctcatctgattcctgcgtttttcctgtggtccaatcaaatggtcattcctatgtttttcctgtgttttgtaatcctctgttatacaattgcattcctgtcagaatcctgattttttcctattcatctatttttttcattcctacgatttaaaggggcccgaaaattggacattggcgtctcatggttagcttgtgcatcataggcatcacctcgtacacaagctaaaacaaaaatcctgcagactcccggagaaacaaaaagaaaatcaataaaagctaagagcccctttaatttatagaaaaaaatatagaaattttggaggatttcaattatatgaaaaataattactataaaaatctttcaaacaacggattgaattatatcctatcatttcctatgaaataggtaatcctatgaaaattttggagaaaagttagcaagagattcctttgaatctatcttttttatccattctatggtaagtgttttttatgtggttcaatcaaacggtagtttttatattttttcatatgttttacaattatctgttttgcacttatatttctgttagaatcatgtattttttttctattcctctattttttttcattactgtgatttaaaagaggctttaaaatcccattgggtaaattaaacaatcgtaagtatccgtcagcagtgtgaccatacatgatttaatgtaaagttgagggtgtcttgggcaaagatatggcgcaagaggatcagcaaagcaaaacactgggaaaaggattagaacgacgacacggtttcagtggaaactccctcccctcctcgtccacaagcggcgtgcagaaacggcgaaacgtgcccgctcctctctgtcacgtgggtcccgcggcacggtggggcccgcgcatcatggaccgataggaggaaagaggacggcggccgtttcgccgggggaaacggacggacgagagacggacggcgtcgtctcggttgcttgtgcgtgcggacgaggtgttgcttgccggttcggcaaaagcatcagcagaagccggagatgaaacgggcggctttggcctggcttggctaatttccctttgctctttcctttacctcttccgttcactgtcaggatcagatcgttgcgccgtgtttcttcgatgacgactccagaaaacgaccgtgatgtgtatataaatattgcttcaggggatgagaactgtagtatgtagtatgtactagtgtgtgtttttctcaagcacaaaaatgtgtgagatgaacaaagtaaacgtacctcaactggttaggtctctcatagtgaaacatgtccattcgagtttaagttctaggcttgataaggatattcgtatttatactaattattttttctgtgataaaccgtagaccattgagagcgagaaacctatggtgatttcatcgatatgaagatataatgacctaatcatctgagatgagatgattatagggatgtagattgtgcatgtgtattatatgaataaatatgcacgcacgattaacatctactcctccctcccataaaaaaaacgaatttgtacgtctctactgcgttttgaagggaaaaaaaaaagtgtgtgagatggaggagtttggaacggtacatgcgaatggcatgcgatgtactggatactggtatctgtccgcctcctgcatcggccaaccgtgtgcacagtgatagcagcagcatgattgcgaatggttgtgattcagtgtcggcggcaatgatggccggccgggccctgcgcgccgacggaggaggatgccccggtgaggccggccagcgatccagcggcgctcggttgcaacctctccaacgctttcaaccaaacgtgcaggcgcatctcttgcgagcagaagcatcaacggatcaaaaccaccacgcactgacgttctcgattctgcaactctcccccagggagtttgtaaggccccctttgattcaaaggaaattcatagaaattttagggcccctttgatttggagaaaaaatataggaattttagaggattttaatcctataggaaaatttcctataaagccctttgaaacaaatgattgaatcctatccaattctttgaaattcctatggaatggataatcctatagagattttggagaaaatttagcaagagcttctaacttttctttgagtctatctctctcatccaattcctgtgtttttcatgtggtttaatcaaacggtcattcctgtgttttgcaattctctgttttatatttgcattcctatcaaaatctgacgtttttcctattcctacgttttcttaatcctgcgattcaaaggggcccttagaggattttattcctatagaaatttttcctacaaagccctttgaatcaaaggaatgaaacctatggaatactatgaaattcctatggaatgcctcttcccatacaagttttggaggaattttaacaagaggtagaacctcatggaagaaatcctttgagtctttatctctcctcaaatagaaatcctttgagtctttatctctcctcatcaaatagaaatcctttgagtctttatctctcctcaaattcatcctttgagtctttatctctcctcatcaaatagaaatcctttgagtctttatctctcctcaaattcttgtgtttttccagtggtccaatcaaacggtcattcctatgtttttcctgtgttttgcaatcctttgttttacacttacattcctatcataatcttatgtttttcctatttctccgttttttcattcctgtgattcaaaggggctaaacatgatgtgttgacagtgttgttatgggctaaacatgatgtgttgacagtgttgttatgcattacgcaatgatcaatcaggaaacattgaagggtatactgctacaggacaatgacatattaatggctgtgtttagttggatccaaagtttggattttgcttgaaattagagatgatgtgactgaaaagttgtgtgtgtgacaggttgatgtgataaaaaaggactgaagtttggatcaaactttagatataaccacagccattgacatgttgaagtatccgacttacgctgattcacgcaaaaaaaccaatagcgtgatgtgatgcaaaacaagacattgcatggtgatgagacaatgactgacagttcgacaacgcaatggaggttcagttcataactttttcttcaaacttctaatttttccatcacattaaaactttcctatacacacaaacttccaacttttccatcatatcattccaatttcaatcaaacttccaattttggcgtgaactaaacacaccccaagtttgtttgaagttaggcacgctaagtttgaaagcttagattgaaacattgtccactaggacacatgtcattacgtcaagcattaccatttactactagtacaaagcaacaacgacaggatcgatcacagttcataaaaagcggactcatcacctcctcaatccaccctctcggcctatccccgattgtatgggcctgtcccattgcaacgggcaaatgctactccaacttttccatcacattgtttcaatttcaaccaaacttccaattttggcgtaaactaaacacacccctaatatcaatttcgcacatccatatttcttgaaatatttaccaagacttcaccgtacagaagatctacttatgaaacacgagaagaaatcagtaccacccatgctactcaaaatttcaaaatgagtggaaactgatatctcgcaatatgaaacatcagaatacttcatcacaaaaacatcatgactgcacttcgcgctggttcatttcaacatctatagtgcaagtgcggaaccatgtactccagcacccacagaaatttgaactgcgagcagggttgaatgacaagacactagacaacaaaatgaccaacatgatcatcatccagcccctgcccctagacagtagacaacctagtagaacaaatccccaaataacaatagaataattctgacaaacaaccatgacattttaatcatccagtatctagcagacatgaattttccagaaaggacagctacatgattgatcctatccaataatttgtgaatgaataacataattaatcagtgctcaagttactggtctagaataattcagacaaccatggaatgcctaaatggaccaaaaattttcatagagagaaaaaaaatgcaaatcagtaaatcactgagaagtttgtcatgtggcacagaacccaaacagcgcttgctataggtttacatctaattttcagaaatatggctaaaagataatccagaacatggcagaacccgaagtattcaacatgcttattactagtacatgtctacagttaacttataaatatgggttcttatcaggaacatcatacatttctcaacatatttcagataattgtaaatttgtaatgaagcataatgcagaggccagatcaaaactaatgtgaaccttaccatccacataatttggcagacaagtacataacatgatcagacgatctaatataacgcgggcatgccaagtcagatcgaacgaatcataattggcagcacaaaatagcattgatatatctgaagcatctgacatgaactggcatcgcttagtgcaaaaattctcataacgtactgtcttaacatgcaagaagtacagtagaaaacaaactaatcaagtcttcttaacgcaaatagcttgagacaagaaacgactactacttcagattaatagatctcaaaaaccaagaagcagaacaaaaggcagggccaggaccaaaccctaggcggtgagcacgacggcgccgccggcggccttgatcttcttctcggcgaccttggagatgagcttggccttgacgacgatgggcttctccggcagcagacccttcccgagcaccttgaagtagccgaactgcgtcacgtccagcaggggcgccttgccggcgccggcggcctccgccgcctgctcggcgggcaccatcgaccagagccgctccacgttcaccgccggggagtagaacttgttgcggagcctgtggaagtagcgcatgccgaccttgccgaagtagcccgggtggtacttgtcgaagaggatgcggtggtggtgcatgcctccggcgttgccccggcctcccgggtgcttccggtgcttcccgatgcggccgtggccggcggacacgtggccgcgcttcttgcggttcttcctcaggctcgtcgtcatcgccgccgccgccggcttaccttgggaacgtgttcgggaatggtagggatgaagtcggcgagccggagttggtggattgaataggagaaaaccctaggaggcgaggaatggtgagcttgatgggctattgggctgggccttgcttcttttaggcttgtttctctcttggtttgttatgctgggatgttgggctgtggtttggggttttatcgccattttggtccaagaaggaaggagattttttttggaagctaaaaagaaattagatttttgtttcttaatgtgttgtcctggtgtttttgttgtggaatctccatgtagatgaactatgcaaatgcatcacaaggggattttactattttaagagtcccatgtcacaccggacacacggttggagccctaaaggaatcacgtgacatagatgagatgaaaggggaggaaaaggataaaaaaaaaggttttgttgttttccaaaactcactattagtaagccacacaagtgtcgataaatatttttttccttgttaaaaaacatcattggttttatctttaacattttggcagtaagattgccacatcccaatggatagaaagttagataagagccaacaaagaaaggggaaaataagagaagagaagcgtcttttgaaccattgtaagaactcggaagtggaatgtgttaatcacttgacatggttcttttctcgtcgagtaatatcactactattagtttatcttttcaacacatgtgtttgatgagaacaataagataatatggtaataccgttacctataataaagaataactgttagggatactggtaggtcgaccccaaggcttgacccaccatcagggtttcttaaaccgccggggccggggttaccgcgccccggcggtaagcacggttaccgcggtaaccgtgaaaaaccatgaaaaaccgtgcaaaatttatcaaaaattcaaattattttttaaatttatttgaatttaaggaggttaccgcggtatttatattaccgtaccccgcgataagtccggtaaccgccggtaagggaaaccctgcccaccacgccccccgtgctagattatgggtcatgggtcatcttgcccccgcaacgttcctaggcagttgacccatgggtcgacccataacccaaaagttgaataagcatatgcatgagtactggcactgcaaaaggttcgatctcgtctagttacatggctttcatagtggcgatattgtccaacttgtcgcccacaacgccgatgcccctgatcctctggagcaacatcttgattttgtcatagtctatgccttgttggatctctagcagaaagacgatgctagcaatgaggaacacgatgaggacactgggccgtcaagcaagcactactaagagcctctagcctcagcctcccgtgatcttctctatggtgaaattcacaaacatggtgaccggagctccaagagacacatgttgaattggatgccgagcccgacgtcgagcacaaggggtgagcagaggtggagatatagatgatgaggtaatgagcatgagaagtaggctaccgattttgctgtagtgttgacgcagatgcacgccgtcgtcgcctccacccaccaacatctactggagcctgtgagtgcgtaaacgtggtgtaagatatgggtcaaccccatgcgtggtccgtgcgtcacgaggccaccaacccatgttagcctaggtgaaattgtgggttgacccatatggtttttgccccatagatcgtgggttgggtcactgggtaaatgggttgacccagcccatctacatccctactaattgtgtcatgtatcaataatgatatgcacaaacaaggaatctctgaccgtccaaaaatatgatttaaccaacaccaaaataaatacatgtcaaatcttgaatgttttcatagaaacgataggtttggtatgttgtaattaaggaaacacgtaacttctataccccgagcaataattattccatgcacataacgtcccaaccagctgaggagtcgaaaccctaaggattgcaattgtcaacttggagcctgcataaaaacttcaaaactcatattatatatgtaatgcgcaaaaaatacttgcataataatgtctgagagtgacacatgatcaattcatatgtatacgacattgttatttttttcaagtattgctaatattcctttaatatttcttttagagctagatatttctcaaaggacaatgcaaaataatttatttttagattaaaaaaatatcaaaagaccctcccctccctagtcctaaacctaaaaacccaaacccaaacccaaaaccaaaaccgtccataaacccacgaaatccggcaaaaacggaagattagacaggaagaaagaagggaagggaaagaaaagcaccgcagtggagaggaagaggagcaaaccctctcctctcctatatcaaccccaactccgccttcccttcgcccctttttctttccccccttcggcccgccccagatttcttcgtcaccaccggcaccgtcatggacgacctcgagcaggccattctgctcgccttggattcccc

SEQ ID NO: 14444 - DNA, 25559 bp, Oryza sativa
cgcccgcgtcctcgtctccctcgacgatgacctgctctcccaggactacccgcgcaacgccgaggaggcctccgatgccgggagggtcaaggacgccatgcgcgcgcagtgcgtgccccagatcgcccgccactggcacgaggccgccgtgtccctccgcgccgccgaccccgccgtcgccgcagtagccctcgatgcggcgcggaggtgcatctcctggatcgatgtctccctggtcgcgaatgacgtgtttgttcccttgctctttgacattgcgctgtccccggggagcgtggctcctcttgctgccgcggcggtggggtgcctctctgctgtggcaacaaagaggatggacgcgagggcaaaggtggcgttgctgaggtcgctcatgtctgcccagaaggggtttggtagccttgacagcggtttgaaaaatggcacatttggtgacggcatacgctgtcgaagctctcgagtgttattcgcaagcttggctctagtgatgctgatggagccgcggcattggaaatgctggaagaggtgctgccagctgtatttgcggccgcagagagcggcgatgatgatgaggttgattcgggctcggtgcttgagtttttatctgggtatgtgagtacgatgaaggcaccgacagagaagcaacttggacacttgggacagatactggaggtggtgcggatgcagatgtcatatgatccagtttataggggtcatcttgatgtccttgacaagatagggaaggaggaggaagacctgatggcagagcagcggaaggatttaattgcactatttcggagcatttgtcgtgtggcaccaggtgccactcagctgttcataagagggttgcttgtgacggccctttcatctgcagaagttagtgttgaggatgttgaggtcgcgcttactctgttttaccggcttggggaaatagtgggtgaggaagagatccggactggagctgggttaattagggagcttgtcccaatgctcctttcagcgagattctcatgccacacacaccgcctagttgcattagtgtacctagacacaattagccgctatatcaagttcatgcaggagaatgaccaatatgtgccacatctgcttactgtgttcttggatgagcgtggcatacaccatcagaatgcccacgtgagctgccatgcaggatacttgctcatgagagctatcaggctgttgaaggctaagctagtgccttacttggataccattttgcaggtatttcctctatctcttttaataggtttaagccagtctagttttctattatagatctgagttatgtgtgtctatgagttaacagagcttgcaagatgccctagtgcaattcactgctacggactgggcaaacaaagatattaagttctccagctcagaggatggcagccaaatattcgaggtacaatgttctcacctttgtctagctgttgttttacactgggaacactaatcttggatcaatgacgcttgttatgattttaggctgtgggactgttgatcggcattgaagaggtgtcaccagataagcaggttcagtgcttgacagctttacttaatcctctctgtcaacaggtgatcatcgatctctttctccccctgtttatgctggccttaggtcctatgggtttaagaatcttacattcatcggtgaaaatcaatccagatcgagtcacttgttatggatgccaaagcacaaggacttgaagaatcatctccaagagctataggtcttcaacagattattgttgcattgactatgatcagcaaggtatgctgttcatcctcacacatcacgaggagttggcaatatcacattccgtgaacgtagtatatcattttatttctaaaaaaacgttctgattcgctcatatgccaaatctttggttctgtatatggcaagtgcctcaagtattaatgcttgatcttactgtgtctggatgctgtccttttttagggatttaatgaacggcttgtgatgggaagcaggccgacacttggcgttatgttcaagaaggtacattctgtcattctccattccacgtatatatatgctttttaattatcatatatgtgcataatttccatttttcgtatgtgatttttttttcgtattgttctcagacccttgatgtagttttgcaagtcctcatctcatttcctaatgtgaagcccctgcgatctaaggtaagtaactgttatcaacatcttttgcaatttactgcttggatgattaaccaatttgtaacttatgcaatgctgaaatacagatcatatcatttctccaccgtatggttgagatattaggcatttcggtgcttccatgtattccaattgcactgcgacagttgctcgttgataatgaggtatttcatgtccctgtttcctggttattggttttgcaagctattgcgatctctaatagtaactgtagcacctgtgttccctttttcggtaactgtcctgttttagctgtatttctctgaggaataataacggcaggactttggaaactatcgtactttgtaatgtttcttttatatacttatacaacaaaaaggtgcctctgttgttaatcataccatcaaaattatttcagccattggatcatagtattaaccattaaattagatcgatgttctgttctacaaggaccgctttagggccatacagtggattggcccagttagactccacatctcacttttccccctctttggcccatccctttgagcggacaatgtcccctttatggactctaataataatttagtagttctacaactattttgtttacagttaatattatttctccatcttattggttcatcacagttctgcagcttattttcattcattcgtactgcagcaatgcaaggggtatcatatagttcttaaaatagcaatatacaaaggaaaggattgtgtagactgtcaatccaaacaacaatggaaatcaatgaatatatgattgtccacagaaatccattaaacattcttttgtgcaattgtgttaatttcttgtgtcttagccttaatgtttttctagtacctgttgaactgcatattactatttgatgcaacatcaaattagtaccttattatttctctaaaaacaatattgtcgtacatataattctattttgcggcccttgctgacatcatctttttacaggcaaaagatatgtcggaatttctgtacttaataaaccaaataatatgcaagtttaaatcttcagcaaatgccttattggaggatgtgtttcctgccatcgcaagtcatttatctgtgatactatcacacgatgccttttcaaatggttttgcaagcaatactgaggtaaattgaattggtaaataagacccactatattactgcattaatttgtgtgttaaccaattagtttaatgttgttttctctaagcattttgttttgttgttagtcactaaatatcatggctgttaaggcgtcgctatggcatcgctatagtgctagggcaccctgagggggtcaaggcatccctccgccttagggcttaatgcaaagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccgccttaacaaccatgctacatatatggcaatcatcttgatatgataatgttcttggcttattgcatagttagtcacacactattgtttgtagctggcttggttcttcatcagctagtaggccccatctgaattgctaccttttgtctactttgttcatgccaatttggctaatctatgtagccaggcttttacaggtatttcatggattgcgtagttccttgtatactgtattcatgccaattttgttcattgcaggaaatgcgtgagctgcaagagctggaaaagagattttacgcattcttgcttcatatagcaacacatgatctgtctacagttctcctaactcctagttgtaggcattatctagagaacataatgcagttgcttttgattacttcatgcagccataaagagatatcacatcggaaggtggggtttaattgatcttgaatttcttatttccacttcaagcgagttacattctccatctccactttaaatagaattgtctattttatactcggttattgttttgtagacatgcgtacagacttttgtcaaccttatcaaagactggtgtagtagctctgaaattgaagataaggtattgttgtgttcagttcttcttatgtcatgttttgaagagtctatctagtacttgggcagttgcattactcataatgtcatgtatttcttgttttcctcagcttcctggcttccgagtgtttatgattgagaagttcgctactggttgctgtttgcagagtgtccttgacaagtcatttaacttccgtgatggaatttcggtaggacctgtcaaccatacaatctatatctatctaaatttctcgtacctgttttactgtgttaaatgtataccatcaagtagttattatactgtttgtctattgcttcattaaattcttggtaattttattaatgtccgtcctgatagggtttataggcatttgattgtgacctccagcctataggtgtccgattggaggtgaaactgcagtttgtagtctaatatgtgatctcttatcacttcctaaacatcagatttacttggatcaaatggcaatctaaatctccactctatataaactattcaggtgattatgtagcttgttgggcacactgatttcttaaaaattcttagaatatttaacttgagcgataaatttctttgtactttgacaatgtatatgttttctgtaaccaacctttcatatattattctcatgatgtttaaagtgccactaggtagtgtttgaattctattgccataaatgccttttaattgttctcaagcagactgggttgcgacatttgaatcttattggtcacaacctcttttgacattcccaagccccacagtttcatgttggtccctagaagcgagaatacactctactttctcttaaatttgaaatacaatctgcaaatatttctatatgccccactactatgtaagggagcgtcaaactaatctgttccctttgctgatggaatgttaatatgacaattgaaaattcagttggccaatgggatgcaatgagctatgtcttggtgctttcattacttctcaaggagggcataaatgattagaggctcagtggccaaagtaggcatgtagcaatgcaattctcggtgacagtcttgctaggttatcatttagttaattactaatctaaaagcaaatagaacatgagttattttcttcctttaaatgattgttgtctcacaacttattgtcttgtcattttacttcattactatagttgaaatggacatgacttttgcgtggtgatggatgtatttctttacattcaagagcttagtctaatctgcttctttcttagattgccctgtttggtgaaatcatgatggctcaaaaggttatgtatgaaagatttggcgagaactttgttgtaaattttgtaacaaaacttcgagaagcacactgcccaccagaccttgctgaacagtactaccaaaagttacaggtatgcttgttcttttgattccactgtgtttgaggttgctaactgcacaaaagctagaacatagctatcattgcaattttaaaaagttgaaccgttcccttaatttacgaagttaaatgtaagtacattgtgttgctgtctcgttgataactggttgacttgccatcaaaatgccatcgaggtttgggaagttgttagtaccatgatggagctctagtttatttgttgtggcttatatgagagagcaagtatttagcatttaccttcagacttgagtaatgattcaatgggtaattatcatttgtttgtcgtattactaaagcaatggtgtttgttctatggttttattacaaacaaagtaataagatgctgacataattcaggaatttgtaatctgatctcttatctgctgtatcaaatttaaatttttcacttttacttttctccatcacagggaaatgatatcaaggcattcaagtcattttatgaatcacttgtcatgaaaataagacaacagcagaatgggagtcttgtcttcagatagcgtcattcaattattttaaatctgtttgccagtgaaagattcctcagttctacaatttgaatataggtagttatttcattcttttcttggcttatcaacaatatgcttattcctgcatgacttgcttgtattattgccttcacatctttgtgttaacttgctataatttgcagggtagttgtatcatctatgtacataaagctctaccatttctgagatcagaaggtattcccttgattttgatacacttcttttttgcatctttgacccatctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccgaagctctattcatacacctttcaatatcagtaatcatacctcgcattattgtgaaatctgacctcaatgcatgtttcagtgtagtttatgccagtggcacataactgatgaaaaattacccttgtatgcttgcagatgtatactgcgggaatatttttaccgagcctggctaccgtggcaaagttccttgatcaaggcatgttagtgagatgcaggggatacatccccagagtttctgctgtgagcatacagggtttcattatgtttgttttgatatttctctggaagtgatcattgttctgctccgagcttgaaattttttgtaaggcgattcgggtgaagctaaacagatgggataggcaaaagagtgatgtgtgggccgtgtttttcctgacagaaactgtcacaccgcctgttgtcgtgttaccaaattttggcagtggtttttcacccctttgttagctggggtgctgtacagattctttaatatagttgcgtcgttcgcattaataagtttccgtggtcaccttctcgttaccctgattatccagtgacagaagaggcatgctatgctgactgcaatgtaagagttcaactttgatctcttctccttttgaggtagtggaaattttctttttacccatagaggtcggtatttttgaacggtcgaaatctttcatccttgtttttgcccattctgtgactttcgtgcttgttcggcttcctttcagaatttggataaatttgctttggattagaccacgtaacagagtctagtcactgttacttgttaggcaggatggatatggctgtgaagtgaaggccaggccatcaaagttgggtttgatcatatcttctgttcttgttcttgtgatccaactatccaaggacttggccaggagcacatcagcgtgctagagacggacataacgatattgattgtctagcttatatgactgcacatagaggcccatatttgtaggttgacaagatgtttatggctttatggccatatgacttttgttgaaaatttgcttgcctgctgttggtgcatattatcaaatttgtcatcgaattctttcgcacgtcattggaatcatctgcaaaaaaatgttgttccctatggtggtggctccatgtatcttgcgagacccatccacgtagtcattttttatcatcttctgaaagtcaatgctaatccaatcatgcacattccgcaccgcacgaggaaatatggggttttaatttggaactttggagccaattttcgccctgcccatatttggtagtgtaacagtattggcaaacattgttatcaaactaaatattttttgtgatattattttagttaccaaaaaatttgggtgagcaaaagttgactctaatctaaaccatggtctgcttcctttcatcaagaatccccacattacagaagttctaaaatactcgtatactaatttggaggtgcagcaaagagcatgaaaagtgatttcactgttctcacaattttttgataatttctggagcttctacacattgaagcactaacttggtagtgaaagggagtgaagacctcccaaaaaagggaagggaattgaagcactggaattggattgttcatctgcactgcacagctagaaagggatcctgacaaaggaaaatgccacacaaaagaatgggacagttgcaaagtccaatagagaatgtagcaaaacaaagaacacaaatgccaaaagagttgacaaaaaaaaaaaaccctgcatcatccaaaatacacaagagacaaaagaagcactcaccaagatgagctaaccatgctcatcaactttttcataccactttagctgtttttcttggagggggcacttggaggttggaaccaagtgctctcacccaagagtagtaaaatatggccagctaatcagtttgagaagactagatatttgaagacagattaactttcttgtctatttggacagtagtttaatttgtctatgccttcaaaccctgttttaatcacacctaccatgagagtttgttgatcagcacacatgcctgctgctggtctaatgtccattgaaaatgtgtgaagacaaaccacttacttagaaagttaacaatgctagttaaagtaatgactacatatatgctgattgatgttgctattggagcaaggctggttaaaatgcctatattaaaagaaaagctatctgcttttgacaaagataatcaatttgattgcattatcaagtataagatagttatttacgactagcctggtgacttggttttctgtagcggcatagacctgttttttcttcatttcaaatgtcaggtaatgtgtccattgaggaaggcagcattcgtattcaaaaggtgtggttagtattcagttcagtgtacagaatgggttgactaaatcaagctaaagatcgtctctaattaagaagtaatcaagctagtagctagatgttctctaattaaaaaatgattaagctagctactgcataacatttgcttgcttgtagccgacaagttgtgataaattaactaaatcctgcaccaatcaacaggcctgtgaagaatgcattactccaactaagattgatgtgcacaccaacagcactgcaaatccatatggatatatacggaagaaacatcagcagaacatcatcttaaagaattctgattgggaatatgtgctcacgtaggggagcaagaatgaacaaaaccagtagctaatgcccatcctgaaccaaatcaagaacccctgacactgaatttttccccctatcttcttgtttctctgatcaaaccaagaaaccatgcaatgcatttatgcatgtatctagagcattagcttgtttagtagatgataatgatagatgctttaggggtcaaaatcattatcttaaggctgcggttgtacctgccgaagtgtttatcttcaggtacagagaagaggagaaactagtaacagtcaggaagcaagaagtgcatattgcataggaaagtaagttcagaaagtatgcatatgacgtagaggtcgatgcttagcagtttggtgaggagtctcgtgacatttgatctcttcatggaaagagattgcaaacctaccccgtatctcacgaagttaacctgtccttcacaagtgtttctagaacgtgtcaatttcatcaagctgattaatttcaggtttattgtcattgaggagaaaactaattctaattagatatacggaagatcatgtacggactaatcacattttctttccgaggaaagaaacttacagattgtttttaaaaacgaacttattatgttttttaatagataaataaagctttattgaactcaatgagaactaaggttgttaaaatcatgatcctaaatcagaggtctctgagtaggatcgcaaataaaaaatagtatatgtaggaattgtaaaatcgtggattctatctactagaatcgtagaatcaggttctttaattaggattgtaaagtcgtagaagtgtagagctgaatcaagatttttacaatcttcctgaaaatacttagtaagattgttttgtatcaccttattgtaattggttgaattcaataattatctcattatctaaaaataagtgtctcgattaactgatcacgtggtacatagccaagttgtttctctgaatcattttggctgacagagatcagcatccactgcaaaagtcaaagtggatggaaggattttatattgtatctctgcacacgcattgcaagcattccaaagcatatgcatggaacagttgactgtcatttctgaagcgatggacttctgctacgcttcaccagctaccggagaaaaacaagaaagtaacacaatctatacacaaaaacggcttcttaattagttgcatggctaatctctctttgatcatcgtgtgtacaagagccgccattaattagacgtcaaaactcaaaaccgagttttttttttcaaagatcctgaaattaagaaggtcgtcactgcagagttggtgcagatgattgatttcagaaacaatatagtacatatttgcattcgaagctcttcagttcttttgttttttcttcaccttgcaaagcacgtaggcacttggtttgatggtttccagaatgatgtttcttggaagcaagtagtccttggcaaataatctgttattatcatcaaatgcagattacaggattacccttaacctaaccccagttctgacttaatcagttcctactcctagtgtttgacaacctactgcagcaaagaggattacactaattaaacatttgatccttgcctgaattcatgcagcatgcatgcgtgcttgcacggccgtctcatcaggtcatgtactaatcaattaacagccattgacccattgtgcatatggttttcccactggacatatgtaactaaccagtaattaatttcctgattagttcttgattgggcaccaagaattagctaagtagctaaccaagaaccaggcttcaaaatttcagttttgaccatttctattgggggcaccgatggtaccgaaatttctaaatattttgatccgaaataatttaaaacttgaatagcttcttatcggatgaattcttttttgataagatatatactcgattacatggttagagtgtccctatcttcccatggccattattcagaggagcaactcgtggtacatgcatggcaattcctgcgccacatgatcagtggcacgattagtaaatcataccgacatcagatccatacatgagaagcctctttctctgtcaccgagcacacgtactttacaatatatactttccctctagaaggaaaaggaattgaaaatgaaacgagctttggttatgttctcacttggcttgtttggggccacatggtttgtttttaattactgtaacttcagttaaaaatgttaacagatcaatattgtttgaccctctttgacgaatttaatttcagtgtaccaagtgcgtgttctatttacatatgcttgaaagttactgaggcatacacatacccattgaaacacaactctgattgttgagctatagttggtatgcctaaaaaactgaacaagcaaactaaaaaaaaatacaggtaaaacatttatatttgtatcattaatggttctagaaccaatgctaaaaaaatagaccatggctatggctcggctaataagccaacaatctcctaaacttgctgggcaccaactgtaaggttttgagagtagaagatagagatgaaaaaatatctcgttttttacgtgcacgtttcccgaactactaaacacagtacgtttttctttcaaaagaattctatatgaaagttgaataaaaatcaaattattctaaattttaaatttaaaataattaatactctcaaatactgtactatctaactctgcatttgctacatttggaacttcataaccatgttgatgtcgtgaactcagattcccagcaaggtgttctcatctggatggtgcatgcagatgcagtcgcaggtcgcagctggatgcccggattccagtggtggcaacgatgaccaatcgacaacgacctgcacacacagacaaacgtcgttttggccgccatttgccaccattaagagcatgtccaatagcatactataaaccagctgtaaatatattttaaaaagataaatgaggagaaagaagaacagcgggctacagatttgtagccagctgtagcatggactccaagacttagtgtgtgtatgccatgtgggaccagatattaatagtgtagtatatatgtaactattatatgaataagctattagattgcctatagatgaattgaagctagtagtgggctatgctattaaacttgctctaagtacatcacatcgatgctgggcagcagcttgcacgcactgactgatcgacgaatagtgatcaaaatattcagtcagatcgaccaagaaacctccaaaccgacgagaatattggcatctcttctcgcgattgggactcttgcaaacacctctcgatccatccatcgtcggctcatttcctcttcctcctcctttgcttgttccgagtcaaaaacgcgtatgcatggactggaatcaagcgacctcctttacggcgcatttcttttttttctctgaaagtctgatgcgtttgcttgcattgcaacagacggtggtgttgcttttctttctttaatttgggggcagttaatagtttgagttggtgatcactggatttttctttctctctttctgatgaattggtcttaatttggctgcattgcctgaagctgggttgatgcgttcctttgttcgcgttggtcggctcgtatacgtacgtacacacagggacacggtcaccaatttggtactccatccgtttcacaatgtaagtcattttaacatgggactagctaaaaaactgtcgagtgttttttgaggggaaaactttcaaatctaactatagtatataatttcactagaactatattataataataataacttatatatatgtattaaaataatatatgcaactttatatgtaatttatatagagataacaatatagttatagtgtagttacactataattacaatgtaattacaatgtaattacagtgtaactacaatgtaactagaatgtaactggaatgtaacttagatataactttgaacaaatctaccgtaaacatacaatgatgggactagcttgtgaaaaaagggtttagatttaatagcaaaatatctcagcacaaatcttaaagcggaatcaacgactaagaaatttgacagttttcactcaagaaaattgtcgacagtcctctagcaattccgttttagcatttcccacattcatattgatgttaacgaatctagacatatatatctatctagattcattaacatcaatatatatgtaggaaatgctagaatgacttacaccgtaaaacggagtaagtacttctttgcatgcagctgaatggatgaattaacgatgaataatttggttctatgataatattcgagaatataaacgaatgaattgaataaaacaaagtcaaaaggttgttctaaaaaaagcattcttataaattttaaatttatacacgcaaagtttcttttataaagatttgcaccatttcgagacatgaaaaatgtaatacttaaacatgttttggtcgaattttctatatgatgagaaaaatctaatacgaagtatgaaacacactggagtgtatggccatgcttgcttccatccatccatttgcacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccggcgacgagctcgccccgccgccgacggcgacggcgcatgctagctgcgtatagcccgcggcggagatgaggtcatccagcgattgcaaggttgtggcggcggcggcgaggaaaaaggagaaggaggcggcggcgtggccgtggtcgctgtgggggttcctcctgaccggctgcctcggcggcggcggcggcggagggaaaaaaaagagcggggggaagaaggtgcgtccccgcggcggcggcggcggcggcctgcggcggctgtcgttcacggacctgacgggggcggcggaccaggacctgtcggtgtcgctggtggggtccaacctccacgtcttcaccgtcgccgagctccgcgacgccacccgcgggttcgtctccggcaacttcctcggcgagggcggcttcgggccggtctacaagggcctcgtcggcgacggcgtcaagccgggcctccgcccgcaggccatcgccgtcaagctctgggatcccgagggcgcccagggccacaaggaatggctggtacttcacccctccacgtgtcccttttccacttaatcatcaaaaaaatagaataaaaaagtgatatgatttcatttgattaattagacatgcacgcgttaatcactttagttagttaatcatttaatgcgataattaaatcagattgatcgattatgtttgtataagattaacaattaagcttggagtaattaatctgagatagtgtagtgccagcttccttggaagagtccctaaatctaatgcttgggggaaacaacattttctcacatggtttcttatagtaaaagagtggccatcaaatatagcttaattggtagagtagtagttgccttgcaaggatcactcaaatatatgtatcccagtatatgaatatcctagggcattgagtaaccctctagataactgaaatttgcaggtgaggaacagtattttttttttctttttgagggtgagagatatgagatatcgttgattttgttttttaaattaatattattgtttttctttgggaaagtgtcgattttccttttatttattgcatagaagcaaagttgtgtcgtttctcctgtagcaacagggaatgttcagtcaaattacccaatcgtttctttcctaatgctatttagtttcccatcaaacagagactgatcagcggtaattagtttggttatcggtcgactagaggttaccacctaaaagactgtattattcaaattttatatttgaaaattttgaacttttacgacttatgactagttaactaccaattattcattaaaaaaattgaatctgaaattttatctggtaaaattcagtaactgtcaggggccagtagcttcggaaacccggtttctgaaacgcttggcctaaacaattaattacagattgtttaatttcagatcaactaatactactactactcacacgatcatctagaacataatcaaacaggtttaaaaatatcttaagcagcacgattaggacgtgcgaggcaaagaacaagggaggggtagttggacgatgtgacggttccggcgacggtcggataagtttccagtgatctaatcatgctgcccaatgcaacagtgccactgaaatggacgtgatcatgctgctgattcgctgctactactactactacctgatttctgatgattctgacgtcgttgcttgcaggcagaggtgatcttccttggccagcttcggcatcccaacctggtgaagctggtcggctactgctgcgaggacgagaaccgcctcctcgtctacgagtacatggagcatggcagcctcgagaaccacctcttcaaacgtaagcactgaactgatccttcgctaattgattttcagcttaagtttgtactactgttccattgatctatagcactagttgccaacttgccattgtgctaattttttatctgacgagatgtctctttaccatgtcatgggtgtgtgtcaaattgaagctttagttcgagtaggactacctaattaactgatggttaatgagtggtttggtacggtcgtgaagtggagatttaaaacagaagttggcttgaccattctcacacaaacgcaatgacctggcacggcatggtgccatggtctgatggtcattgagaaaatgaggttatattccaacttaataatggattatagatatcacaaaatgagagagaagcaaagccattattcagaagtctacttcaaatgggtagctttgctactcaaaaaacttggttgcgtctttgaggctttcagcttggatgatggatatgttttccttcgtttggctagccaacttctttagcttattagagttcagagttctgaccaaactgaatttgactggccttctctgctcacttatgagcttgcaaaacccatggaaaatagtatttcattaggtaagggtcaattatacattcactcacccttgcgagacaagctatagattatgctactagacgttttctaatgctagattacagacgtcagatgaaagtgaggtcacctgtagttgttggatcaatttcaggttgacatagtaatctagtgtgctgcaatcttcccagctgcctcactggctcaagctgattgatttgttcttggtcatgacgaaatctcctaactcgttgactggatatcgaatccctccaaattacaataataacatttcttgaaaattcagaaggcagaaagaacaagaaaccaaaattccacaaaggcgacaacacgcatggccggctagccagtactgttcatcgtcttttttttctcctctgctgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagagattcctgcagtgctgccgtggtcgacccgattaaacatcgcggttggcgccgcgaagggtttggcgttcctccacgacgcagagaagccggtcatctaccgtgacttcaaggcctccaacatcctgctcgattcggtgagtgccctgtagcttttcctaggtagattgacacctctcatatgcatgcatctcagttagctaggagtttttgatgcacacatcacatatgatatactatatatatagtatcatcctaatgaccttttcatcatcatcagtgaaaaggtagagtaatgactaggaaattgtacttggcacagtttggattttgaagcattttatgacatgattatgtcagagaaacttagtatcatactgtacttatgctgttatagtgttatgcatcacttcatacttaactagtactagttaatggttattatcatattgtacttctctaccaaagaaaaggaaaggaaagcttagtgatgtgggctatggttcataggttgggccgtaagtgagttctgctcaagattgggctaaaaggaggcccaaattttagtttcaccactgaaaagcgtcactgaaaataattttatcgggtcatataatcaaatctttattatctaaaaaatataatcaaatctttacatttttttccatgaccgtgtcaatgttcttttttttgaaagaaaaagcaaatgttaagtttgggcctttaatgggttactactcaagatgggccaaaatcaggcccaacttgaatttcccccactttaaagcccattcattagtaataagcccaagtaagagaatcgcatcaaatgggctaatggtttttgggcctgtgaattttgtccctccctccaggattacaaggcgaagctgtcggacttcgggctggccaaggacgggccggagggggacgacacccacgtgtcgacgcgcgtgatgggcacccatggctacgccgcgccggagtacatcatgaccggccacctgacggcgaagagcgacgtgtacagcttcggcgtggtgctcctggagatcctgacggggcggcgcgccgtcgacaagacgcggccgaacagggagcagagcctcgtggagtacgcgcggccgtgcctgcgcgacccgctccggctcatccggatcatggacccggcgctggaggggcgctactcgccggcggcggcgagggaaggcggccgccgtcgcctaccggtgcctcagcgggagccccaagaaccgccccgacatgtccgccgtcgtcgacgcgctcgagccgctgctcgtcgccaccgacgacgtccccctcggccccgtcgtgctgttcgtcgcgccggatcaggaggccgacgccgccgccgccgccgacgacgacgaggacgacaaggcccggcggcggcagcggcggacgcggaaggacgagcagcaccgccgccgcagccgcctccggacgtcgcccaagggcagcccgaggaagcccgccgtcgccgctgcttgccggaacgaggagttctgggtgtggcacgtccccgccgaccacaaggcgtgagcgagtgacacgtggcgcgttgcatcgcacgccatgtcagccgccgctttgctttgctccacgtgtgcgacgaacattgtgtgtgtgtgtgatgaggtctagtagtaacactggtgatttgattaggatttgcatgcatccctgtactctgtttgtttcagtgagatgcagagtgagagagcgatcaattcataattcacagcacaacgaagatcagatcagaaaatatcttatcaggtctcgtcttctttaatccaacccttgtttgatttgattggttgatcccttcgaaagtcaatttgcatttgacaatggcagatacggatgaacagatcgatctcgacgatcacatcaacctggattatttttcttattaccgggcgttgacaaggcattggtatctgacgaggtctcttgccgtgtagttagttttagaggttactgtcgccgtcgtgccctcgcatgcaacgtgttcgtccgacgacacgacccggcacgggcggcggcgccgacttcgcgacgccacgctgtctttgaccggctccgacgagcgcccgccgtataaagaaagaaagggtcgcgtagctgataaaagcacggtgtccatagctagctagatcgtcgtcgtcgtcttcttgcaggagaaagatggagctcccactgcggtgttttcatggcgctaaggtggcggcggtggcggcggcgggtgatggcggagtcgccggccgtgcggctgttccggcgaagggcggcggcggcggcgttgcgcggggggtgaaggtggtggtaagagggctcgtcggcaaggccggcaaggtgttcggccggtcgatcccggcggcaaggttcggccacctcgcctacataaggtgaaggcgcagctgcgtcctgaaacgtcagtgatctgatcttcttctcctctctcactctctgccatcgagggaggtgtgctttgtactagcttttttcttcttcttcttcttcttcttcttcttcttcttctttttttttgtttttgggccaatgatactttgtgctagctaggtgctcgacaaaatgcgtccttgattgatgcttggtgattttcactagatctgttcatacgacttgtaaatagtagaacatgctaggtacaaggtacttttcagattacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataaccaaaattgatatggattcgggattgagtcggtctggtaattgcagatagtccaacattaccaataaatcatgttggctttcaaagttttaacttaaattggtcgacatggagtactagtattgcacttgtttggctgcttgctgaagtttgcggcacttgagttaggagtacaagtgtttttttaaacggaaaacggtacaagagtgcgccttttcattaaatatagaaagaggttaggagtacaagttacgaccatccataacaaatgtttgattcattgctaaaattgaagcatattaacccttaacctcacatgttattatagccaaaacttgccacaaaatctatggtcaccgtctaaatctctatcttcggtcctgccagattagtaccaatactcctactgtgatggcgatgtcatcgtttcgttacgctgacatgcgagcgtacaccgctagtagtacaagtgtaattcaagttgaacgatggatcatttctgtcgtaacttcacatccagcggatagatgagatgactgatgatcacaagcaagacagggaaggtccctcgtttcgcttatatagggaataagacaaacggtataattgcaaatgaaaaataattttttcatatacgtgttcctacgatctaaaagtaaaggctaaaaaataaacttcgataaaaaaaaccctaaaatcaactctaaatttaaggttgaaaatttaaattttagttgataaacataagcataagtgaaaagatgaggctggaagttgtatatacagtactttattctcatcttttgtttatcggcttaccggtcgtggccaaatttaatcgttaaagttctctttaaacattggggctgtgtttagatccaaactttgaattcaaacttcaaactttttccatcacatcaacctgtcatacacacacaacttttcagtcacatggtatcaatttcaacccaaacttctaactttggaaggaactaaacacagcctggatttcaaatcgcaaataatacacatacaacaaatggaaaactcccacaattttttgttgcttcgttcacgggacttcggcttgtcacttcacttcatctacaactacaagttctcacttgagcatcctgcaatcctacctatgtttcgtcttgttcttttgtccctcttttgccatgcataccgctgttgcttttccagttttccatgacccatccagtcaaaccaatactccctccatcgcaaaaacaaacaacctatgagtaaatttgacactatacaatgaatttgaataggagtattctctccgtcccataaaaaaccaacatagtactggatgtgccacgtcctaatatatcacatcagttctagattcatattttttggaacggaacgagtatatcatgattagttgtactagttagtatcaaattcacttctaggttatttttatttttgataaaaaggagtacatatgatagcatgataggaatacgatgccactaccctttaacaaaaggagtattcttgagcaagagaagcaagcagccattcgttcacaaactctggtgattgatcgtgatggccattttccttgtcttccagagacaaaatggctctgattccctcgcctcgggagagcacgcaagattgagatagcctcctccaattattgggtcactcacacacacacacacatctacactgtactactctactggtcactctcgaggtcttcttggcccatgcagaagatggaaacagggaaagcaacagagaattgacagggttggtctcgtcctgctactcctgtttgccgtatctgaatcctgccaagctttcagcagttcagaccttttctttttcttttgcggaggaagttcagagaaattttcctgtggttacaacagcagccagcaatcagtgagaactggctggctgtttatatccaaagacaagtccgttgtttggtccaaagacaagtctggaagaggcccctccaataattggtgtggatcactactcatcccataaaaaaacaaaactaagacatgatgcaacattttttagtacctggttcagaggatttgatcagcgtagagactgcatttacgttaggttacggtcagataacagtaattctacagttcatcagtgtttaactggagccaagggtgtgtttagttccacgccaaaattgaaagtttgactaaaattaaaaatttgaagaaaaaagttgaaaatttatgtgtgtaggaaagttctgatgtgatggaaaagttgaaattttaaaaaaaagttgggaactaaaccaggcccaaatgtgcctttcggacggtcagtgccaccaaaacgagcgaccgaaaaccaccgaattttttttatttataattttttttattaaaagttttacaaaaataattttccattttgaaaattgacggaagtagtcgcctaccgcccaatcgccctctcagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgtactgtgcggggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactgataaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgttttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcaccggtcgtgcctgcgaacgcgctcgaaggcagacgaggtcctgcgatgaggaaacgtgcagttaaaacatggtgacataatcgtgcaaaagctgaaacaaaaatgaactaatatttgggctgaactgtaccctgcgaaaccggtgctttaggtcgcactgctccgaaactagggcgctcgaaaggcaaacgaggtccttcgaggatggaacaatcaagtactacggggtgatg

SEQ ID NO: 14445 - DNA, 3839 bp, Oryza sativa
atctgggctgaactgaaccgagcgaaaccggtgctgaaggtcgcactgatccgaagctaggggcgctcgaaggcaaacgaggtcctgcgaggatggaacatcaagttacgacggggtgatgttttcgtacaaaaacagaaacaaaacttaagaaacctctgggctgagcaggaccgggcgaaataggtgccgtaggtcgaggacctgctccgacggtaggcgcgcgaggccgtggttgtaccggaccagctggaggtaccacgtccacggcgctgcggacaggagaagacgcgcatgaccgcacgcatcttctcctgcatccgggcgaaggtcaaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaaggtcacacgcgcacgagtgcgaggaaggtaccagcgaaggtagtcacagtagttttcctccgtgtgtgggaagagctcgttgatcacctcttctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacgaccacaacaggtacgcctcaagggagcgtcggaccgagtaatcatcagcgtcagggtgcagaaggtccgcctacaattaagaatgaaatgttagtacaaaacactcatccggtcgcaaataagcacgtatgataataacaacttatttacttacagtgaactagagcaaccaagccttgctaggcccgactgtagagtacggaggaagggtgttggtcggtcctaggtgtggagggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcagggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcatgctgcgcgacgacgccttggccttgcgcgcctgcttgttgttccttcaccaggtggtcgcctaccatcacttgcctgtccagatggactagcatctgcgccgcttggaacttatgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggactaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggatcgtcaccttcaactagtggtatgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaaaattaggccacttagctggaagtccctt

SEQ ID NO: 14446 - DNA, 3319 bp, Oryza sativa
atttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttaccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacattaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctcatattcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacggaggagggactgggctttataggggggaggcaaaaatcgccctcccccagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccgtctgccacgtcattttcgccgccctttgagagggcgattttctcccagagggcggtaggcgactacttccgtcaattttcaaaatggaaaattatttttgtaaaacttttaataaaaaaaattataaataaaaaaaattcgaaaaccaccacaggggacaaagatatggcccattttcctgaacatgttcatgcatcctagctcatctctctcacatcatgataaattcatgccattcgaatcagaaacaacaaacctttcatacatcacatctgtcgagtaggaaatgtccatctgatctccatggctccaggtgaagaaacagtaagggcaaggtgaagtctgaaagttcagaacaacatggccatttcttcgacaggtgagcagtgagctaggaacagaaagtgaccaagatattacaatatctcagagcacgcaagatgtggttattaataaccagcttaattacctttgacacgtcgttctacagcccatgtttatctgctagagatcactggtcttaagctaggtttaattattcttaccatatttctcttcaaagtgtaatattccaatggagcatgtaaagctagctgggctctgacgtacatctgtgtgttgattgtgttgactggttaattagcagttaataaagtaaagaaaaagagctagtactattagtgtgcaaggaaaacgaacgatcgagatggcactgataggatagataagtacgcagtgattgagaggttggagacttccttaagacaggtttaattaaggtgcatgtaaggccagcaattggaggcagtgatcaacatcaatcgtgtctcacgcgttgcagagaccgattaattaagttgttgtgccgacctaaaatcaggttcatggcatgagctagaaatgtactagtactacacatggttaaataccagagacatatgtgcatctttctattgggataattaagctaaaaacgaagttttcattggcctgtgctagaggtttagaaaaccatctcagaatgcaaataaaaagaaacttgaatattcatttcgatttactcccagatgctgcggtaatcaaaataggatttgtctgttgtctccaagtttacagtgaggtcagaag

SEQ ID NO: 14447 - DNA, 3517 bp, Oryza sativa
acgccacctccacccccacctcctccgtctcctccccaacctccagctccatggctggaaccttcagactccaagctactagtctcctcctcctcgccggcgtctgctgctccggcgagacggcgtcgaacaccttgtggccgtcgcgtcttctctctctcgtctcctcttcgtgcgcgcgtgatcgttttgggccttgggctttataaacggaaggaggaggagggtggggcccacgcgcgagggaatcatggaggtgtgggggcccacaagtaagtgggatggggacgccacgtcggacgggtggcaacgggcgttgccagctgtctccaagtgggcggctggcttgcttgctgttgctaacttgctggggttgtttggtcggtaaagtattttcgtttgcttgattgagaaaaccacggtaatatatttgttttttttattgggttgattaagtgtgtatactttgtgcctgttcagagtacggcactggttgatattattttaggagaactaagcagagtccactaaataatgacaaatacaggtattatatactatacattattacatggtagacgcatggtgttatgattgctttgttgtttatgtatatatatgagtgtattcgaaataatcaaattgactttgaggaaagacttccattacagctgttgataaaatttaagcacgcacctgcacggtttctcgtggagcaatgaaatgcatttcttgaagtaagaaactttgatgaaacgtactaaaagattataaagaacaatcagtactagaagcaaaggcagctagtaggtagtaaggagattttgtttatccctattaatctatccactactattacactacagatgaagcgtttacttgcaaggaaggaggagcgcgaggcggcgtcgcgttcgtttcacacgcacgctgacatgcgtcgccattgactttcgccgccgccgccgcggtggcgcgcgcgcgcacgcacgctgggcgacacgccacgccgccgacgcgacgcgcgccgtgcgcacgagcaacacgtacgcaaggaaaaaggagagatcgctatagcttccacgcgcaaagcgcagggccacacgtgcgtgttcgacgtagacataacacggcgcacaggcaagacggcgcggcccggcgcgggcgggggcgacggctccgaccaacgaacggcgtggtggacggtgggcgcgtcgcgtcgcgtcgtgcgtgggcgaagttggtcggcgtgacagcgcgcgaccgcgtctcggtctcggcctcgttgctcacggcatacgaagccttgggcttttacgcacgggagaagcccacatatactgattcttttgggccgtcaatctgaggcccaatcaggctcgaacatggcatatatgctgcgtggttttatattagtcccacctcgcgccctagacctgattggaagaggagacatgggtatatgagatgacccagggtttgtaaccaaatcatacctttctcggccttttggctaagatcaagtgtagtatctgttcttatcagtttaatatctgatatgtgtaccatgtgttcactttgatattaaatttattttagccaaccatgtcctcggcgcctagggttcctaggcgactcaaggtgggttctgcgtgggtagggtttcaatcttctctcaaccccatcggtctcatgcctgatcggatcgatctcttcggtctagatcctgagtcggatcgatctcttcggtctagatcctgagtccacatcccatccttcctctgtgtccacggttagattctctgttttggagccgagccaaaccttgctagccggggaggggtagttttagggttcggagggcaccatggaggcgatgcaggcactgatgaagcgcatgcaattgtcggaggcagagaagaaggggatccggatctgcgaggcggagtctggaagtatgggatcaggggatccgaaggcgatcgggaaggtcctggcggagaaagtggtgaacgcggagggtttggcgcaagcactggggaagatctggtgtctgattaggggaataacgtgcagagatctaggcgagaaccatttcctgtttacctttcatcagcatccgggaagcggcatgctctggaggatggaccctggatgtttggtaaagatctggtgatcgtcgtggattatgatgaatcaaaggttttggaggagatggtgtttgcctttgttcctatttggatcagggcttcaaagatgcctttatgcatgatgaacaaggccatagggagagcgatcgggggagaggtgggtgaattcatgcgaatggagtcggaaaaggatggcactgatgtggggcagttccttcgtataaaggttcgtctggatattcgtaaacccctgatgcgtggtgtaactctgagtttggcgaaggggaagaaggagatatggtgtcccctggtgtatgagttcctaccgtacttctgctatacatgtgggatcatataggatacctgatttaaaatgtagtgtggaacttaaatactgataaatgtgtagtgtgcagctaaaggagggagaagagcaacgttatagcaaaaaactgcggttcatcccagaaaagaggaggtgggaggagggaagtaacatgagacaattgggtggaaggggggggagcgcagagaagatctggggatagcagtagtagggggagtgatgcaccatcttggaggaggaaggattctggggcagtagttactggaagagaggccagaaatggggaggaggaggaagtgacgagtcctgtaaagaaatcggttcagatgcacaaacctgaacaggctaagaaagcattgttttccattgagaaggagatggttagtgcgggaaagaatcagccccaagggggcgaaataggaggggagatgctgaaaccagctcaacatgacagagtgcaggaaaaagcggacgcccaggggaaatacatggaaaacaacgccatgcagcccatgcacgtcgacggaggggctgctcagggagaggtgccatcgggagtaaaagggccaggaggtagcaaacagaaaactttcaaaagaatgacaagggagactagaggtaagattttgccagcaggctcggggacggtgatcccgggaaagagaagatagatggagggaggggaggaagtttcgggaaagcgaaggaaggagggagagctaaagaatagtgaggaacaaaacccaatggaagcgggacttgcgatccagtcctgcgggaagaaatgaagctagtggcttggaactgtcgggggttgggaaaccgcccggcagttcggggacttctggatcttcagaagtcggaaaagatcgatattcttttcttgtcagaaaaaaaattagacaagagaagaatgcagtgtctgaggtggatgttgggtttggttaatatggtggtgaaagattgtgaaggacaaggaagggggggaattgcagtgttatggaggaggaggattgatgtg

SEQ ID NO: 14448 - DNA, 1122 bp, Oryza sativa
aaaagtttcatcatgcagtatttcaaaaatatgttccagtccaatggatgtcagcacccggagcgcctcttaagcaaagtgaagaagaaagtaacagaagagatgaatgaatgcttaatggctcagtttattgtcgaagaaataaaggcatcaatagattcaattggagacctgaaggcgccaggaccagatggaatgccgcctgtattttacaagaatttctggcatgtggttggaggaaaggtgacctcaaaagttcttgatattttgaatggaggtcagatgccattaggttggaacgagacgacaatagttttaataccaaaggtgaagcagccggagcaaatcaaggatctccgcccaataagcctccgtaatgtcttgtacaaaattgtttcaaaagtgctcgcaaatagagttaaaaaagttttgcctgatgtaatctctcaatcacagagtgcttttgttccggggcacctaatctcggataatattttgattgcttatgagcagactcattgtttacggcacaaaagaactggtaatgttggttttgctgctttgaaactagatatgagtaaggcctatgacagagtggagtgggagttcctgtcagaaatgatgattaaacttggttttaaccaggtttggacgcagttaatcatgaagtgcattacgtcagtatcttataaaatccgagtgaatggagagttgacagaggagttcctgcctgggaggggtctgcaccaaggagaccccctctcgccgtatctatttctgctttgcgctgagggtttttcagctctgttgagtcaggcggaagaagaaggattaattcaaggggtgcgaaaatgccagggtgcaccaagtgtatcacacttgctatttgccaacgactctcttattttatgtcgtgcagatagaggtgatgcacagcagttacaaagtattttataggtgtacaaggagtgctctggctagatgattaataaagataagtccgcctgtgatgtttagtcagaacacatcgagagtaaagaaagaggagttcatgagggaattaaatctgtaaagggagacagtgaatgataggtatctgggactgcccgtttatatcggaat

SEQ ID NO: 14449 - DNA, 538 bp, Oryza sativa
acttttgccagcgggtaataatggaggatgccctcatcattcacacccccttaacaagggcctagctcgaaggtgggattattcagaggcttcacacggtcgccgcctgacttttgcgtctttgccagcgggtaatagtagaggatgccctcatcattcccacccccttaacaagggcctagctctgataccaaatgataacaatccgatccaggtggggttggctgaggtccaataacttaaggttgtccagacttcaacagttcataggcacacccactcggggaaaggcccaatctccctgaaaaactagtccaataggggaagagtggctctcccttttaaggtggcttcttcctcccaagctaagtaaggtgggattattcagaggctcacacggtcgccgcccgacttttgcgtctttgccagcaggtaatagtggaggatgtcctcatcattgaccaataacttttcataaaagatatatcaaatagctgtaaaaccaatattgtgtgaaagtactaaatgtaatggcata

SEQ ID NO: 14450 - DNA, 903 bp, Oryza sativa
cggctcggtctcggctgtggccggccggaggttaaagaaaggcccgacatgtgggccccacatgtcggcggctgagaggaggaaggggcggcggctcggcttgggccgcacggctgcgcaaaaaggggggggaaaagggttgggctgggaacaacccaacggcttagaagagggtttttttttactttctcaattaaaataattcgtgaaatgatgtttcatttattaaaaatactttccttgctcaaataattcccagaaaaatctagaaaatagataaataagcaaagtatttaatgaaattttatctagctcaattttatgttgaaatttttcctagattattagagtttaacttgtaagcttttaaaatagtttctaaaaatgcattaaagaatgaattactaaattaggcaattttcagggcgtgacagagcaatagttcgcttcttgctgctgggctaaccagagctggtgggctttgcagatactgctttagctcctcgaaggctgcttggcactcaggcgtccatttgaatttgccccccgaagggtcttgaagaaaggtaatcctctttcggctgcctttgataggaatcagctgagtgctgcaattcgccccgtgagcttttgtacttgtcgtacgctcgatggtggcttcatttgctgaatggcattgattttttcagggttagcttcaattcccctttcagacacaaggaaccccaataacttacccgtgcgaacaccgaacacacacttctccagtttaacttcatgccggctgcgtgaagattgtcgaaagtctcttgcagatctgacgcatggtcgaatgccttgcgtcttttcacaacaatgtcatcgacataggcttcaacatttcgccccaattgcgatcccaag

SEQ ID NO: 14451 - DNA, 719 bp, Oryza sativa
tttcatcaatcggcttcgatgtacatgatagatctattccctgatgtcataccccaggtaaaccttatcattattaacctgagtaattgtcagccgattcattacttgactaatctcttgttcttgttctgcagacaatcgactcttcccctccacgccaaagcaacagtggcagagacattgaatatgctccaggtctaattcccaatggaggtgggccatctccccctgtcatcggctatcatgcccccaggacttcaactctcctccaaggcctaatcagggaaccagccgatgcaggcaggaaaagaagaactaggtcattggctatggacgcattagctccagctccaaagaaaagggccaaatccaagaaaaccaagtcgactgatgacctgccttctttggatccatccatcgagcaagctctagatgaagaagaaattgacgaggctgttgaccaggctcccgctgatgtaagtgatactgaggaaacaccatcggcttcacccaagcaaactcctccgactccttctgcgccagttcatttttcaagataaagcagctctctttgatcccttttgtaatcacttcacttttcggccgatcactcacagagtttattgttgcagaagaagaaaactgctatgaaaaagaagccagcagcaacaattttcaaaccggctcaaccagtaagatattttaattcttttattagt

SEQ ID NO: 14452 - DNA, 2694 bp, Oryza sativa
ggaaaaatgtcacgcctagaaatttagcccaaatttctagactattttgtgtatttaatccctgtccaggaccagccagggtacacaaaatgacaagtaatatacagttccaaacgtaaataaagcgtaaaatacttacagcagaggcacttagtcctcacaccgaaagagaacgacagcagcggaaaaagcgatcctagcggggcttcagctcctctccacaggcaaagctcaattggggtctgagccttggtcttctaacttcgtcttcagctcagaagcactacacttctgaaaagggggaaataatagcaaggctgagtacaaccaccgtactcagcaagccacaccattgatgcagacgtacaaggggaacacaaggatggtttgtggctatttgtataaaggcggttgtaaaacattttattgagaaaaacagtaaaactgttgagtaattaaagtaacattaaatctccactgatcaacgctacaccacgttgaacaggccccaaccaacccacctgaactacagtgcattgagtcaatttattaaaagtgggactaatcaccggtgaatcttggtcgatcgccccataaccgccggccacgggcttattcgaataagttttaacttttgggcccacagagagaaaacacgccgcccccgtccaactgtacccacaagacacgaattcacacatgtcgccatgccccaaaggtttcaccatgatactggaaagggggaaatcgtgacaagaccctgcgcataaccctcccctaaccatccacaccacgctaaggtttcacccccacccctcaaaaggcagtgggcggtctctcttgcgccgcagtgaatccggcagctggacaaccggacaccccggccgacccaactccatcacgcccaccctcgccaccggtggctaggaaagggtcaagctatacttcagatcaagcaattacccactcccgcttgtggtaagcacggtaagtctcccagggtttcccgtgaaccggtccttaactgcaatgggtgcgaccagcaaaaccatgcacccacagcccaccattcagtcgcattttagttggataaatacgaccatgaaacatggctagatgtctcgaacacgcagctcattctgatcctaaaaaggtctaatactgcagttatcccatcaaatgagctagtggtaattaagcatggctaagcatataattctagctaggtcacataagtaacatgagctagtcaatttatttgatgaaccctgagttcctctcgacactcaagattgttgttggcccgatctttcggtgagttcagataactacgatttgggagaaacgttgacgacccgactacaaccgtacaagatgttgtgttgcgcctttgcgatcgatacacctctccatgggttgttgatcttgccggtgcagatcaaccctattcctgcaagcaaatcgaagaaacaagcaagaacaagataaaagcaatctgatattgcaaataggaatttaatacaaatgataaattggggttccgaagaacaagcagacggacggtctagccgacacgcgcgctgcaagcaagtagcaatggctaaactttaatctaacaaaacccgagaaaccttgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgacgcaacacattgttcctgtgattctggccacacgagatggaatttagagaagaggctggatccgttagaaagagggctccgagagctttctatcaagtactcacaggccgaaaacggaggtcgtatgcagattcggtggccgtttgaagtcagcagtgtagtaggtggccgaatcggattccagcacttggagtacttgatctcgatatcttcttgttcatccatgatgtcagcaatgattgcatccgtggtagccatggtcacatcattattacccagggttgacaaaggacagatatcaagtaaacatggcacaagcgagcagataggtaatacccacatcccatgtaattagcaaaacatgcatatttatttgcaaacggtaaaacatttgtaaagtaggatcaaaacgctcaaggggaatgtgtgacctgcgttgcttcttcacttggatcttctgaacacttttcctcgcgaccgcgaacttccgaaacgacggaaactacatgttggcacgcaaaacgaggaaaaactctaataaacaccaaggaaacagtacataaaaagtaaacaaacatgtaaatctcaattttagatgaattttgcaagttgaatggtttgggcgattttatgtggtttgggcgccagggcgcaggcgggagaggctggaatcgtgggcgacgtggggcggcatatgcgcggcatggcggcttcggctctggaggccgaaggtagaaggaagagctgacaagtggggtcttcgggcccacctgtcggcgaaagggggaggggagtcagggggttatttagactttacgcgaggggaaggtgaaatgggccgacggcttaagagaagagaggggaggccgactgaggaagggggaggagaggggcgcgggccgcgggagggg

SEQ ID NO: 14453 - DNA, 696 bp, Oryza sativa
ccctcccgtcccaggtattcgggagagacggatccgaaagattctgtccatctacgaatccgtaattgcagttgctcacggcgatgagaataccaaggcgaaggtaatccacctcgtgctcgacggcataggggaatcgacaagggagtacatgcgccgattctcgcaagcacggtgccaagtacaagacataaccaaagcatccatcgtcaacgcaggttcggccggcttgcttgagggtgaactcacaaggaagatcggacgcaaggagccaaggacgatcgaacacctctttcgcataattgatggatatgctcgaggtgaggaagacaccaagcgaaggcaagagatacaagctgaatatgacaaggcggctgcagccgcaacagccaccgtgcaagctaacgctcaaactcaggttcaagcccaagttgtcagttcggcgcccgttctggttcaccctacccctccggcgaacccagcgcagcattcaaggccaaaccaagccccgatgacatggaaaaaattcaggaccgatcgaggtggcaaggccgtgatggtagtcgaaaaagtgcacgtcctctgcaaggagttcgacgcccagcaagcgggcggacatcagcaaccttttcgcaaaatgatcaagaaagacctgtactgcgcctttcacggatgctcttcacacacaacagaaca

SEQ ID NO: 14454 - DNA, 445 bp, Oryza sativa
gaatcaaattgttaaattcttcaccatattatgcacaagctaatgggaaagccgaggcatctaacaaaagcttgattaagttgattaaaaggaagatttctgattatcctcggcaatggcatactcggttggccgaagcattgtggtcttatcggatggcttgtcatggatcgatctaagtccctccttataaacttgtttatggccatgaggctgttctgccgtgggagacaaggatcggctccaggagaacggaactacaaaaggatttaagagttgatgagtattacaatcttatggccgataagagggaagatctggttcaatcgcggttgcgagcccttgcaaaggttactagggataaggagtgaattgctcgacactataacaagaaagtggtgcccaaggatttttcggaaggtgaacttatatggaagttgatttt

SEQ ID NO: 14455 - DNA, 352 bp, Oryza sativa
agatggttctcaaggaaatcaaggtgataactctcaaggagtatagggagttcaaggtgatggtactcagggagttcaaggtgaaggccctaatcaagatggcaatacagcacagttgcagttcaacaacttccaagatcaggttgattatgctgtacaccatgcttagatcaatcaatctggaatattgaccaatactttggcaaacatggtgaaatcaatggttgatggttcaatggccgaataccaagctacaggaccagtttacttaccagggggagtattcccgaattatcggccattaatcaccgataatcaaccagttgtccagtcgatcccacttaatgcgcca

SEQ ID NO: 14456 - DNA, 535 bp, Oryza sativa
tttataggtggaggggaaggcgaacgtgcccggaaaagcctctgatttcaccggcgacgtggggtggagagagagagagagtggggtgggatccgaaatcgaatcccgccctctcgagcgcgcgcgcgcgggcgggagtgacggggcatgggcggtgacgtggggaggacgcgggaacggcgcggcgtgggcacgggaggagcggaggaggtggggtggttgcggcggttgccggctttggggcgaagtgggcggcgggaggttagggacgaccgacaggtgggccccacctgtcggtgcccgaaggagagagggagagagggaggactttgggacggggaagggggagcgggctggcctagcaaagagggcgtgcgggagggaggttgggcctacggcccaacaaagaaaaaagaagggaaagaaaaagaaaaggaaaaaggaatttccctgagatttaaatattgcagttgctcattttgaattggttaaaattatttccaaggctctgaaaattccaataaaaatcctgtta

SEQ ID NO: 14457 - DNA, 409 bp, Oryza sativa
gatgcaagctacctcgacagaccagcaaaaccaagcgatgatgttcggcacggggcattaatcgacacctgcagctcaacctcatgtgcaagctgtagcttcgccattcgcgcttccatacccacaatttaactggccctctcagttaaacgatgatatgatgctggttttatccgaccttgtcgatatgctgagtgggtttctagtatagttcctgttatcaagaagaacggcaaggtcagggtgtgaattgatttccgaaacttaaataaggctaccccgaaagacgaatacccaatgccagtagccgatcagctgggtgatgctgcttcggggcataagattttgagttttatggatggtaatgcaggatacaatcaaatctttatggccgaagaagatatccata

SEQ ID NO: 14458 - DNA, 626 bp, Oryza sativa
tttacggggtgcgcaagatcaaggagagatggtgatgcaggtgtttatcctggttcaggccctcgagaagaggtaataccctacgtccagtgtgtttttctctgtatttgggtggaaaaatgaactcagaagccaagagagaagaaggtagaagtctcggaaatcctccggcctagggaccccttccccctcttatataggatgaggggggagggttacaaggaaagtatctagttgattgcaactagatcctcctattccatctataaagatatgcatgatacccgagatttatatcttatcccggaaatctctctttctttatttacaagtatgccgcaggggcctagcacacttggcccaccccatgcgatgcggcccaaggtttgttgttgggtacctgggtatcgtgtaccccacagctgccacggcacacgcgatgggttgctgcttgtctgtgctgagagttctgtagttcggaaaaacacccccaggcagaaaaactgggccctgagtttgatgctcagctatcgtgccgtcaaaaaacccccccccatagatttgatcatgtaggtcaaaggtattgaccagcattcccgattggttgaccaaagcatgatgaacgg

SEQ ID NO: 14459 - DNA, 537 bp, Oryza sativa
tatcgtggcagcgtgaaagcttctcctccaaaactcaaagccgcgtcacctctcattcactctcgctcttgagccgatgaaaccgagagagagagccctgcttctccgccgcccataactccatcgccggccgcaaggatgacgaccgtcgcatcgcctattgagccgcggttgtctcgatctcttgtccgttcccttgtctcctctcagtgcaggttccgttccccttaagttcagtcgatttcatgcagtggacgttcgggaacgcggacctcgccatcgctgatctggagcaagcctggagcgccgccgtggatcgcgtcgccgttcctgtcaatccggtggatctcaagccgagcttctgccccacaaacaccaccatgaactcctctgctaaagcccacaagaatccccaagaatcgtgcaccgacgagggagatcatcgccgtcttctccaactccggtcgccggccatcgtcgtcaattcctcaaacctgggagagcttcggcgcaattcctcgcatctaaagcatccta

SEQ ID NO: 14460 - DNA, 515 bp, Oryza sativa
aaaaacaaaacgacaagtaaatatacagatcgaaacctaaataaagcgtaaaatactaatagaagaggcacttagtccccagaccgaaaagaaacaactgtgaaaaatagacgatcctagcggtgcttcagctccactccacaggcaaactcgactgggtataagccttggtcctctaacatcatctttagctcagaagcactacacttctgaaaagggggaataattagcaaggctaagtacaaccactgtactcagcaagccacacccatgatgcagacgtgcaaggggagacaaagaagggtttgtggctatttgcataaaggtggttgcaaacatattatagttgaaagcagaaaaactattgattaattaaggcaatattaaatctccactggacaatgctaccccacattgaacagacccaaccaaaccacctgaactacaccagttctttaagttaaattaattaatagaattgagtctaatcacgatggctagttgatcgcccataa

SEQ ID NO: 14461 - DNA, 505 bp, Oryza sativa
  unsure (1)..(505): unsure at all n locations
tatagggcgaattcgagctcggtacccaaatgccctccaacagcctctccatcctgttagctaagccatctggatggccaaatctcactcctcattggccaaacttggagagtcactttgcctggatggccccaccactccctctcccaccccatctctctctccctggcaagaaggcagcagaaccgcacgtcggcgacgacaaggaggagagaggcgccggagccagccacgcccgccgccgccgttgtccgcgccgttgcgtccccagccgcgcccgccgccactgccgtccccggccgcgcccgccaccgccaccgtccgcgtcgtccccggccgcgctcgccgccgctgtcgtccgctccgtccccagcagcacccgccgctgccccaccctttgctcatcgccgttgtgtcgggagtacgggaagagaaagaggaagagggannnnnnnnnnnnnnnnnnnnnnnnnnnnnnnnnnnnnnnnnnnnnnnnnnnnnnnnn

SEQ ID NO: 14462 - DNA, 719 bp, Oryza sativa
tccccctcttttttcctcccctctctccctcgggcccgttttattctcccttcttccctctcggcccagccacccggcccaagccgtggcgccccctggccgagctgctcccctcccgtgccgcgcacgtgcgcgcactgacgacgcgcgccccacgtgggacccgcctgccaggcgcgtcttcctcctcccgctcggcctcttctccctcccgtgaaaaccctagttcgttcctccttcgaatccgcgcaatttaagcattggattccaaaattgattagggggaattaatcccctttccctcctctctctttcccccttaattcccccttgattcgtgcccccaatcgccgggaacggacgcgccaaccccggccaccttccatgggcgccggccacaaactccgccgccgttccccgctcctcccgtggccggctccctctcctcccctataaaatggaaccaactctttgcgttctatcgttttagcctcctcccgcgtcttcccgtggccacaccacctctccccgccttctccttctctctctccggcgccggccggcatccagccgcctctccctcctcgcctgagtgccgtccggccgcaccgtcttctctctcggcctcgtaggtgcatcctcttccccggcgccgcctctgattcgtggggaaatcaccggagacacgcccccgccggctacagtggcggcaacaccac

SEQ ID NO: 14463 - DNA, 2120 bp, Oryza sativa
ttggccatttgaactcggaattggactgttcaagtctctaattttttcttaagaagtcaagaacccatttttgtgctttgttcatgcttgttatatggagtttattagagtaaaagcccttttcttttccgttggtcgtgtagatgctgcagcttcggaagatccgctcttcgtggaggttgaagccaacgtttgggaaagcgagcaaggcaagtcacatcattctttgaacatattggatcccactttgtgaaattactttgatttaaattattgcattatcgctttacttaaattcccgcgttatcactgttttatttagccatgcctatttacctttgttatgaccttattattgttgttattgttattattaccttgttcaccctagaaaaaacaaaaccccaactagtgggcactctattcatggttccactagtatgaagttaggtagatgcttcgctgattaattaggcaacattaggtggttttataactctagactttgggaatattcatatcacttgtaccttatggaatggttgatttattgtggaactggatgcacacctccccctctattcaaaactctcaaaatggttttaggctgggcttggggtgcatggttttgatagtagcacctcggccacataaggaccggtcttcgggcctcggttgcaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcgtggcacagggccggtgtcctgctgttaggggctcagtcctgcctacctgtcccggaggttccggccgtaggtggggttgggtcagtactcttgtctatggctaggatgggttggaaactatgtcatgtcttccgtccatatgccgtggtggtatgcggcacgtggttgcacgtgaggaagacgtgtcttgtgggtaaagatgtacacctctgatcagagtaaaacctattcgaatagacgcgccctcggttatgggcaagcctagcaatgtacccaagttagtgttttaaattcttaaaacctgtttaacaactaaaatgtggaatggttggcctgggttggcttgggacgagctgggacccagggtcgggttgccagttcggtctgaatcatcgtaggccttgggttaaggcaggttcgtgcgggttcacggccttgatttataatactgtgtagctctaggatcgtctttttaaaatggctttgggtaactaagtgacttttaaatcctatttactgcaaaatttaacccctattattagctccttgtacccccttgcattaatcatgcatctcccggtgtgatttgctgagtacagtggttgtactcattcttgctctatctttcccccccttcagtaagagaagctttagagaagaagtcttaggtggagtcctggcttataccccagttgagcgcctatgaagatggagccgtaggcccgctagtccgctgctgtttatttttgtttgtcaggcctgaagtgcctttgtaataatgtaaatattatcgatataataaagatgtgccttttgtatcatgtttgtttggtgtaccccggcttttcctgggacggggattaatacactagctttcgggaaaaggcaattttctcggtcgcgacaaatcatattgtcggaattggcttgatcggctaacctagtccgactcgaactttgtcgattaaggtcgcagccgattcggacttagccgattcttgctccgtttccacaacgatatttgtcttggattccgcttcgatctaatcttcatatccgatactcagattagcaaatttggttgttaacagtaaccaaagcaagatcaccccagaagtgatgagccatgatgaactatacaaggaaaattgatgcagtcagaatcaatgaggggtcagccaaacctccagttcggctgaaccacctctaccatgaatcgtcctctgttttataaagagcgcaggtttgcacgattggggatcctctagagtcgac

SEQ ID NO: 14464 - DNA, 2072 bp, Oryza sativa
acattatggaatggttggattattgtggaattggatgcacacctccccctctattcaaaacccccaaaatggttttagtctgggctcggggtgcatggttttgttagtagcacctcggccacataaggaccggtcttcgggcctctgtaacaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcgtggcacagggccggtgtcctgctgttaggggctcagtcctgcctacctgtcccggaggttccggccgtaggtggggttgggttggtactcttgtctatgactaggatgggttggaaactatgtcatgtcttccgtccatatgccgtggtggtatgtggcacgtggttgcacctgaggaagacgtgtcctgtgggtaaagatgtacacctctgatcagagtaaaacctattcgaatagccgcgccctcggttatgggcaagcctagcaatgtacccaagttagtgttttaaagtcttaaaacctgcttaacaactaaaatgtggaatggttggcctgggttggcttgagacgagctgggacccagggtcgggttgccagttcggtctgaatcatcgtaggccttgggttaaggcaggttcgtgtgggttcacggccttgtttaataatattaaatagtcctaggatcgtgttttaaacttagctttgagcaattaagagtcttttaaatgctgtttattgcaaaacctaacccctatactataactccattgtactcctttgcatttatgctgcacttgtgggtgtgtcttgttgagtacggtgattgtactcagtcttgctcaatttttcccaaacccagaagaggagcccctagatgatgaatgctttggtgtctagctcgtgcctgccgtcaagcgcctgtggtcatcgccttagtcttccgctgtttttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggttatttccggtcgtgacacctgtggtctttgtagtgtctaccatgtgatcctgagcaattgagaaattgaacaatcttgacttaagtcagcctaacttttcatgaagaacaacgtggggttttttccagtaacacaaaattacaactttgctttactccaccaatgattctctcaatcactcaaagtgtatgattcctcacaaaggcatatgattgtgccttttcttttcctaccacctaataaggcatatgtggagctcagggtatgaaaaagagtagagcattacttgcaccacatatattgcaaagtcaaataatggatccgcggaaatagaagacatactttctggttaagaatgtgcatgtgtatgtgtatggtgaatttgtaaaagaaaaataagaataactccttttgtatacctcctctccatttatttattttttttgaaatttcgaagagtacatggctatctttttttccctttttttcttttttttctcatcatcatgctccatacttgtatgagcactttttttttatttctttttgctaagccatgcatctctcactctttttttttaaagaactttggaagaagaggcataaatttcatggagtatttattttgtggaatgtggatgaaatgaatgataaatgaggaatgctaacttcctgtgtagaagtcaagcattggtgggtgtatgtggagtgtatgtgatcttgaccataaagtatgaaaagcatatcactagggtcacaaaacttgacaacgctcaatgtattgacaagcagcgtatctagcaagctaatcatgaacgatcaacctatggctctagtgggaataaaaatatcaatgaggtatttaacatca

SEQ ID NO: 14465 - DNA, 1526 bp, Oryza sativa
gctagcagtataatcagtataatttaaacataaagtaaagttggcattcatatactcggaaagtatttcaataccataattgtataaagaagaatattctaaataaaatacaagtcttacaaaagaagaaaggagagctgctagagccatacccaaactcttccgaagacttctggactccgatttctattatattcctactccactagcttgatactactaaactaaacttgagagaatatgagaaagctcttgcttgaagtgtgtggaaaatggaatgagaggagctccttttatagctgctaatgacggttgtggcagttggaaatttcctaactgccctgcaactgtcattgaggatgcatcctggatgtccacgcaaaaccacaggatggaaggcgctgatgggggttcggccgaaccatggcctgggccaaaccagcccatcctcggctggcggtctcctccattgcttctctccgtagacttgtgaattttggcccaattggttatgtcatttttgagtttttggcccattcatacataagtctgatcctcgacattgtccgattgattgatcgtctgatttgatgtcgattctcctccactctgtggttattctctgcaaaaggtcagtaaacctattaccagtggaatattattattctaacacaaatatgcattacaagcataactatttctcctctaatttggtagtattgacggtcgaaactgatcgctaacgtccatcaacaaaaaccccccaagcttgaacctttgctcgtcccaagtaaaggacgaacggaaacaaagacttggttgttgatcaggaattgctactatgctgtatatctcaaatgtacaggtgcaaggtatatgtactctctctcaaattaaataatatttggcatggtggcttacccttacccctaattcccacaagacactgcctttccttgccttgagcggttgaaagatagaacaacaattagagcactaatcacccaatttttattcaacttttattccagaagttttcaaatgattttacaaaagaaatccaagttcctcaaatgattcactcagtctctccaagtgtatcaatatgaattcctcacctttttgcccttttagattcctactctaaggtttgatatgtggagctcagtagggatcaaacatggcatacttgcattcacgtttattactaagtcaaaaacttagactaaaatagatgactaaacatacttaagatcaagatcgtgcaaagtgtgtgtgtgatatatggtggaaatgaaatgtgaagaaaaataaagaaaacgcttctcctttgtgcttactttcttctcccaaaaatccttctttttattaataaggagagggcatggctacattattatcttttttttcttttttttcccatatcatgctcatacttgagagagcataactttattattttcataaccatgcctttccctcttcccttttttttttcaaaaatgattttctttttaggagaagaa

SEQ ID NO: 14466 - DNA, 489 bp, Oryza sativa
ggctggcgtaggaggacggggcacacgagtcccttgttgattctgctgctgctgcggctgtgggacgcgcaccacgaattgaggtcgaggcgcggagcgaggttgttgctgctgctgctgcgaagaggatccccctgggtagggattggtgtagcgaacccgctggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcccgccaagaacttctcttgcttctcctcatcttcccgcacatcctccggagcgtaacgggccaggttgttgaactcgtgcaaatactccatcacggagcgaaaaccttgcttcaactcccggaactccctcttcttgagggccacgactccggcgggcacatgggttct

SEQ ID NO: 14467 - DNA, 351 bp, Oryza sativa
cccaaggatgacccaacaaaagtcaacaagcttgcataggaaccacatcacaatcaatagaatctgcatatgtctcaatggaaaacgaaaccctacaaacctgtgttacctttgctcttccggaatcgtttaactactaaatatggtaaggatgtggatgtgtgcgtgtggtcaaaccaagcttctcgaccaaatcatcactcaccaaattgttgcagctatctccatcaatgatcacacgtgcacgacgtttgttgatgacgaagaaaatctgaaacaaattatggcgttgcaacctctcaggttgctgtacctgcgtgctgagcacctgctatacaatgatggtcgtgt

SEQ ID NO: 14468 - DNA, 4442 bp, Oryza sativa
ttaactttgcacattttaatttttgaaggctttcacaagcattttaattattctaggtataatttagaggatgtattttagggtcgatttgggacgcgacaactggtacaggtatggctttgaataatttgtttgcatgattattagtaaggaagtcgtaaccctgttgtagagtccatagccttcactcgggatgagcaaatgttaagtgtaggggtgttgttgacggtcattaaatcataatatttgaccgtcaatacctacatataatgaaacaaaacatggtatccaacttagtggtagggattattactaatcaattccactagtgttggtgaaatatgtgtatgcacgtattttaatgagaaaacacacccgacatgcgaggaaacacacctccgaccaatcagacgcgagcacacagattggagggcccacaaatcaggtgaaaccgcccgggaacgggtcataactgccataaccgccatcagggcccaccagtcattgtcccagccaaagcagaggccaggatgtggggcccagggttcggccaaaccaggtggttcggccgaaccaccacaagctcctttaatcctggccttccacgtgtacgctgctgattccttcccaatgatggttgagggcattttggtcatttcccatacatgtaaccgtcatatggaggctataaatagagctctccttcacacttcacaacacacaactttgagctaaattacaagaggctctattgtatcttttgtacattagaataaggtagagagtgaggggaagctctggaggagtgcccggaagtttggcgctcatccgacttctacctcgataagtgtagcttcatatgggtaattctggaggagtaccggagctgtcggtacactctgctcctggttcggagaacttcttctataaagtaagcattcgtgttcctttttttttgttatttaattactttgtctaagcgatatagatttccatctttgcgggttcattgtttagtattcgtactaagtgctctagtaataggactctagataaagaaggaagttcttgtacaagtattagagtagtaattaataacttagacgtggtgtctaggttaaagattacatttgtttgttgtgtatcccacggatttgtcagagatggacggcaggtggtgaggggatcctctagagtcgcgtccaggtatcctccacgttcggatacatcatagagctatagccggaaccacgttggcagaccagcaggggtcgttgcccgaagcaatacataggaaattatctttacttagcgtagataattaaaacacatagaaagtcttctctagcctagcctacctatcatctgttgttgtccttggataatcttagccttaggtagattacacacgttccctgacttcgatatcctttaggagtcacccgaaggtgaagtgctacagcggtattccgtgcgcttgcggatttatctgtggtcataagaaataccaacacccttgacatgcagacgagggagatctagtacgacctcacagaatacatggctcaaatgcaagaatggcaacagactgctgatgctcaattcgccaacttcaacaacatgatgcagcaacagcacgatgaccttcaagcgtacttccgctttcaggggttcaattcttatcaaggaccctgagcgaatgccaagcttggggggagagatgtctctccccccactgagataacttgtatcacattggatatttccctttccaattgcatatttgctttcaaattgcatcttataaaacttgaaaacaatataaaaatttgcaaaatagaaaataccaaaaagataggataggtttgggtcatgctaggtaagacaagctagttctcttcgttgaaatgatgaatagttgctctgttttatatctcttatatatgggttcatggtaagtgctctctcaaaggttaaatataagtagccaacaattatctgagaacttgaggtaaatgggctgtacttgccaatctaagtctaggttgttgcgatatatgacatagtaaataagagttgctatgatcctgatactagtttgaccaaaatagtggagaactagtgatgcttgcaatgcataaatatgttagaacaataatattccactagtgttaggtatactaattaaccttttgcagagaataacactaaagtcgacgagaatcgacatcaacacagacgataaatcaatcggacaatgtcgagaattagacatatgtatgaatgggccaagaactcagaattgacacgatgatttgagccaaaaatcacaagtctacataaaggagcaatggaggaggccgccagctgaaagctgggttggttgggccgacccatggttcggccgaacctccctcgccttcgttggatccatgttttggctggacggttgagatgaagccccaatgaaggttggagggtattaccgaccattccaaccgtcacaaccgtcataactcagctataaaaggagctcctcttctcacttcactcagacacatcaagcaagagctctctcatttctctcaagtttagtttagtagtatctagctggtggaataggaatagagtagaaatcaggagtccggaagccttcggaagagttcgggtatcgctctagtagctttcctttcctcttttgtaagctttgtactttttttagaatactcttctgtagacatttatggtattgaaatacttttcgagtatatgaatgcctactttacattatgttcatgttatactggatatacggctaacttatctgggagatgctttggtgcgggtataatttttgcttatgcaattactctatgtcatgacgatgatattagagtagtatctggtagtttagacgtggtgtctagattacgggatatcattatttagggttatatgctgcggatgagaggtgggccgctgatggtgacagctcagtacgggtattcctccgtgcctgtatatgatcccaagttaattttctggggagggtattcctccgtatttagccccggttgtattgtcatgacgggctgtcgtaaggaactcggcaatcaggggtggcttctcgaagtaccaggagggcatcggatagaggatattagctagtgtatcagataactagaatgtatgtatactatgtatacgagattaagtgctacaatactatgtcggaggaacagttttgcactgtagtgcgtgactcaggttattgttcgtctatgacgttggagcatttagtcagaggagccggttcccatggaatccatcgacgcctaatgtctcctacctctcccttacaccatccgcaaagcatcaaaggtctctataatttcatctccctatatctctcttagactgtgtgcatcttcggtatgcacgaatcgaaagtgttctgaatataattgtatcatcttgatgtaatgtgaaagggcatatagccttctcttaaaaaaaaatcatctctcagtctttctagcctgtactggcgtgctgcacggtcgcctgctcagcacatgcccttatttcgcatccaaaatcaccaagaacgggttcaccaaacacatcccaaagcttcgattcagcggtggccggaactgaggtcttgggacttagtatttggtttccgctgtcctcgatggacctcttcagggcataattcattccatgtctctaatttattgaccgttaacgatattatgcactatatatgtcataactacttcgtgtactgttcacatttatggtgggctgacgaattttgactcttttttttttctaaatcatccttacaaatttagaaaatgtctattaggtactgaaaaaataaaccatccctacaaattttgtaatgcatatcgtaaaaaaattttatatctaatatatatgcacttttgcagccatggatcgaagttagatgtacgaaaccgatcgacatatcaaggagtatagaagtggtgtttcaaattttataaacgtcgcagaggaggagaggaaaagaaggaacgattgcatgacttgtccatgtacaaattgcataaatgggaaggagtttgatagctaactagatatacactctcatatgatacgttgagaattcatgaaggggtacacatgttgcatgaagcatggagagcaagaatactatagatacagcgagtagtggtgcacaaaaccaggaaaaagatgaagctgacttgttcgtaacttctccgttgagcagtgaaatggttgatgtcgatcaagatgttttgtaagcaatgttgcgcgatgttgaggagctagattataatgagagagattatatgacgttcacctcaaatcaaagtaacatcccaaaacattcacatcacaaatcttaagttacttatacacacaaatca

SEQ ID NO: 14469 - DNA, 3072 bp, Oryza sativa
ttagtccaggtttataacaccaaccgggagtaaagttgggggcctgacaaggactaacaggtttagaaccgagactaaagatcatctttagtcccggttggtgccaaccgggactaaagatcaaatatgcccactgtagccaccaaccaggactaaagatcatctttagtcccggtttttagtggaatcgggactattgtggatttcggccgaccgaccaaagattggtttctccaccagtgattagaaatatagatttaaactgtttttgctgtctcttgtaagcatttggtataaaataatttagcaattttgaattaataagtacagaaataaacttggtttggagttaagctttttcatgatttaatgattcctatattcatagttattaaatatcaagttgtattccatgtggagtaaagtgaatgaaatcgattggagcgagagataattgaatgacccaatagagcgaatagatttcaagagtacatttaaaaaatgtgaagcggtagcaataattatacatgagttgaatatgatacactacgccagatcctcacacttctgacgggatacctatgacgggcaacggatttggtcactagtgaccattacctctgacgggtcagacgggataacgtcaccggtgagccatccggccgcggaccgtcacaggtatcccctcacctgtgacgggccgaaaggaaaacccgtcagaggtataccagtgacgagttttgcttccaacctgtcactggtatcccctcacctgtgacgggccgatacattagaagccgtcagaggtgatgggccgccacctgtgacggctttcatttctggcccgtcgcaggtgaggggataccagtgacgggccgttgaacagaagcccgtcaaaggtatgagcaatacctttcacgggctttttttatctaacccgtttgaggtgtgttgggtctataaatacccccaaactgccaactgctttccatcccgaccattgtactgttcacaaatcagttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagaaggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggacaaagcatggagagcaagaggcgcctgatgtcgcagctgaagaagtgttggatcaggatgtagagaacaccgccgcaactcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagaattttacagaactccttgagctgttaaaggatctgttgccagaggggaacaatttacctgaaacgacatatgaagcgaagcaagtattatgtccgttgggcccggaggtcagaagaattcatgcatgtccgaacgactgcattttgtattacaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgtgctggcatgccgaagaacggaaagtcgatactatgctgaggcacccagcagattcagtacagtggaggacaatgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcaaatgcacaacaacctccatgcgatgctgttttgtaccatcaacgataatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagaggtacacccggacccctgacagagctaacagggacagaggtgcacaacttagtgatgggaataaccaacgagtttggaaaaaagaggaaagttggaaagcgaaaagagaagagcacatcgaaggaaaaaacagaggagcatgttgaaaaacaaaagacaaaagagaggagcatgtggaaaaagaagtcaatattttggagactaccatactggaaagatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatctggcagggtttaccttcctccagcctgctacactctctcgaaagaagagaagattgatttgctaacatgtttg

SEQ ID NO: 14470 - DNA, 1836 bp, Oryza sativa
  unsure (1)..(1836): unsure at all n locations
ccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatcagacaggagaacccaggccgatcagagagttgggtcaggaataagcacatgtcttctttcaacgagttggctgaagaaccgaattgccaggttgcagaacttgtctagtgaaacacttcagtggttgtcacagggtcctgaatggagtaccaccacttggcaaggatatgacataaatggatacacctttcacacggtaaagcaagacagcaaatgcacagtgcagaacagtgggttacgcatcgaggctgctagtgacggtggtcgtcgtgatcaatactatggtaaagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacagggatgaaccgttcgttctcgccaaacaagttgttcaagtgttctacatagttgacccgtgtaacaagaaactacatgttgttcgtgaagggaaaaagagaattgttggattggacaacattgcagacgaggatgattacaaccagcacgtccacggcataggtcaagaaatacctctagaagaggaggaagaagaagatgaagttcaatatgcacgtgtcaaccatgaggaaggattatttttgtaatttatgtacgtagtttatgtctacatgtctattatctgtatgactctaatatgttcgcaatgatcaatagtatattgcttatgaaatagtcaaataaaataaataagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaatttctctaagcaaactcacctgtgacgggctctatcagtagggccgtcacaggtgacctcacctgtgacggcccagagtgttgggcccgtcacaggtgggcttacctgtgatggctccacggttggcgcccgtcacaggtgaggccacctgtgacggccacatagttggcgcccgtcacaggtgagtttgactagggttgacctagggttggacatcttctagatcgatccagatccggcacccactctcactcactcactctctcgaccgccgcctcgcctctctctctctcgatccagatcatccaccctccttgccgccgcctcgacctttccaccgccctcctcgacgccgcctcgacctctccaccaccctnnnnnnnnnnnnnnnnnnnnnnnnnnnnnnnnnnnnnnnnnnnnnnnnnnnnnnnnnnnnnnnnnnn

SEQ ID NO: 14471 - DNA, 2021 bp, Oryza sativa
ggtgctgctgtatagatgaattaaatgtgatttgttgtctgtggatgttttggatgaatgtaggggctagattttatatacttgattttggtgcagtgaatcttgaatgtggatttaagtgcaactgttgctgtctatgtttgcccttgctgtctatgtttgcccatgctgctgcctatggttgcaactgttagttaagtgcaacttgaatgtggatttaagtgtcatttggacatataaccattcatggagtgtgtactgctatatatgttgctagacctattgaattttgtggatcatgtttacatttagctgaaaaaggataggtcagtgtagtccatggacggaaccgacctagacaccaaagttctccatgcattttgttttctgtcattctttgatgatttatatacccttgctgctgctgcccaatgtgttccttattaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattgagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtacgaaatttataatctttttcgcgaaagttaaaccatgtcaacgcccggcgcaaacccgccctccccaacacctgcgaggatccaggaagaagcaaacccggccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccctggtcacaaaatatatggctgtcacgaccgaaaataacccaacgggcgttcctgacgtgcgtgcattaatccttgtcccaggaggcaaggtacaccaaaagttgatacaattcagagtttaacaagcggaagcgtaaatagttatacttattacatgggcagcgaaggcccggcacacaaagacaaacgagaaacagcggaagactatggcgactaccacatgctcttgacggcatgcacgagctagacaccaaagccttcatcttcaacgaacttctcttctggggttgggaaaaaatgaacaagactaagtacaaccaccgtacttaacaagacacaccccctagtgcagaaataaatgcatggagtacaaatgaatcatactgtaaaagggtagggtt

SEQ ID NO: 14472 - DNA, 539 bp, Oryza sativa
  unsure (1)..(539): unsure at all n locations
nnnnnnnnnnnnnnnnnnnnnnnnnnnnnnnnnnncttttgttgaggggaaaccagactgaaaacacttgttaccagagaccgggttagttctattaaataataccccatgaaaaacacttgtagaaaaatttaactattttgagcatctaaataaaaaggaacacatttttacatgctaattctacttaagtccatatcacaatacaaacctttcttagtttctgaagattgacactagatacttcatccccatcctcatcatcatatcccatctccttatcagactcaatattctcatcttcttcatcaccatcaaatccatccaaatcttcagctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14473 - DNA, 736 bp, Oryza sativa
  unsure (1)..(736): unsure at all n locations
nnnnnnnnnnnnnnnnnnnnnnnnnnnnnnnnnnnnnnnnnnnnnnnnnnnnnnnnnnnnnncgaacaagccctggatgaagaggaaattggagaagatgttgatcaagctgcagccgagctaagtgacctaggagaaaaaacaccatcggctccacctaaaaagacgcctccaactcctgcagctccaactcactttacaagggtaacttatcctgacaagctcttaaaaaatttccatatagccgatcattcattgaacttgtatttgtagaagaagaaaatcgcttcaaagaagacatcagcaaaagcatcatctaaaccagttccatcggtaagactccttctgaagaatcttttaaaatttaatcataaccgatgctaatttacatttgtctttttagcctactcctcctccttcaccccctgtgcagccgatgtcaagcggccgtactccaatggtcatgggcagccatcatattgaagaagaacaacaaccagccgctcctgctatcccagtaaatctttcttttttcaaaaaccccaaatcggctgtacaacatgcttcagtgttaacccttttccaactttcatctttataggtcttagccgatctattctcttttgacatcaaggactacttcgacgaggtggaagaagacaccaccagcagatccctagctcctctatatgaagatgttagaagaagtctcgaagacatttgtcatcgtctagag

SEQ ID NO: 14474 - DNA, 776 bp, Oryza sativa
gtgtactcggtctaccgcggtcctttaggttgacatgtggggtctgcatgtccacaagcgcagccttcctatcttttccacgttagcgcttacacatgttttatagttgcaaaacataattataataatccgcaaatctccatgtaacagcattaaacttcggatgaccatgtcttggtcatacgagctccgaattgacccgttcaactctcttaatgtttgttataacctaaagaaccgtgtgctttctttttatgtattgttattgcttctttataggcttgtagctttgcttgtgtgcttcgcatagcttctgtcgttccggaggttcctgaagcgtggtttgcagtcgttgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcttatttacctttgttatgacattattattgctattgttattattaccttgttcaccctagaataaataaaaccccaattagtgggtactctattcatggttccactagtatgaatttaggtaaatgcttcgctgattaattaggcaacattatgtggttttataactctagactttgggaatattcatctcacttggacattatggaatggttggattattgtggaattggatgcacacctccccctctattcaaaacccccaaaatgg

SEQ ID NO: 14475 - DNA, 554 bp, Oryza sativa
gaattcgagctcggtacccacatgctctagcgcatgtgctgtacatgcaccccgagacgagccttggccttcgtgaataggaagcaatgaacctaaccagaatccaccaaggattgtggtgtggcaatcgaatctcgagcagcatgcttttcccattcgaagatagaccaaaatggggggagggggggggggagggtcaccacttgcttatttactctgctttggactgagtttaggcttatgtaggtgcctgggatttgaaggacgagagtgtacatatggtgaaaatagacgaactatagctaaaaatacggatttagttcggagggaggtgggaggggggttcacgacagtggtcgctgccaccgtgctgctgattccccggtcacagcttggctgtccaccgcaattgcactggcagccgacaatgttagtttggtcaacgatcatgacgctgatgaagtcgctgacgtgcccttagtcacgacgtgtgcagttggtggttgtctcccccagattgtctagcttttgatgacggatgtcaatactcataa

SEQ ID NO: 14476 - DNA, 3193 bp, Oryza sativa
  unsure (1)..(3193): unsure at all n locations
caccactaccactggtgctctgatccatgtttggaacaagagactcctctcctgtactgctacctgagccatgcttgtcgatgtttggaaggtggagagcaacacctgagccatgcttgtcgatgtttggaaggtggagatcgtggctctccagtattcggttaatggtggatagatgcccccggacttcatccatcttttgtgaaagtggagctcatggttgtcctgtatgtagatgatggtggacaactaacccaggacttcatccatcttggcgaagaggggtaccatgccttcaattgttaacatcgagatggtggtggcgaaagagtgctctgataccaatatattatggatagaatttaggtggtgcatgaggttgcgaatgttgtacgagcgtccaataggaggcttagtccctagtgccctaggatgctgaggcaccagccgtgagtgaggacaaggaatcatcatgctgtgaacaacgtgcaaggaaggagatagtttctgcttattccttctttattgtccaatagtacatcaaattataacctaattaataggaaattaccaactagggatatgacacactaaaaggaaacttgatggtgcacccggcgtgttcttggactgctgcttgcgacggcggtaagtaattataacccatgccacatggttgaggccttaacccgtgcattgaggccccaatcacgtacacaatggccgcccactatttgtaggtcggttcaaggggccagcgaatgaccttttcttaaaccaactctgaaaattcacaccagagttgaacccatgagctagtaggtgctaccatgcataaaagtgtaaatactaggctgcatacccattcacaacgacggttgcccatattttcttggaggcatgctttaatggggatctaacatgtgatcaaccgtgcacggacgtgctccccccatcccaacgcgcggcttcgccccccttctcatatggttttcaagaaagaatttaatatatgtttagaaaagaaaaaaaatactaacaaaagaagaaaaaatctgctcagacatattcatgtgtataaactttatacacataaaatctatgtgtataaacattcaatgaagctaaattcggtatgagatatttgaatccatttgtcagacatttaaaatttggtgtataaactttatgtgtatagactttgggtgtataaactttgattgtataaactttagctgtacaaacatttcaaataaggaaagcatgtggagcaagaaaagaaggggtgcccagaaagaaagggcgacctccacacgctgatacatgagcattggcacgccgaattcgggcttccttgcctttggtcgccaccaaataacaaagagaaaaccaatgtatgtctagagtttattaaaagggattgtttagattccttgggtggcaatcctatagttctaataagtccactcttaattaatcaaaatagagtctctttcatatggataaaaggtcaaacaacaaattccaaacctaaatatgacaagcattttcaatttctaaaaatttacaaaattatatgtagaagtattcaataacttgcaaaatcaaaaaaaaagcaaggataattcagtattttgaaacatacgcacaatgacctacaaataaaaatattcttatttcctttataacaacagacaatttaatttcgtttatctgaaacatttttccttcaatggaaaaagacggaagttcatgatatagtagtttccgtcctagtttttattgtggacaatcttgatttgcatcttagcatttagcgttcaagtcaagtaaacagtaccagtgcctagcaacacgaacataaataaagaaccgaagatacacttccatgactataagtggcacttaatttatttaaggagaataacatcatgaacttgaaaagatggacatataagaggattaatagcatgcaacaataataataatgatgcacatatggattataaaatagttagaccgattaaaaacataaaatagatatagtgaattgaatagagtaaaactgctgaatgatcacgcataaaacaacttcatgacacaattaccttaaagatggtaatagcccaaagtcttatcagcggtactagaacccttcaaacttaaagaacaaatcaagttcgaaacatattacctctagaatgaaaaaattacctctagaatgctcaatataaaatctgaaagcccgaaaacctgaattccgacaaacaagcaaaactatgtttacttattattctggtcataacttttaaaccactcaaattatatatattaatttacaatgcactatgttggcgaatggcctcacaagtccatgtaggaggcatcctatcatggaggagaggggaggtggaagcagtggcttgtagtagtgtcagggtacactcactgaggcacattcctttggagaataaaacgatgctccacaccgcagaggaaacggcatggggagagctcagtgagggcaagcatctccaggtgtttgtctcgttgttggatcggtacctcagacacgcagctgctcacgttgacaccatatctgcaccattgctgggcaagtttttgcatctgcattgatataaggcttatcggccgatctctttgccatatatgtgccacagctgtcaagcgtgacacaccactgcaagcttatcgtctgatatgtgccatcaacatcgtccttcagccgagcagccctcggcgccacagagctcatcagcccactgcacaaactccatggagggctgctcacgatccgtcatccgtgttaccacaagcccttcaatcgtgggaggggacggtgaaagtggggaggtggtggtgattggtgaagagtgatgactcaaagctttaaagtaaatgaggatggcagcattcacagtgaatggaagtagttggaggcggaagtggcgatggtgatttgggagtagaggaggacaacgacggtccagacgtgtgagggtagatgagtatgcagggttatggttaggctatgatagtttaaaagaaaatttcttaccatataaaacaggaaccatgagatgctgagcagcggtacaagatttggagcacagcaaactggtttgacaaacttgggannnnnnnnnnnnnnnnnnnnnnnnnnnnnnnnnnn

SEQ ID NO: 14477 - DNA, 1511 bp, Oryza sativa
  unsure (1)..(1511): unsure at all n locations
nnnnnnnnnnnnnnnnnnnnnnnnnnnnnnnnnnnnnnnnnnnnnnnnnnnnnnnnnnnnnnntggtggtgattggtgaagagtgatgactcaaagctttaaagtaaatgaggatggcagcattcacagtgaatggaagtagttggaggcggaagtggcgatggtgatttgggagtagaggaggacaacgacggtccagacgtgtgagggtagatgagtatgcagggttatggttaggctatgatagtttaaaagaaaatttcttaccatataaaacaggaaccatgagatgctgagcagcggtacaagatttggagcacagcaaactggtttgacaaacttgggacaacatatttgaagtagtcaatcctagcaacttgatcgtatcctcctcgcatgaatgttttctcctcgcactcactcgctaatcaatgccacaacatgggcggactactgctatccacacgtctatgggtggaacgttgtgtgcagacacgtctacctacagctagtgtttggctcgtgagtgcaggggcggctagggtttatcatgatggttcatgtacttgcatgtctcatttaccccctcaaccgtcgcccttgaatgaatagaacttctaattggacctccaaggaccattaggacgcttacctagatccctatccaatcaagtcatttcaatacattaaatgtgtgacccaataggttcgtgtacactcactacatgtatcataacagacctagatacttcctttatagcaatctagttacgtgcagtagcatttgacaacctaaagttagccaatatgcttgttgagaatcatgataccacctatgatatacaatcaaggaggatttagaaatagtagcatattagatgaagagtatcacgaataagtcacatattcattgatcaatagtaagtcatctatctcaaggaacacttcattataattctagacaaagtatgtgaaacaatcatctcaatgattgcctctagagcatatcactaataagggacaacaatgttgcttgtgctttggaggaaatggggatggtgatggtgttagtgtgtaggcgatttgggatcggtgtccaatgtgcggtgagcagagtaattgtgtgagggagatagatgagggtgacgaaaatgtgatgcttttgacaatggccagtggggcatgggtaaggaaatggtacatgtatgatagtacttagtgccataaggtttgtagtgtaaaatttgaacatttttagttaataaagggactaaaatggtcaaatagttaagggttgaaatgcaaaattttatagaggaagtgactttgtgctatagtctcatctatggttttacaagtcatgttctctcatacataaaccatctttacaagcggtcaaaacataaatttgtaaacgactatgaggcccacatgccccgaggtgtctgtgaaaatcggtattttcccaaacaggtagctgaaccgtgtacgaaaacagattttttgcataa

SEQ ID NO: 14478 - DNA, 6167 bp, Oryza sativa
  unsure (1)..(6167): unsure at all n locations
caggattggctcataggatattttgcattaaaagcagcatttataaatcataagttgaaaatagtaaaacaatagataattaagaagtattaacatcatcactgtccaatgctaaaccacgttgcgataggcccaacccaaaaccacctgaactacaccagttcaagaagtcaaattattaaggtgagattaatcacggtgagctagatgaccgcccaataaccgcgggcacggctattagaattgttttactctgatcagaggtgtacaactttacccacaagacacaattccgcacatgaaaccatgcccccaagtaccgccacgatactgcaaagggataaatcgtgacaaaatcctccatataaccaccactaaccagtacacccacctccggtttcacccctatccccataaggcgatgggcagtccccgctcatgccttggtaaatccggaagcagcgtagaccccccccagcccatccatactccatcacgcctaccctcgccaatggtgtgctagctagaaaatataaaacttaagatttagcctggagcccatctggcttgtggttagtacaagcatatcttccagggattcccttgaaccggtccttaattgtcatgggcacgaccaccaaatgaatcatgcatgtacccacgacccaccaataaagcatatataattaattaaccatatgccaaaatggcacaatatcagcataaaaattaaggactgtattacagtgaatcttattgtgagctagttgatccaagcatggctaagcatccctagaccaatcatctagtcaaattattatcctaggctatcaatgaatcagggtaaacataggctgagtactggtaaattccatcccacatggcataataaaataatgcaaatttaagagaaaagcaggggttttgtaaataggctcaatatgatcaatgatattcatatgacttgccttgctcttgagctgacgggacctcagtgaccacttcaaaataaactggagcgtcggaactgctggagtctaaacgacaaacaaggcacacagtaagtacaagctaaaaagctactgaaacagcaaaagaaaccaattttattgaattcttgatattttagcgaatttactacaatttgaatgtgttaaaacggagctcagattatttaattatcaattttacaagatgctctgtgttattactaataacagaaaaaacttaatcatttgacagagattaatgtccaaaacaaaataagatcaaaggatagattgactggctagcgagcctcacgagataccgactcaacgagttgattctacgtgacaggggatcatcgaaatgatcaaccgaaactgacggctctgaacggctctaaactaaaggacaactcaacacggacgaatgaacgaaccacgggagcaccttgttcgaacgaacgagcgaacgactcaacaacggctgcggctaaaccggcgggctagacaggattcacggtaaagccttggtacggcaaacaataagccggtaggaacctagggttgcacctacggctagacaactcaactactgaggaacgggacaaaacaacggctaggttctagcaaagcgcaatcatgacacaacggcggcaagcggctcggcacgacaaggcggcggctcatcatgacgcggcgctgctcggcacggcagcgacgcggctcggcaaggcgtctaggtggggcaacatggctgtggcggcgcggcatggcggctcggcacggtggtagctcagctagacggagcggcacagcggcggctagggtttaggcggcacgattcaaaccaacaaaaacaaggggaaaaactaaccctaaaacagggggaaaaccttactggagagcaaaaccagcgagggagcacgacgacgatgtcggcggtccgtcggcaagcacgagattgatgatggaggcggtgctagagaggacacaacgggttatgttagacagggatataattgacattgggttcaaacaattcaattaagaggaaaaatggatcaccggtgacgcgaggcgacgacggcggctaggttattgagttgcagaaggacaaaaaaaggggagggatcccttatataggggaggactaaattaggaaatgtgcagtcctagggggagtaggattgagaggaggggagggaatcggagtcggcaaaggggaaggncggcgcgcgcacggaaggaggggnaggcgtacggttgaggggaaagtgggaaggaaaaaggaaacaaggggagactgggactttcccgaaaaggaaaagcaatgcagtgccattttaggaaaagaacggaaccggatattgttcgtcatgcaaaacgaaaccgcagaccgagaggggtgtgaattgggcacaattcacgagcaaaagcaaaggaagaaattattagcttgacacttttacttagcaacactgcctccattgttctaatatttactctttaggtcctgttagtgattttcagagcaaagagaatttgaaaaaaaaatttccctgacaattccgattactaaatgcattgttaattgggtttttctcctgattaaccaaagcaaattcttgaagccatttattagtgatttggaacctaagggaaggtaaaactcagggtgtgacaaacctacccccttaaacagaatatcatcctcgagattcggaagaactggcgaagagatggggatggatggctttcaactcatcttctctctcccaagttgcttcatcttccgaatgatggctccactgaactctacaaaacttgatcactttattcctggtgttcactttccacttgattcaaacttactcctttcttctgagttaatggagactgcatcactaccacttctccttttccattaactaacgtaactgtgcggcttgcacaatcaatgactccgttgtgttttgtcaaccaatccattcccagtatgacatctaggtctttgcactccacaaggataagattggctagaaaaggtgacacttggatttctatcatcgtagagggacaaaaactaactaatgttgagctatttcccggtgtattaactttcatgggagaactaagttccacttttcttaacccgtgtaccccaacaaatctcttggatataaatgaatacgtagcaccagaaaaaaaaaaactatagcaggaattgagttcgcagggaacgtacccaaaaccacttccagcgctgcttgagcttcttccgtagacacgtgattaacacgagcttgaacaatcttgggtccattgcgctttcgtttaggacacttacctgcaaaatgtccgggatctccgcagttgaaacatgtgaggggctttcctcctaactccttcggctgttggggctgcgaagcttgagactgtttcattggcgggcgcggaacgggattacggttgttctgatttccactattgccttggctgaaatttcctggctgatacggcctgtgctgtcgaacaatcatagtagttggaccattgtgttgacaatcatagtagttggaccattgtgctgtcaaggaccgtagcggagcttctattgtccatcttgctgactcctgaactgtatagctttcctcttgcgatccattttgttacgctagtcttcctgacgaatggctttgtccacaattctctgaaaatcagcataatctctagaaatcaactcgttagtcaactcatcatacaaacctgccaagaacttttcccatctctcagcatcggttcgcacatcctcaggggcataacgtgctagacgattaaactcatgcagatactcagtaacagtcatgtttccttgatgtagagacctaaactctcgcttcttctatgcaacaattccatcgggaacctgggctttcctgaaaacacgacaaaactcatccaagtaacttctattccggctgaataggtaatcatttaattatcccaccaagctaaagctagaccttgcaactgatgtgtggcaaacgcaaccttctcctgatcagtgcacttaagtagattaagtttcttctcaatggcgtacaaccaatcgtaagcctccattgggttacttgtgctcgagaaagtcagcggacggacacatcaaaactttggcaacttggactgagggggaccattgtgctgctggttctgctactgttgctgcatcatatgttgcatcatctgatgatactgttgttgcatctgatttatcatggttgtcattatctgagtctgtcttgctattgtctaggcaagcggaggattctctgatatatctcctgaaccatttcctaacagctgttcctcattgacattgtttccagaacgggtagtccttgtgttcaccatctgaagcagaagacgagaagagaaatagggaaggagaaaaacagttactagggaacctcattacttttttatttattgttcaactgtaattgttctgctctggtttaaaacacactaaaaaatccttaagtagaacgtcataccataggcacatggtatcgactgtcaactaaaccccacaagcaaacacacctaaacacaaaaatctaccaagcaatgagtaaacaaaacggtaaactagggtagcaagcctaatgcttggaacagctcctatgatcggcagagacgacatcgtcttcttcatcaccactcgaactgctgctactagagattgacacgatccacttcactgcatcactaactgttgcggctttggcggcggagagcatcggcaactgcgaagacgcgcgaactgggacgggaacgggatcgacggctaggacatcgactggggcgggacgccaactgcatgcgaatgggagctgtagacctcttcctcgacattgtccggattttggctcttcttggtgctggacgaccttggagcattgcgctctcgaccttgagacgatcaacctcatcttgcaaacgagctatttgaataagcttcttgtcgttcaacgtctctgaggctcggtgaagatcctggtgcatcttgtcaagcgctctcatcacagtcctcatgcgaccaaaagtagtatcattctcacttgaagctgaactgaaactactagcaatgcctcctgctgaacagcttggatgataacggtaagcaattccatcgaagatgaaaacaaacttctctcaaatcctggtcatcaccaaatatacggcttcctggcaagcatgctctattgttcctctagaagtctcaaccaccatattaaccagaggggtgcccaaactaccatgaacttccaagcgaactctatgcagcaactctccactgaggggctcaataactgtgtactctgaagcttcaatgtagccggcaaccaatgtcatatttgcgagctcagcacggtgaataggggggaaatcagccatctaaagagaagatagaaggaacaaagctgactccaatcagaaatgagatgctggcattaaaactagaagcaaaaaggaagaaaaagcactaaactgaaatcaaaagactaaagcaatatataaatatattttttaaaatactattttcagccaaatttttttaaataccaaaactctttttttaaaaaaataccaaaacctctcttttttttccgctgaaaaatccccctttttttaaccgaaacattttttttgccgaaatgttttttttaaaaaatagccgaaaacacattttctttgaaaatcaaaaaggcacaaagaaaaaatatatattttttgacgaaactcagaaactcaaaagaaaacagactcatatatttagactcactggaccacttcaaaatgtgggaataagagatttccaggggaagaagagaatttcagagggctctatgtgttttccgtttggtttgtcctacggtcaagatcagctctgatatcaacttgtcgcgcccagatattcgacaacccgaatcatcgctatctattgtgagctggttgaccgcacaataaccacgggcacggcaatttgaatagttttactctgatcagaggtctacaactttacccacaagacacgattccgcacatgaaaccatgccctgaagtaccgccacaatactacaaagggggaaatcatgacaaaatgatgtggactagggt

SEQ ID NO: 14479 - DNA, 3164 bp, Oryza sativa
  unsure (1)..(3164): unsure at all n locations
gttggtatttcttacgatatttactagaaatataattccaagcaatggcgaagaaatactcntgatatattatggtacagggttcatccgcaagtgcacggatataccattgtagcttttcacccgagagtattccaagggtattgtatttgtttaattccatgggaagatcatagtagagagaaccatactaataatttatatgttacttgtaataatcatagtctaaataggggttaagataaatcaaagggtagagtgacacataagcatggagctactcattctcatactaaaatatctaagctaagtggaaagaaaatagaaaagaatctattcctatacttccagtatacatagtatgcatacattctagttatacgattaactagctaataccctctttctgatgccctcctggtacttcaaaacgccacccctgactgtcgattttccttacgacagcctgtcatgaccatataaccggggtaaatacggaggagtaccctccctaggaaattaacataggactatatacacgcgtggaggaatacccgtactgagctgtcaccatcagcggcccacctctcatccgcagcatataaccccaaatagtgatatcccataatctagacaccacgccaaaactaccacatactactctaatatcatcgtcatgacatagagtaattgcataggcaaacgttatacccgttaactatgcagtataatcaatataagatgaacataatgtaaagttggcattcatatactcggaaagtattccaataccagaaatgtataaagaagagtattctatataaagtacaaagcttacaaaagacgaaaggagagctactagagccatacccgaactcttccggactccgatttttattttattcctacttcactagcttaagaacactaaactaaacttgagagaatatgagagagtgtgttgaaatgtagagagtgagctccttaaatagacaggtaatgacggctatgacggttggaaaggtcagtaataccctccaaccgtcattggggatcaatcccagccgtcaatcaaagaccttgcatccagcggctgcatggctggtttggccgaactaggggacggcaaaatccagcccaatttcggctggcggcctcctcttctgttgctcactttagacttgtgaattttggcccaattcatcgtgtcaattctgagttcttggccaattcatacataagtctgattctcgacatcatccgattgatttgtcgtctaatttgatgtcgattctcctccactttatgattattctctgcaaaaggtaagtgatccaaacactagtggaatattattattctaacacaaatatgcattgcaagcataactagttctcctctattttggtaatattgacggtcgaaactgatcgctaacgaccgtcacagccgagaatgctaatccctggttgccaatcgaagaacacaaataagaaacaagatagaatacaaccaaaattgcaaatgaatgattaagctcacaagttggggtcttacaaaccgatctagtggcgaaactgttctcgacagaataatctaagcaaaacccaaaccataaagatgacggccggtactgatatatagagtttgggtcgtgcaacaaacccttggcgcaaccctaatgggctccaacacgatacattgcccaaaggcccaaatacggtgatgcagcatcggaacagattctggatgccaacttgttcgatcgattcctattgactcggaaagaatttggacatgggaccaaatccattggaaaggttatcttcttaccttttccatacatgtaaagaacgccccaatccaagcgcgtatgcgacctggtcgcccgttttagtgcagactggtcctggactccgagttgcactagaggttgacttggtttgggcctccaccttgatgatcctcgatgattctaagtccttctctaagtgtctccttgtcccctccattgttcctaatcacaatataatgattagatagcaatctattctcaaatttgtaccaagaagaacataggtacgagctcatctctaaattcaatcgtcgcgcgcgagctcttgttatcggtccttgaatgaccattgaaggattgttgaaggagtgatgtccgcatcatcttccccctcctgaattggagtcatcctccactcaagctcatgttcttctccccaagtatggcttcaaatctgaaatgttaaacgtgggactaaccctaaactcgggaggcaactcacgtttatatgcattatcattaatcttctcaacaattttgaaaggaccatccacgcgaggcatcaacttagactttctcaattctggaaatctatcctttctcaagtgcaaccaaactaaatcacctggttcaagcttcatttcttgcctacctttactattatcaattctatacttttcagtcatcttttcaatattgtgcttagttgtctcatgcattttcaaaataaatgcaacacgtgccttagcatcattgtgaaccttctcactagtaggtaaaggcaagatatcaataggagcacgagggttgaaaccatatactacctgaaaaggacttaccttggtagtagaatgtcttgcccgattgtatgaaaactccacatgaggcaaacattcttctcacatcttcaaatgtttcttcaaaatagcccttaacagggtacccaaagtatggttgactacctacgtttgtccatctgtttgtaggtgacttattgtagaaaacaatagctttgtacccaacttgttccatagtgtgtgtgtgccaaaaatgacttaagaattttgcatcgcgatctgaaacaataatagaagtcatacaatgcaagcgaacaatctcatgaaaaaacagatcagcaatatgaatagcatcatcacttttatgacatggtatgaaatgtgccatcttagaaaaacgatccaccacaacaaaaatgctatccctacccctcttagtcctaggcaatcccaaaacaaagttcatagaaatatctgcccaaggaatagaatgtataggaagaggtatatacaaaccatgtggattaaatcgagacttagctttttgacaagtggtgcaacgtgccacgaac

SEQ ID NO: 14480 - DNA, 19347 bp, Oryza sativa
aggtgcccggttaagggggggagggggaggggaaaaggaaacaaggggagactaggactttcctgaaaaggaaattcaatgcggtgccattttaggaaaagaacagaaacggtcccacgaactaaaacggatacggttcgtcatgcaaaacgaaaccgcggactgataggggagtgaattgagcacaattcacgaccaaaggcaagggaagacattattagcttgacacttttacttagcaacactgcctccgttgttccgatatttactctttaagtcctgttagaaaagctactaagattcctacctattagaaaagctactaagattcctaataagagcatctccaagagtcctataaacatgttcctaaagttaaatttcgtaaaaccccatctattatatatggtccaagttacacaaaaccataagaatcttaatacatgacatataacttcaaaaattatagttctaaaattttagaaaaccgcaccgttaaccatttttatatactcctatattcatatttaaaaaagctttacatacatgcatataaaatttataatggataaaacactcataaagttaattaagatgtgattgtagaactcaaaagtgtggttgatcaaagtcaaaatgatcaataccatggttttctgaaactttatggccagagtatctaaagttacgtgttacatgacaaaaatcgtgtgattttgtacaacttagatcataataatattcatggttaagtgagatttactctataacataagtcaaagacaaagctctctaacaagtaccaaaaccctctcccaatttttaggcacgaccaacagcgctccaataatcatattcagatgagaaatctcttgggcatattggtgcgaactggagctcagtggtgatgacacaggtatagcagttggcctggttagtaatttgaagaaatagcagggcaaaatcagaatttgtctctgataaaaaaaattgcaggtgcacttccacctagttctaatttcttgttgggttggaagaagaaaatagtgcagaaatacaacatttaattaataatatgaagaaaaaccggaagttctgaatggaacttgtcgaaacttctgacttttgggatcatcaagagctcaatgtgaaattccaatttgaacatcggaagttcctaactagtccaattctaatgcaaggtaaaatcagtgcccatttttcttcgatttgattttatctctagctgccaagcccaactagagaccctcaaacgcaaccattcacatcttatattttgttttaatttcctaggttttgggaaacttaagattttatagttttcctatagattgttccttatctcctaagaaattgatttaatctgccgtgatttgctcataattaaatcacttgttcttcacacaaaacatgacatgccctttcacaaaatgtgattatctcatcagcattagcacatgtaactagctgctgccatcgcaatcaccaatgccaccaccaaagctgtagtcactggaaccgctgccgccgctgtccgtcaactactctccgctgttcgcactccaatcctaggagataaggattagtggccatacaaaagagtgaaggcatgcacggctggaaagttgagcgggagggggataatacatttaccgtcatttacataggctcgtatttctttcctaatatttactagtgtgtcacttatctatattttagcttatataatataagacatgatcaaactcggcacggtctccataattaatttttactccctccattctataatataaggcacaaccacttttcttagatattctataatataaggtatacatgcaagcatgcaattaattatgacatcttctccattaaattattacttttttaaatcatccactctcatgttatctaatcctattggatgcatgcattagtatttattaggatgatccaaactacaagatgataataattatttcttggtctttaaattaagggtgattgtgccttatattttggaatggagggagtagcttataatttctcatattgtataaggtttataccaataaaaatataacctaaattcaaatgtcaattgaatgatattattttcaacaaataaaatttaattcatgttatattgattgttagttaaatgttttaaaaattgaatcttaaattgcacgcacatgttatattatgggttggaggaaatagtatctaaactaatttaatttatgtgcaattggcttgtttcttcgtttctaggttcctctagcgttaaaattaaggacgaaaagacgggggcaatatacactgttcaagggggttaccattcttcgggatggagaattcaatggcagatgcccctggttctgttgttggttacaaaggtgtcaaactatctacttttctaacacaacgttaactctattttcacccaattattatgattccaattcctttcctgataagttctgtatttgattttcataaaagatataattccactatatctgtcttgatatgaaacaataatgaattttcatatggaattctcctgctctagttttcctacgggattgaacattactgtgttttgtcgattggctggagtccattcgatgtatctcgccaggtgtgcatgcaccagagcttcatttcatttatccaatggttaaatgtacacatgctatacgctgataaatactttgtaattatgaacagcagctttgtatagggggctagcacaaaatctgtggtagtggagtcgtgatacatgactccttttgtgcatcagatcgtagtgccaacaagtattggatccaacaattatgcttactacaaacatttaatgcttcacggatttatacatgcaccaacaataagatttcttagagcatctcgagtagtagcccctacaatagagcctctaaaagtcaaatgggggctgcccccaattctttaggacactaaatatgtcatcaactctagcagtagccctcatatcttagctcctatttctttttctcttttattttattatataatttatgtttaaatacagtttaacaccataataattcaaacataaataattctagcacatggaattcaaccgtattcgaatttgcaatttcaaacaccatggttcaaatttgagttcaaaattttctaacatgaaaattgaaagtgcatctaggcccctaatgattttcatgattgattacaatgcgattagagaggactaacattttcattcaagcaaatgtgaaggttgttatgtcctcaatgtgttgcaatacaatccatatcccgtgaatgcgacatcgcgatgtaacgcggcaatgatcaaatggtatattgtatctttttcctcgcattgtgtcgtagaaaagccatactattatgggggatgatgcatagacatgtaaggagtgatgcgtgtgctcaaaatcatttttcctttcaagcatttctcttttggagcgttctggaaattttcggaagttccgaaaatacacagaagcgttctggaaatttttggaagttccgaaaatgtttttcggaagttccgaaaaatgcgttgacttcgattatttctcagatctggaattttcggaagttccgaaaattgtttcggaagttccgaaaattgcatttattgcactccaacgggcagatttgtgctgtgggtataaatacccacctcgcctcacttgtgagggctgctggttccattccaattatttgtgcccttggcttgctctctctctctctagttcatttgagccttgcttcctcgattcatctctccacctgtgtttgattcggatttggtgtgtgtgtgagagtgtggattcgagtttgtgtggatgctccttgtggtctttgtgaagatttgtgagcacttgcatcatctccgggagttctttgcatcatcttttactcttggaggttgaggactcctagacggctaagtgtcactcccgagccaccgatctacttgtggttggccgggagaagtttgtgaaggccggatctcgcctccgcaagggaagagatacctcttagtgaaaggagtgcttagtgcaacctcttgacgaaagggttagctaagacccggctcttagtgagctcctcaacggagagtagaatcccctcaaggatttgaactccgggaacaagtttgcaagcttcaccttggtgatatctctttatccctctcctctaactttgcttgcttgtgccgctattggtctagttgctgtatgtgcctttgtttacatgtggtagacttctagatctagatacttctttttgtgtgcgctgctctgtgcattaacggaagttccgaaaatcctttcggaagtttcaaaaattcccagcctagttccgaaaattactgctttcgctttacttaagtttttaaattagcctattcacccccctctaggcctaattgaccttttcaaaaataatataaggcaaagcctagacaagagtggcgtgttaagagcacagttacgacagccgatgaagctgaagccgataaggccaagaggctgcttaaaggaaaagccgttacatctacatcggtaaatatgatttttatgctacctgcagagtttgaagccaaagaagccgatgttgatgatgttgaagaggcctctgctaggttgattttgtcaccagatcaagcagtttttgagaaaccagaagggacataaaatcggcacataaaaccattgtatcttaatggatatgttaatggcaagccgatgtccaagatgtgagtcgatggtggggctgctgtaaacttgatgccatatactactttcaggaagttgggtaggaaatcagatgatctcatcaagacaaacatgattctcaaagattttggtggcaatccatctgaaaccaagggagttttgaatgtagagttgacaatcggtagcaaaactgttcctaccatgttttttgtcatcgatgggaaggggtcctacagcctgttgcttggaagggattggattcatgcgaattgttgtgttccttcgaccatgcatcagtgcttgattcaatggcaaggtgacaagattgagatcgtgccagccgataggtcagttaatgttaccagtgccaatttagctctttgggatatggatggtattgattgtttgtctggaaagatttgggatggaatttttctaaaagtgtccgattgtgatatacaaccaattgaagatggagagcccgaattattactttgagggcgtcgtggagggttcaaatgtctacaccaaggacacggtagatgatcttgatgacaagcaaggacgggattttatgtcggctgatgatttggaagaagttgatattggtccaggagataggccgaggctgacatttatcagtaagaatttatctgcagagttgaaccaagctgatagagctattaaaagaatatagagattgctttgcttgggaatattatgaaatgccagggctcagccgatcgattgttgaatatcggctttctatcaaaccagggtttaaaccgcatcaacaaccaccaaggaggtgcaaagccgatatgcatgatgctatcaaggctgagattactcgtttgtatgatactggttttattcggctatgccgatatgctgagtgggtttctaatatagttccagttattaagaagaatggcaaacttagggtgtgtattgattttcgagatttaaacaaggctacccctaaggatgagtacccaatgccagttgccgatcaattggttgatgctgcttcaggacataagattataagtttcatggatgacaatcagatttttatggccgaggaagatattcataagactgctttcaggtgtcctggtgcaatcggtttatatgagtgggttattgttgactgtcattatcaaccagtttcgaccgtcaatattaccaaaatagaggagaactagtgatgcttgcaacgcataaatgtgttagaataataatattccactagtattaggtatgctaacctttagtagagaataacactaaagtggaggagaatcgacatcaacatagatgataaatcagtcggacgatgtcgaggatcagacttatgtatgaatgggccaagaactccgaattgacacgatgaattgggccaaaattcacaagtctacataaaggagcaacgaaggaggccgccagccgaaaggtgggctggttgggccgacccatggttcggccgaacctccctcgtcgccgtttgatcctggttttggctggatggttgagatgaagccccaatgacggttggagggtattaccgaccattccaaccgtcacaaccgtcatagttcagctataaaatgagctcctcttctcacttcactcacacacatcaagcaagagctctctcatttttctcaagtttggtttagtagtatatagctggtggaataggaatatagtagaaatcaggagtccggaagccttcggaagagttcgggtatggctctggtagctttcctttcctcttttgtaagctttgtacttttattagaatactcttctatatacatttatggtattgaaatactttccgagtatatgaatgcctactttacattttgttcatgttatactgaatataaggctagcttatctgggagatgctttggtgcgggtataatgtttgcttatgcaattactctatgtcatgacgatgatattaaagtagtatctggtagtttagatgtggtgtctagattacgagatatcattatttggggttatatgctgcggatgagaggtgggccgctgatggtgacagctcagtacgggtattcctccgcgcctgtatatgatcctaagttaatttcatggggagggtattcctccgtatttagccccagttgtatggtcatgacgggctgtcgtaaggaacttggcaatcaggggtggcttctcgaagtatcaggagggcatcggatagagggtattagctagtatatcagataactagaatgtctgtatactatgtatattagaagtataggaataggttatctttctcttttctttccacctagcttagatgatatatcatgagaataagaagttaatgcttgtgtgttactctacccttggattatcttaacccctacttagaatatgattatcacaagtaatatataaattactagtcaagttatctctacatgatcttcccacgggataaaataaatacgatacccttggaatactctcgggtgcaatgctacaatggtatatccgtgcgcttgcggatgaactctgtcaccataatataccagaagtatttctgcgccattgctgggaattatatttctagtaatatcgttaagaaataccaacaagcatttctggcgccgttgctgaggaagattcataatagagattacctgaactaatactttatatttacctttgtataatcattttcctttgtaggctaaccttggttattttcacttttgttgtgaaaacagggtagtgcgtgactggtttcaactggccggaatacttcaacgaaaatccataagctttcttccgtagcgtcaggccgcgagtcgttgttccgtagaaaactctaccgacagagaaaccagccgtaccagcgccaccgaccttcaagactatggctaacaagactcttcgcgagttcgctgctccctctgctgagaatgtggccattgggccgcagatcaacatgggagatgtggatttcgacttggagttcagcctcatcacgatgtcgtaggctagcctgttctgtggcaagcctaatgaggatgccaatgctcatctgcaacagttcctggagatctgtagcacgtacaccataaaagggcgtcagtccagacgccgtcagggtatggctgttcccgttctccctcctcaggagagcgaagtagtggttctatgccaatcgtgctgctgtcaacacctaggacaaatgctctatggcattcctctcgaatttctttacaatgggcaaaaccaatgcccttcgtgggaggatttccagtttccagcagacaagggacgaatctattccggaagcatgggaacgactgcaggagtacatggccgcctgtcctcatcatgggatggatgactggctgatcctgcagaacttttataatggactcaccccgatgtcccacgatcacctggacgcggcagctagaggggccttcttctctaaaacggttcaaggagccgttgatctaatagagaagatggtttccaatatgtattggagcgaggaacgacttcagacccgtcagtgaggcatgcataccgtcaaggagacggaactgcttactgccaagctcgtgttgatgcaaaaaacacacagtggcctgggagatctgcttagctatagtgcaggtccaaaggatagtgagatgcgagtgtgccagtcagtttgatcctgcaactgacaagatatgcaaataatagatcaaacagccgatcggctgacaagctgatggagtagttccagccgatgccgataccagccgatagcgatagggtttaagcaatcagctatatgtccaaagtagataatgatataaaggcaatcggctgatgataatcaatataattaaacaatataatccagtagaaaccagtcggctaataatgatatgatagaataagcattgatctgaaggttaaagcatacatcggctgaaggtccgatgtcataaaatccacaagattaaataatgaaacctttgttgtcatcggctaaatccaacttatatgtatatgcaatccttgtaagccgatgcaacatatagatacctgatcagctgaaaccccgatgaaacccttattgacagtcaaaagcaggctaaggattatggttctaaacatgacttagtagatgaaatttaactgatgcaacactaagtatgaaaagaaacataatatctagacaatcaagtcgttgactgagttttcaggggggaagatgtctaagctaatcaaatctagcaacacgatttagccgataccagcataaaccctaaaacgagaagcagccaatagagctaaattgatatgctaagactagattaacagagacatatgataaataggtaggcaaatatatcatccaaaccagagcaatccaagaggtcgaatgtaatgatgcagccttgaacgacgccgacgtaaacgatacatttgcctgggccgatggtacattggacttaccccttcgccggagattgaacaccgatgcagccccacgtcgggtgccaagtcccgccggacgataaaataaagttgaaaaggtaaaaggtggtgatgcgccgaattgtattgatcgagattgatagattacatagaccccgggtgtacatatttgtacccatgggttgatacaagtccttgtcggacaagaaagaaactttcctaaagataaaaggaaaacataaagtccttatcagacactaaacacactttcctaaagataaaaggaactaacaaactattcctaattaatagataacttgccacgccgcatcctccttgaactcggactcttctggataaattccctttagttgatccgactccatcgaaaacacggttgctggcgatttgacgactcccatcggttgtttcctccaatcggctgattccagtactctaaagccgatattgactctaagccgatgataacttcgggctttaccaaatttcactgttaacagctggacctcctcatgaagcgattggacgaccacgacaaaaagccacaagggactgtcaaggtcttggactcacacgtcacgtgtgaggtctgcggcaacacgggtcattctggaaatgattgcctggatacccgtgaggcgatgtacatgggcaacaacaacgggtactgtccacaacgaggtcaggggtggaaccagccatgcccatatgttgacagaaaacatgaggcctgggaaatctgcttaactccagtgcaggtccaaaactcgccttcggatgtatgagcgtgccagttgatttgatcctgcaatcaacaagaaataaagacaagaaaaccgtagttaaatctataaatgatagctgatcggctaggtgccgatgacatatgatttatattaagccgatgtcatatgtacatcgatcggcaagtgtttaataaacaattcagaactaaatctactcgatcggctgtagatattaatgatatacaatccttatatcgatatatacttaaatcaagtgattgggatagatgggtcaccttaccgagacagtataaatcacttaaattgagatatatattaataatgagattatatatattcatagcatagccgatcagatagatttagcatgtatcggctaatactccgataccactctatattaagatattaaaacaagcagaatatatcaatcataagcctaatatacttaacagcaataagatcttaatatgaagggcagatttaacatatcaatcaagcatataaaataaaagtagttacatcagataagatcggctgaaactccgatgctaccctaatcggcaaccagaaagcaggctagagattgaagttctaaacatgacttaatagatcaaactcaactgatgcagtattaagtatgaaaagaagaacaatatctagacaatcaagccgctggatgtttcatagagtggtagatatgtcacgtaatctaagtcaacgtcgctatataacctaatcggctatcttctattaacagatattagccgattataggttacatgacgatactatcaacgattacgtgagatatatgataactcgacgaattacataaacaagattagagtatcatgaagatggaagcactaatctcgagaacacaaatcgtcataacaagctttacctcttgttgaagatcgacaccgatgcagcccaacccgaaagtaagaactcgtcgaaataaaactaaagcaaaaagggtggcgatgcgccgagattgtattgaacgtgtgttagcttgattatatagggctcggggtctatttatacccgagaattacaagatacgtccataccggacacgactattatctctaacaaactctaagataccataagtctttgcggcagacttttgcccaaacatatctctaaggaaattacatagaatatcctaactagtagatacaattgccttctcaggactctatccttgtgcggcaatcaccatgaagcacattaactcaacccgatgacgtacaccgaatcgtattgtcggaatcggctgtatcgactagccccgtctgactctaactctgtcgatcctgaccgtagccgatttggattgcagccgattcttgctctgtttctgcaacgatcttcgtcttggattccgtttcgatcggcccttcatctccgatactgaagttaccaaatttggtcgttaacaccatattatgaaggaggcaacaacaatggtaacttctctaaccagccctccttgaaggatcttgtttttgcgcaagccaaaactattgatgctttaagcaaaaacctcgctacaaatgacaagatcctagagaacataaatgttaagctagatggcttcgcttctgctttccaaaatcagctgagatttaataaaatgttagaaacccagctagctcagtttgcatccttagtccctgcaaatgaaactggtaagtccactcgtgagaatgttaaggcgatcacgttgagaatgttaaggcgatcacaacgaggggaggtaagtccactcgtgatccgccgtatcctaaccctgcaggaactaacggaattgcaaaagaagtgccatctagtgactcggctgacaaagaggttcagctagaaaagatagtgccgcaggagtactgcgacacatggttgctgtcgtttcatcaacggagtaggaaaccatcagtggacgagcaattcgctcgttttgctgaagtaatccagaagatccacatcaacgtaccgttgttggacgctatgcaagtgccaacatatgctcgttatctcaaggacatgctcaacaacaagagactgctcccaacaatggaggtggttaagctgacagaacaatgtagcagcgtgatactccacaagctcccggagaagaagaaagatccggggtgtcctacgatcacctgctcgatcggggcacaacagttcgaccaggccttttgcgacctcggagccagtatcagcgtcatgccaaaagacgtccccgacaagctcaacttcacggtgctgacaccaacactgatgtgcctccaactggctgatttgtcagtccattacccgacagggatagcggaagatgtgccagtcaagatacgggatttcttcatcccggttgatttcgtggtgctggatatggacatggggaaggagacgccgctcatcttggggcgtccgttccttagcaccgcgggagccaacattgacgtgggaatggggagtatccgtttcgacatcaacgggaaggaaaaaagtttgagtttcatccgaggacgggccgaacccacagaatattcaaatggtcgaagtggagccacccaagatggacagcctggtgagattcatgcagaattttctggagaaggaaacaacgatgcccaggaaccgttattggaggacgccggtaaaaccacccataccggccaagaagctagagcagtcggctccgaggaagccgccgtccgcacgaaagcgaaataaggtgtggagggagaagccaaagacgcccgctccatcacctccggagatgggaggaaaatccgtgagctaaatcagaaggaggtacagtcttgcacgtcggacttaaaatgacgcgacctttgtcaacaggtaaattggtatgtatccgcatatttatgttcaacaatttgaatttttgcatcaacacatgtttgaatttcaaaattgcatttaggatttttgaattttgaggaaattcttcaaatgaatttttttcagagcaaaccaaaataaaattttcaacaaaaatttactgtgccacgatcacactgaccattagaatccaacggccgaaagtggggccggttggcccaccagaggttcggccgaaccggccaggcaacggttacctgccacttttggcaaggtaatggctagtgggtctcacatgttatttctgaccgttgtgggtaccctataagagccaaccggccgagagagggaaatccaccccatttcaacacattttcattccctctccaaagtttgcgctcaagttcattcaagctttgatagtttcccccaaattcaaaacacttagttgcatatatacaagttgctttggtgaaactaaccggtgggtgcaactcttgtcatttctaacccctaccgagttagtccgttcgtgctccattgtccagaatgaggaggcgattgtctcgtttattctaggggtccgattcttcatcaagtcatcatgacgagtctagcactcgttcattagttgatgtctcgatggaagacaccgaagctccgtgacgactcctgaacgacaccaacctcgacattgtcggtgatcgggagagacaaacctactacatgctgagcgaccgggagtatgctcacacacgagactactcaccggagctgctgaaaaagataggtatagatgttgaattttgtgctatttggaaagctgttggttggcagagatttgttgtggtagatgagcctggttcttgtttgcttactatgcaatttctgtgcactttgaaagaaacagaagatggaatttcctttcgctttttccataagaagtatacacttatatggaaaggcttaagcacacttcttggtttttacgattcctgtaaaatcaatctctagaaagaaatttctaggttcgagaaaaataggttatgggaagatatttctggtgctccaatttgcaagaaacctaggacgaatgatatccataatcctacacttaggctcatgcacaaatggattgctatgactttgtttcctagaggtgatcttagacccattaggggggatgaattgattatcatgtttgcatggttagaaagatcaaaattgctcctgtgaaatatatgatacggcaatggtttgaataaggtagagagtgaggggaagctctggaggagtgcccggaagtttggcgctcatccgacttctacctagacgagtgtagcttcgtaggaggaattctagaggagtaccggagctgtcggtacactctgctccaggttcggaggacttcttctataaagtaagcatctgtgttcctttcttatgttatttaatcatttagtctgagtatgatatatttccatctttgcgggttcattgtttagtatatatactaagtgctctagtactaggactcgggataaaaaaggaagttcctgcgcgagtattagagtagtaattaataacttaagcgtggtgtctcggttagagattaccttcgtttgttgtgcatcccacggatttgttagaggtaggcggcatgtggtgacagccttgaatcccgtcccagtaatcctccacgttcgaatacatcatagagctatagccagaactacgcttccagaccagcaggggtcggtgcccgaagcaacaaataggaaattacctttgcttagcgtagataattaaaacacatagaaagtcctctctagcctagcctacatatcattagttgttgcccttggatagtcttagccttaggtaaattacacacgttccctgagttcgatatcctataggggttacccgaaggtgaagtgctactgcggtacgctgtgcgcttgcggatttatctgtggtcgaaagaaataccaacaagcatttctggcgccgttgccggggaacggttgctaatttatccgagtctaggtcatcctcgtatgtttatttttatttcttcttcttttattcctttccttgatggagcaacccacaattcaaaacctttctgctcctcgggctgatctttgtgagccatcctgttcttcaaaaccaaccctttcggatggctacgaaatcggtcctggctttatagccatgattcgagagcaaaccttctcttgtggtattagtgaagacctatacctccatcttcgggactttgagctagtgtgttcatgcctatccatcgtaggcatgacgcatgaaactctaaagtggaagttgtttcctttttcacttagagatgaagtgaagcaatggtacactctgtctgtcaagaaattccatggtgaatgagaggagctaaagtgcaaattttgccttgccttctttccatcaacccgtgtaattaatcttcgattagacatcctttctttctgatagaacgagaaggaatctctcagtgcagcctgggctaggttctcattattaactcagtctggcccagacttgtctttacccgatcatgtattgttacaacattttcaatacgggttagacatggagtctgccgaaaatctcgatatttctgccgaaggatcatttgcccacaagacaaccgccgaaggaagagaactcttatatctgatcttagagatcgaagtgaagccgtctcggaggtcgagattatcgatgaggaacctctgcacgtggagtcggaacccgactcaactgccgaatcctcattccaaatgctggagcctgaggaagaagaaattcatccttcggaaattccattccaattcaggggtgatctttatgatgattatgagaacaccctgaattattccagcaaaaaagaaggctcgtcccaaccatgagccgttcgaggaggtgatattgtttgtatctttgtccgtttcttctgaacctattatccatcttcatgaaactgaacgaccgtcatcaccctcgatcaagcctaagccttgtccctctggccctcataatgttgttcttgtttatcaccaagaaacaacccgattcttgcacgatccatctgttgagaacaagaaccttcaggccacgggcaagcttgagacattgactctggaggatgagagaaaacattccacatatgagcataaaagtttctattgcaaaatccctttggattcatgctcacataaggaatccctagagtcctgttcgattagtacaacttccctgtgtgaggaccaaaaccaccttccagtcctcatttctagcatgtttataaggatggttgtggatgcttacatttatcataaatactgcaaatctcgtatttgtttgtggcactaatcttgcaaagcgatgtctccatggtcgagcttgtgagcataaacaaagcactggcgggagataccccggattatcatggtaagctttcttcccaataaaaggaagaaccagtttttaggataatatgcaccttcgggtattcttggtcgctaaccattgtaggttgagattaagaacgagggtcatgcgatgcctaaggacacggtagctatatcaactgtacactttggtgatccttggtattgaaacacactctataggataatccgacatcacacacttggttttgatgtcttgtgacacaaaagtccaagtgtggggggaaggtcgacgagcttttcatgacgagttccatccactaaggccatcttggtttgaagtaggtgttagtcctagcttgctaaaaaaagaaaaaaaaagaaaaaaaaagaggacaaaagagagatagaagaaaagaaaaaaaataggaggagaagaaaagagcaagagagctgatgggctacatttggatcaatgaccacattaggtgcgtgtctttaaaatatggctatacaactcgctagtagcaatcgtgctgcctggctacacctagtcccgccttcaagctcatgcacaacttctcgctcccgcagcacctacgcgcaattaagtaagaggagttgccctcttcttttctaagcgtttgctgccactccagttggcacctgcatatttgcccaaaaagagagctatcctacgtctctacatcattttgccaatggatcacgccttcaaggcacaaggttcttgcacctgaggtgtgagcgtgaccaagttgcttgccagagttagcatggtcaaagcgtcgtcctccgatacaatctgcgtggagatggaggagaaatagacaatcatatgtgaccatgccactgccccatagatttcaaaatatacatcatgctggcagtaagtacactcaggtatgcgaaggacagaaaaaaattcaccacatcttttactcttacttatctctatttgaatgagacttgagtatacatggttatgtttcttatgtctatttgcatatgctctggtttgggtgttttcgcaagacacccatagactttttaaattaagcatggtgcttaggttaaactagtctactttaatcaaattagacatggtgtttagtttgactaatgaatttcatagttaatatgttcatagacattggatatatatcttccgtggactaacccctgcaggaaaattttcacattgacgggtgagtcctcaagttcaattcacaatggaggtaggtcagggccgggaacaaatcaattggtaacatgcaaaggagaaacatatcacctataaaggtccacggtgcgtatattactaattgctcctttaacatgttcaagcaaatttacctcagccttgtatgagttacacttaaacgaaaacttgctgaatattaaaaatttgaaaaaaaatattttcagaataaaaggactgtctctcgaaaataaaataaaatgttggcaacttctgggatccacgcttcttaagttttgaatccaatttcgttttagcgtggatgtgaacaattaatcttgaggcgatgatgaaatcttttcaaatctttgtagtccctcaagtatttgttgtccactaacctttttcaggaaataaaaagacaatcaaggagcagtgtacaataacttcaaatagttataacacgctccttatccatgagaaaagagatgcacagggaaccaagtagaacaaatgcaaaacttgttgcattcttgcattcggttcaaatcttggtaagaccaatctggtaagaatatcatacaccatgcgaatcctcatctcatgtctccatcttgccaggtgttggtatttcttaacgacattactagaaatataattcccagcaatggtgcagaaatacttatggtatattatggttacagagttcatccgcaagcgcacggatataccgttgtagcatttccgtcgtatttattttatcccgtgggaagatcatgtagagaagacttgactaataatttatatattgcttgtgataatcatattctaagtaggggttaagataatccaagggtagagtgacacacaagctttaactactcattctcataatatattatccaagctaggtggaaagaaaagagaaagataatctattcctatacttctaatatacatagtatacatatatcctagttagctgatatactagctaataccctctttccgatgccctcctggtacttcgagaagccacccctgactgccgagttccttaagacagcccgttatgaccatacaaccggggctagacaccacatcaaaactaccagatactactctaatatcatcgtcatgacatagagtaattgcataaggaaacattatacctgcaccaaagcatctcccagataagctagccgtatattctgtacaacaagaacataatgtaaagtaggtactcatatactcggaaagtatttcaataccataaatatatttagaagagtattctaataaaagtacaaggcttacaaaagagaaaaggaaagctactagagccgtacccgaactcttctgaagacttccggactcctgatttctactttattcctattccaccagctagatactactaaactaagcttgagagaaatgagagagctattgcttgaggtgtgtgtgaagtgaagagagtgagctccttatatagaggtagttatgacagttgtggaaggggaattgtccgaagtgccctccaaccgtcattgggatgcaatcctggacgtccaggtcaaaacctggatccaacggcgccaggattggtccaggttcggccgaacctagggatggcccaatccagcccaatttcggctggtgtcctcctctattgctccactccgtagacttgtgaattttggcccaattcattgtgtcagttc

SEQ ID NO: 14481 - DNA, 12378 bp, Oryza sativa
  unsure (1)..(12378): unsure at all n locations
nnnnnnnnnnnnnnnnnnnnnnnnnnnnnnnnnnnnnnnnnnnnnnnnnnnnnnnnnnnnnnnnnagagaaatgagagagctattgcttgaggtgtgtgtgaagtgaagagagtgagctccttatatagaggtagttatgacagttgtggaaggggaattgtccgaagtgccctccaaccgtcattgggatgcaatcctggacgtccaggtcaaaacctggatccaacggcgccaggattggtccaggttcggccgaacctagggatggcccaatccagcccaatttcggctggtgtcctcctctattgctccactccatagacttgtgaattttggcccaattcattgtgtcagttctgagttcttggcccatctattcataagtctggttctcgacatcgttcgattgatttatcatctaagttgatgtcgattctcctccactttattgtcattctctgcaaaaggttagtaaacctaatactggtagaaaattattactctaacatacttatggattgcaagtatcactagttctctcctattttggtagtattgacggtcgaaactgatcgataacgaccgtcacaccaggatacccaccaggatacccaccatatccattgttgccataaaacaaaaagaaaaaataaaataaaataaaataaagttggctcccgcagtgctaaggaacgtacgccccaggatgagcggcgtctcctttcccgtctccatgtccagcaccaggaaatcaaccaggatgaagaaatcccgtatcttgactggcacatcctccgctatccctgccgggtaacggactgacgaatcagccagttgtaggtgcatcggtgttgttgccaacaccgtgaagttgagcttgtcgaaaacgtcttttggcatgacgctaccactggctccatggtcgcacaaggcctgatcgaactgctatgccccgatcgagcaggtgatcgtgggacaccccggatccttcttatttcccgggagcttgtggagtatcacgttgctgcattattttgtcagcttgaccacctccgttgttgggagcggtctctttttgttgagtatgttcttgaaataacgagcttatgttggcacttgcatggcgtccaacaacggcacgttgatgtggatcttttggattacttcaacaaaacgagcgaattgctcgttcactgacggtttcctactccgttgagggaatggcaacaaccttgtgtcgcagtactactgcggcactgtcttttctggctgaacttccttgtcagccgagtcaatagatggtgcttcttttgatatcccatcagttcctgcagggttaggatatggcggatcacgagtggacttacctcccctcgttatgatcaccctaacattttcaacagaggagtcgggttgccccagaaccctcctagattcatttgcagggactaaagatgccaactgagctaagtgggtttctatcattttattgaagctgagttggttttggaatgtggaagcaaagccatctagcttgacatttatgttctctaggatgttatcattggcagcaagctttttgcttagcgcgtcagtggttttagcttgcgcaaaaacaagatccttcaaggaggattggttagagaagttaccgttattgttacctccttgataatatgggcgtggttggttccaccgctgacctccttgtggacgatacccgttgttgttgttgcccatgtacatcgcctcctcacgggtttccgggcagtcattcctagaatggctcgtgttgctgcagacctcacacgtgatgtgatagtccaaggccttgacggtgccttgtggctgtttctcgtggtcatccagccgctttatgaggaggtccagcttggcagcaagcagttccgtctccttgacgatgtgcatgccttgctgatgggtctggagtcgttcctcgctccaacccatatttgagaccatcttctctataagatcaacagctccttgaacagttttagagaagaatgctcctccagctgccgtgtccaggtgatcgcgggacatcagggtgagtccattatagaaattcagcagaatcagccagttgtccatcccatgaagaggacaggcggccacgtactcctgcagtcgttcccatgcttccggaatagactcgtctcttgtctgctggaaactagaaattcgtccacgaagggcgttggttttgcccatcgggaagaacttcgagaggaatgccgtagagcatttatcccaggtgttgatagcagcacggttggcatagaaccactgcttagctctcccgaggagggagaacagaaacagtcgcagcctgacggcgtcgggactgacgcccttgatggtgtacgtgctacatatctctaggaattgttgcagatgagcattggcatcctcattaggcttgccacagaacgggctagcctacgccatcgtgatgaggctggaattcaagtcgaaattcatgtctcccatgttgatctacggcccaatggccacattgtcagcagagggagcagtgaactcgccgagagtcttgctaatgatagtcttgaagattggtggtgctgatacggctggtttctctgtcggtagagttttctgtggagcaacgactcgcggtctgatgctccggaggaaagcttctggattttctttgaagttcttcggcaatttgaaaccagtcatgcactaccctgttttcacaacaaaagtgaaaacaaccaaggttagcctgcaaaggaaaatgattatacagaggcaaatataaagtattagttcaagtaatctctattatgaatcttccccggcaacggtgccagaaatgcttgttggtatttcttaacgatattactagaaatataattcccaacaatggcgcagaaatacttatggtatattatggttacagagttcatccgcaagcgtacggatataccattgtagcatttcacctgagagtattccaagggtatcgtatttattttatccagtgggaagataatgtagagaagacttgactaataatttatatattgcttgtgataatcatattctaagcaggggttcagataatccaaggatagagtgacacacaagctttaactactcattctcataatatattatctatgctaggtggaaagaaaagagaaagataatctattcctatacttctaatatacatagtatacatacatcctagttagctgatatactagctaataccctctttccgatgccctcctggtacttcgagaagccacccctgactgccgagttccttaagacagcccgttataaccatacatcaggggctaaatacggaggagtacccaccccaggaaattaacttaggattatatataggcgtggaggaatacccgtactgatctgtcaccataagcggcccacctctcatccgcaatatataacccctaataatgatatcccgtaatctagacaccacatctaaactaccagatactactctaatatcatcatcatgacatagagtaattgcataagcaaacattatacctgcaccaaagcatctcccagataagctagccgtatattcagtataacaacagcataatgtaaagtaggtactcatatactcggaaagtatttcaataccataaatgtatttagaagagtattctaataaaagtactaggcttacaaaagagaaaaggaaagctgctagagccatacccgaactcttccgaagacttccggactcctgatttctactctattcctattccaacagctagatattactaaactaagcttgagaggaatgagagagctattgcttgaggtgtgtgtgaagtgaagagagtgagctccttatatagaggtagttatgacggttgtggaaggacacttgtccgaagtgccctccaaccgtcattgggatgcaatcctggacgtccaggccaaaacctggatccaactgcgccaggattggtcaggttcggccgaacctggggttggcccaatccagcccaatttcggctggtggcctcctctattgctccactccgtagacttgtgaattttggcccaattcatcttgtcagttctgagttctttgcccatctattcataagtccggttctcgacatcgtccgattgatttatcatctaatttgatgtcgattctcctccactttattgtcattctctgcaaaaggttagtaaacctaatactggtggaaaattattactctaacatacttttgcattgcaagcatcactagttctcttctattttggtagtattgacggtcgaaactgatcgataacgaccgtcacaccaggatacccaccaggatacccaccatatccattgttgccataaaacaaaaagaaaaaataaaataaaataaaataaagttggctccttggtcttcactctcgtctttctttttcttttagtgtcaaatgaagagtcccaggaacaacgacaagtgtgggggtgatcttgcacatcaacgtcgtaactgttggtgcgaaaaacacgtggcctggaagatctgcttaactccaatgcaggtctaggaaatcttgcttttggacctatgagcgtgccaattgatttgatcctgcaatcaagaagaaataaagacaaggaaaccgtggttaaatccataaacgatagccgatcggctaatagccgatgacatatcatttatctttgagccgatgtcatatatgcatcgatcggaaatcatgaataaataataaagaactaaatctactcgatcagctatagatattaacagtatacaatcttggtgtcggtatatatttaaatcaagtgattgggatagatcggacgccaagccgagacagtataaatctcttagatcgaaatatatattaacaagaagattatagacatctatagcatagccgatcaggtaaatctagcatgtattggctaatactccgataccactctatattaagatattaaagcaagcaaaatatatcaaacaagaagcttaatatacctaaaagcagtaagatctcaacataaagggcagatctatcatatcaattaagcacataaaatataaggctaaatctggtaagatcggctgaaactccgatgaaaccctaatcggcaaccaaaaacaggctagagattgaagttctaatcacgacttataagatcagacaactgatgcagccaaaagtatgaaaagaaatacaatatctagataatcaagccattgattgtttcataggatggtagataccctatataatctaagccaacattgatatttaacttaatcggctatcttctaacgatagatattagccggttgaaggttaaataataatattgtcaaagattatataaaatatatgataactcgacaacttacataaacaagattagagtatcataatgatggaagcactaatatcgagaacacaagctgccataataacttttacctctagttgaagatcgaaaccgatgcaactcaatctgaaggcaagaactcgtcgaaaccaaatgaaagttaaagggtggcgattcgccgagattgcattgattgtgtgttcgtttattacatggggctcggggtctatttatacccgagattacaaaatatgtccatgtcggacacgactcttatctctaacaaactataatataccataagtctttgcggtagacttttgcccaaacttatctctaaggaaattacatgaaatatcctaactaatagatacaattgcctttccaggactcaatccgtgtgtggcaatccatatgaagcacattaacttaatccgacaacgtgtatcgaatcatattgtcagaatcggcttgatcggctaacctagtccgactcgaactctgtcgattaaggtcgcagccgattcttgctctgtttccagaacgatatttgtcttggattccgcttcgatctaatcttcatatccgatactcagattagcaaatttggttgttaacacatgccccccaagtccggaatatttggtaatgtttcggatttgccatatattgtctccaagagaatatcgcacttgtcgtttttttaccgttactccagcgctttaaatactaaccgtcaactctgagaaacttcacaccgtttcctccattttcactgctgaagcaaactcctccttctctctcttcggcgatccgctcggcgcgcaaggcgatttccaggcgatctcctctccgaccaagtttccgcccgcggcgatgtcgacttccgccaacccatctgccgtgccatcggccgagtacgcagaggtatgtgcccatcggctagatccctttttcccatgcaatagatcagtttttcttcatcttatcttgttttcttcttctctattccttttggatttgtagcatctttccattctggttgcagtccccagtttgtttcacgatcaccagtattttctcggtccgattggcagtctcgacccctatgagttcattagtgctgagaccaatatgatcccttttagactggccaacccgaacctaaatcacttgaaaaacaccttcaaatcctggccttcacttgagaaaagcaatcccgagaaaagttggcctgtgtggtacaagcgagtatcggctagcaagcaggctcactgggacgaaattggaatcggccaggcacttgcccttactctagctaattcggctaaggatgagccactgatggccgctgcagcctatttttggtccaatactctcaatgctttcctcttcatccaagggccaatgataccaactctgctagatgtcaccatgatcattggcttagatgtgacttcatcagccaacccaataagcttaaacacgaagaatacctttgaattcaaaagcaagagcattggagactggtcgggttacattgcagcgtatatgggcaaagggcctatcacctcccgagagcatatagcctttctgctaatgtggctagaaaaattcttattctgcggatgaagttgtggccccacaaccaactggcagttcttagccgaagccctagagacaaaaaggcaatttcctttaggcaaaatcctcctcggctacttgtatcagatgctgaacaacgcatcagctaagatagctgtcggctcagtcgtcggtgcaggtggaccacggtggctactgcagacttggttaaacttggtagccatgaaagctatcaatcggccagctgtgacagttgttgaattccctagattagagccgatcacagacaatgatggagaagagcgtacccactgcaggtgtatgtcctatggggagtatgcatccacaccagccaatgctggagcaaagttatcggctgagtttctgaaggactggttcttcagtttctatgatggatttcagaagaatgcccgagtttggtttccatatgcagactcgacggatttagatctgctggcagagttcagatttgaagacatcaaccatgagaaatatcaaaagtctagagaaatcttcgctgccaccattagcccctgcattcttcctgttagtatccatcaagggagaaatattcaggtttcttatgagttctaccatccgataagctcggccaggcaatttggaatgggccaactcccaatcggcttgtactttgccgataagacacaatgtagaggagatatttcttcaagcttgatgatggatcggctgctcaacatctcaagacctcccttgggcagcattgagaacatagagctagcaagttttaggagtagggcctttgatagatggtggagtgaatggaaactacatctattccatcaaccagcttccatgtatatgacagacctatttccggatgtcatccctcaggtaaatctttactttgtcaattctgctaaaataaccgtcagccgattggtaccttgactaacttcttcttctatcttgcagacaacagaatcttctcctcctcgtaaaagcaatagggacaaggacatagaatatgctctaggcctcataccagacagaggtggaccatcaaccccaatcatcggctaccatgcccccaagacctcaagtctactccaagggctaataagagaaccgggccgatgctggcaagaagagaaataccaaggtatcggctactgacccatcagctctagctccacagaaaaaagccaagaagaagaagtccaagccaaccgatgatttgcctaccttagatccatctatcgaacaagccctggatgaagaggaaattggagaagatgttgatcaagctgcagccgagctaagtgacctaggagaaaaaacaccatcggctccacctaaaaagacgcctccaactcctgcagctccaactcactttacaagggtaacttatcctgacaagctcttaaaaaatttccatatagccgatcattcattgaacttgtatttgtagaagaagaaaatcgcttcaaagaagacatcagcaaaagcatcatctaaaccagttccatcggtaagactccttctgaagaatcttttaaaatttaatcataaccgatgctaatttacatttgtctttttagcctactcctcctccttcaccccctgtgcagccgatgtcaagcggccgtactccaatggtcatgggcagccatcatattgaagaagaacaacaaccagccgctcctgctatcccagtaaatctttcttttttcaaaaaccccaaatcggctgtacaacatgcttcagtgttaacccttttccaactttcatctttataggtcttagccgatctattctcttttgacatcaaggactacttcgacgaggtggaagaagacaccaccagcagatccctagctcctctatatgaagatgttagaagaagtctcgaagacatttgtcatcgtctagaggcatcattagacagcttggtgaccgactgcggttctattcgggcaagattcaaaacaatccaaacctcaatcccatatgacctatcaaacgtccttaccccagctatataccttgaacaacatcaactcaagctagagaaagcaagacaaagactagctgatcggcgagagaagaaagacatagaggcaacaatccaagccaatcggcagcttgtacatgctgaaaaaatcaagctggatcatcttgccaaagagccaatcaaatctaccattgaccaactaaaatctgagaagattgagctcttagctcgccttgaagaatgcaatgctaagcttgctatggaagaacagaagttagccgatctcccgagggcaattgaagaacaaaaatcgaagttaagatcagctaccaagaacgtagctgatttgaccaagtcccttaaagttattacttgaaccaatgctcaagttgctcacgccatcgaagaaatcgaagaaatcaggcaaaaggcaatatcggccatccaacattatttatctgcataactgatcgactgtaatagggacttagtaacttttgtatccatttgtgtaatcagctaagaaactttaacactttacttaattgtcttgatgatcctttgtgccgattaatataacttgctcaaaaattctcaatttttgtatatatgtgccaccctaattttgcaatgacgaaggcattgataaaattataattcagactaagggcgatatgttacatataggccatcatacatcagcagaacacaaccgattatgaaaaaacaaaaaccactaagggcgatataactatatcggccatctcaaggcgatgcaaacacacatcggctttacacgcatcggcagactcagccgatcatcagttaacccatacactagggtaatatttcttttaatactttccattaagtgctcatccataaacttctccatcaagtccttgcaacatataagctcctttagacacaaccttgtggatttgaaacggtccttccaatttggtgaccacttgccgaatttattatcacgagttcctaccggcaagattaacttccaaacaagctctccctcagaaaaagacttgggcactactttcttgttataatgtcgagcaaccctctccttatccttggtaacttttgcaagagctcgcaatcgtgactgaaccacatcctccctctcatcgggcatgagattataatattcgctggctgtcaattcattttgtaagtctgttcttctcgagctgattctaatctcccatggtaaaactgcttcatgtccataaactagcttataaggaggaacttgaattgatccatgacaagtcatccgataggaccacaatgcttcggccagtctagtatgccattgccgaggataatcagaaatcttcctcttaatcaatttaatcaaactcttgttggatgccttggcttgcccattaacttgcgcataatatgatgaagaattcaacaatttgatacccatgctatcggcaaattgaacaaactcatcggacacaaaaatcgagccttgatcggttgtaatggtctgaggaataccaaatcgataaataatatgctcttggacaaattgtatagcatccccccaatcaactttcttcaaaggaatcgattccacccacttgctaaagtaatcggttgctaccaatataaacttatgtcccttactcgaaggtggattaatcatcccgatcatgtcaattccccaacctctgaatggccaaggtttgatgataggattcataaccgatgctggtgcccttcgaattgctccaaacttttgacaatcttcacaacccttgtaatatttaaaacaatctttcaacattgtcggccaaaaataccctggacgtctgagcaaccacttcatcttatgagccgattgatgagtcccacaaattccttcatgtacctcgcctattgcaaccttggcttgatcaacactcaaacatttaagcaacactccatcaattgtccgataatacaattcatcatccagcaaggtatatttcaaagctttataacacaactttcgtgaagccgattgagacggattctgcaaatatcgaaaaacatcatgccttcaatcatcggctgttattgtagcaacttctactttaacatctttcatcatcggcttgtaccccaatgctccttgagccaaatcattagcttcaacgttttgctcccgagatacatgttttaaagtcaccagccgaaacccatccatcaactttcggcacttctcattatagatcaccaatgtatcattcttgcatttatattctcctgccaattgactaatcaccaacaaaaaatcgcccataatctcgatagcatcggcttcaacttccttgagtaattgcaaccctttgagaaccgcttcgtactcagcctgattattagttgcataaggtttaatagtataggaaaacacgaaacttgcctcccgaggaggaattataaccaagcctataccacaaccatgagtgcacactgacccatcaaagaacaatgtccaaggcacaatgtaaactgagccgattgagccatgacgatgatccactataaaatcggctatagcttgtcccttaatcgccttcggtgaatcataccgaagatcaaactctgttaaagcaaatatccatttaccatcccttcctttcaaaattggagccgatagcatgtatttgaccacatcggctttacatatcacagtgcattcgttggacaatagataatgccttaacttggtgcaagagaaatacaaacacgagcacaacttttccacaggagaataccttgtttctgcatccaagagccttcagcttaaataaaatacagccctctctttgccctcaagctcctgaatcaataccgagccaattgacttctcaccagctgacaggtataatctgaaagatatcctcttttgtggaggaatcaaaactggaggggaactaagatattcctttatattatccaaagctttctgttgctctaccccccaagtgaattgtcgatcggctctcaatctcaataaaggtgtaaacggttccaatcttccagataaattagagataaacctcctgataaaatttatcttgccgatcaactcctgcagcttcttcttgtcatctggaggctggatcttcttaattgctttaatactcctttgaatcacctcaatccccctttcataaataagaaatcccaaaaactggccagctgatacaccaaaagcacactttgtcgggttcatcttcaagccatattttctagttttctcgnnnnnnnnnnnnnnnnnnnnnnnnnnnnnnnnnnnnnnnnnnnnnnnnnnnnnnn

SEQ ID NO: 14482 - DNA, 690 bp, Oryza sativa
ccatccgtaaaactcaatatcttatgtcttgaggcagcatcgaccagctgatcggcaaccggcattgggtattcatcctttggggtagctttgttgagatctcgaaaatcaatgcacaccctgactttgccatttttcttgataactggaactatattggaaacccattcagcatatcggcacggacgaataaaaccagcatcatataaacatttgacctcagccttgacagcttcaagcatatcggctttgcatctcctcggcggctgctggtatggtctaacccccggtttgatagggagccgatgttcaacaattgatcggctgagtcctggcatctcataatattcccaagcaaagcaatctcagtattttttcaagagctctatcaacttggttataaatttggaagataagttcttgctgatgaatgtcagccttggtctatctcctggacctatatcaatttcctccaaatcatcagccgacatgaaaccttgtccttgcttgtcatcgagatcatctaccgtgtccttggtgtagacgtttgaaccctccacgacgccctcaaaacaataatttgggctctccatcttcaattggctgtatatcacgatcggacacatttagaaaatctccatcccaaatttttccagacaggcaatcaataccatccatctcccaaagagc

SEQ ID NO: 14483 - DNA, 459 bp, Oryza sativa
catgcccgcaggtcgactctagaggatccccatcccctcacccggccggctactgtttctcgctagtgcaccggtcgacgtcgcagtcttccctttcggcatcgcagcggcaaggtcgtcctcggcatcacttcccctccatccaaacccctccgcgggccatcatcgtcgtctccgttcgttctcgtcgtcgacgtcccgtcggtcgcccggctcgtcgtctcgctgcgccgccaccgtcatcgtcatcgcagcggcgtgttccacgccgtcctcatctccgtgcagctactgccggctgccctagtcgcctcctcgccggccccggtcgtcgtcatagtcgtcctctcgtcgttcccggtcgtagtggcggtcgtccctccgtcgagccattctcgtccgtcgtccgcgttcgtcaagcgagccgctgcagccccgggtaccgagctcgaattcgcc

SEQ ID NO: 14484 - DNA, 731 bp, Oryza sativa
  unsure (1)..(731): unsure at all n locations
nnnnnnnnnnnnnnnnnnnnnnnnnnnnnnnnnnnnnnnctaccccaaaggatgaatacccaatgcccggttgccgatcagctggtcgatgctgcctcaggacataagatattgagttttacggatggtaatgctggttacaatcaaatctttatggcagaagaagatattcataaaacagcttttagatgtcctggtgcaatcagcttgtttgagtgggttgtgatgacttttgcttgaaaagtgctggagctacatatcgacggcctatgaattatatataccatgatctaatcggctggttggttgaagtttatattgatgatgtggttgttaagtcaaaggaaatagatggccatatagccgatttgaggaaggttttcgagaaaactagaaaatatggcttgaagatgaacccgacaaagtgtgcttttggtgtatcagctggccagtttttgggatttcttatttatgaaagggggattgaggtgattcaaaggagtattaaagcaattaagaagatccagcctccagatgacaagaagaagctgcaggagttgatcggcaagataaattttatcaggagggttatctctaatttatctggaagattggaaccggttacacctttattgagattgagagccgatcgacaattcacttggggggtagagcaacagaaagctttggataatataaaggaatatcttaagttccctccagttttgatt

SEQ ID NO: 14485 - DNA, 475 bp, Oryza sativa
  unsure (1)..(475): unsure at all n locations
nnnnnnnnnnnnnnnnnnnnnnnnnnnnnnnnnnnatagtgcagaagatcagtgaaaaggatgcccattgttaagccaccatcagcgtaccccgtgatgtacggacaacgtaaggtcatgttgcatggtggtcgcgaagtgcatattgtatcgtcacatttcacctcttttgaacttactgagctcctagggtcataaaatgtcagctttctctgcacacaagcaaatacacgtacccacgacaaaaacaaaaacatattacaatccagaatttcaacttctataatgaataaaaaccctaaattgcaaaagaattttgcaagcaaattaagggactgaaactaaagaaacactacaaggaaacctaccaatatgtcgctctcgtgagggcattgcttgcagaagatgccattaacccaaaannnnnnnnnnnnnnnnnnnnnnnnnnnnnnnnnnnnnnnnnnnnnnnnnnnnn

SEQ ID NO: 14486 - DNA, 572 bp, Oryza sativa
gagagcttatctcatcttgcgcaaaaagtgactctacatgagcaaagatttgccgaagctaagaagaactttaaaaagatcaaccatgtgtatccttacatgtatggttctgatgatgaagatgatgattccaaagtggcagcagccgaatgggtcagaagcaagaaggtggtacaatgccaatggatcaagaattctaggaaagaagaaaaatatgactttgatatcaccaaggctgacaaaattttcgatttgttacttcgggagaagcagattcaactacctgctggtcatataattccattagctaaagagctaggaaaaaggaggtattgcaaatggcacaattctggttctcattctactaatgattgcaaagttttcagacagcaaatccaggtggccattaaaggaggaaaaatcaaattcgatgattccaagaagccgatgaaagtgatggtaatcctttccctgtcaatatggtgcatacatttgggaggatagccaatgcagggaggaaccaaaattttcagatgaattcagctagaattatcaacaaataccagagaaag

SEQ ID NO: 14487 - DNA, 603 bp, Oryza sativa
cttcgttggcaggttgggtgcgataacttcgcatttgtcgagaatgttctcgataatggagtgtactcgaccataacctaatcgagtgctcagttgttcctgaaaaatattttctagaaggcaagatatatagcagataatatcgagtatgtactcaaaaaactgcatggatcttctagtattatcaggatataatgagtagattaaatatcaggcattatgtaaaccgtaaacaaacatgattcatacagaagagaacaaagtgaggccccagcgttagaccgtagtcagtttaacgtcggaaacactcacgcgatagatattgtataaaaaacatgctctaggtaaacatagtaaattgtagatctgacaatgctgtatgatctgaataggtacgataaattcatatagaatattgcgtacctttgtagatatatgccggatatatctacgaaattagtagatcaatttaattaattaatctactaattaccttggttgtcatgccgtgcgtccttagtagagatttcatgcatgcggtagattaggacgtggattaatatatcaccaggatcatgcttactgtgtacgggttggacaccg

SEQ ID NO: 14488 - DNA, 4120 bp, Oryza sativa
actggaccgtaagaatgccaaggcttattccaccagccgcagtcccaggatacagagacatgcttaagcaatgttaacaaatggaggaccaaaattcgaccgaaaaaaaagaagagaaggaacacatatctcgactgtcgtattgataatccaccaacaattgcccaatcatatacactctacatttggagaccttcctaaaagatgtagctgtcaccttggggcttggggaggttcgacaacaagcatccatcaaccaaaaaggagatgagactttggatcaaaacagtatgacaagtatcaatatagctcccaccatgacccactggagaaatgaactgagtctgcttctctcccaagaacatctgtgcctcaaaattggccgccaaaaacaactaggccaagcctgcaaaagaataactcaccgcctgcgatcaccgaatcacaggatactgaccagtgccagtgtcacggattggcaaaactggagaaacaaccaagtaatgactctcttcactgcgcattcgccttttccaacttctctttctcaatttcaacttttctttcctcggcatgttgagctaagccattcgcgagtgcctggtagcggaaatctagagtctgcatcaggctctggaacctggctggatcagatgcttgcatacctgtaacagatggtcactaacttgtcaggtaacttcagccatagtagcatagagtaagcacaaacttgtacaagaatgctgttttaccttggatggtatcaacaaagaagatgaatgggtccacctcatcaattggcgattgcaactcctcatcatcgctaaagtcatcatcagaatcatcatcgtcgtcatcatagtgcggctggaaacctcttgcctaaatcacaggaagcatacaaaaacatgagtacagggtacagcataaacatgaaacatttacatgaaataaagatttgaatttcacaagacactatggtaaaaaattagtctagggaagagaaggtgacactttctgtggcgtgctaaaagaagacagcagcaagctcaaaggccagcagagaacaaaggtgattcacgagaaatgtgaggcgctctaatgtagttttttaatatacatatattatggaccacttcacccaccatgcatggtggcaaacacctccagaactgattcaggggtttgcttagaccgtttagcatacttcatggatagatttacacaattttatagtttaggggacaatagtttacaggtttaaatagagcttctcctttttgtttaactagcttttgtgtgtgttatatatgttacagctactgcagtttaggatataaatggccagcaaaacaaactcaaatacactttgttatatatgcaacaactatgcaatttgggattaaacattgctagcaactcaagccgtatatatatagtaatttagtttgtcagctgtaattgtcattattcagaattcagtgatacaacatccttcatagtcaataaaacataagttaatatttatttaaagggaagtatttgtgttactaactttactagtccttttgttgaggggaaaccagactgaaaacacttgttaccagagaccgtgttagttctattaaataataccccatgaaaaacacttgtagaaaaatttaactattttgagcatctaaataaaaaggaacacatttttacatgctaattctacttaagtccatatcacaatacaaacctctcttagtttctgaagattgacactagatacttcatccccatcctcatcatcatatcccatctccttatcagactcaatatcctcatcttcttcatcaccatcaaatccatccaaatcttcagctgcagcctcattttcccatttagattctgcttatgaacaggaatgattaagatcaggcaaaaggaattttaaagacctctcctctacatcgtaattgcaaaaaggagacataagattagaaaattttctcaggtcaacatgttaacagaatggtatcacagagtttttgttcgaagtatttgaattgtcatatgttcatcagaaaataaacaaaagataaaattgaacctgcaacttgatccttgtaagaaacaagaagctctagtgttgctttgaaaatgcgctcaagagcttctggtggaatgtgattagctggaaggctaattagtgaagtcaatcccaagcaacaaaccttcttatcatgttctctgcaaataaagaaaaataatgtacggagtcagtgcagcataaaaacacaacatgtatagtactacaaggtacaaacatatgctaacaagacctacctcttaaagtttgcccttatgccacttttctttacttgctgtaacatgccaaaccaaagattgaagatttcagtagcaactccaagcttatgcaatgttcccaatgtcaatgaaggattgtagtacagtgtattagctatctgcaatcacagtggaaagttttaggtatacatgtcatcagttagcaagagatacagatgccatgtttgaacaaacatgacactacagtgattagattgatgcaacatatgaatatggactaccacattgggaagtgttaggtaaatgcggccaacaaataatagtgattatatgcagttgttctgatggaacataactgaaaattccactgctaatgactaaattgacctatgatattgatcggccagatacagatatgagtttgccccatgcaacatgaaaacctatgttccttgaagacactataatcaaatggttacatcgctttccacaagctggctactgtgctgtctaagctatccctgctttatccctgctttatccctatgtagaaaaactatccctgctttatctataccaaatgacaccctttttgatcaaggagttataaatgctgtctaagctttaagacaaaatgtcatatgatggataatttacatataattgctcataatttctaacttccgctatcactgggtgtaataaagtcaattcatgtgccagatcaatctaaacaacaaagttttattatccagtgatcctgtcacctgctggagttacatagggatgatatgctacaaactagtcacagcacatgcagagtgtcactgtttggaatgcaatagatatcttacaccaattacatcccatagctatacatagcctataggatttgcaactttctatcattttatcaatatctatctattcactgcggtcaagttgtgcaactagtcagacagagcacaacttgagggcacgaccagacttgggccgcttgagagcaaattgggccggcatagtcaatcagaaagggagataggatcccacgtacatagttagatgctagagccagaacgagagcaaggttagaggaagcagcaagagctacacgctggacattggtgctcaggatgcagttgcccatcactttggcaggagcggagccaggtagagaagcttgacagagagctgcacagggctgccaatggccttcctttccccatctgctccctcttttttcatgagcatgatcccttgtaatggactagtcaactcaatcaggactagtgcacaagtcaatacagggatgactcaacttgactttatgacttatacaactatagtttacaaacaaccatgtatttattccttctttttcatcttgcccaccccccccctccccccctttgttctgacagcaagatcactgagtgcctcctgcagtaggcagagccaacaatcttcctgagggggccatcttggcaactgccagtatgaacatgtgttaggtaaactgtggtgccatggatgccttccaacacctttctgccggttgcagtcgcacctcaccatcgtcctcccatagcccattgacaggctgcaattgttggagcaactccatccccattgcaagcaaataatacagcgtcggcaagattcttcttccccttccccaccataaagcctccatgcattctccagcctacatctccagctcccaccttacacctcctcttagagcgagtacaatagtacaagctggactggtgataggagaaacacgtcagctacagtgatgagctgg

SEQ ID NO: 14489 - DNA, 24454 bp, Oryza sativa
  unsure (1)..(24454): unsure at all n locations
cttgggggaggtcaggggtacaaaccttgggttacttcccacttggactaaagacttcactcttaggtgcttccacgtcagtggcaaaaaataattaaatgctacaaaatggcaatcctagaactgatcgattcccatatactgtcaagggagggtggaaggcttaagaatagataagagggaacttagggtgtgtttggttcattgcccaaacaaaaaaaaatgacatggcaaagtactcatacacttggtttgttgccagaaattcaaatttggcaaagcagtatttttacaaagctaaacacaagcttaaagtaacttggccgatatttgggcatcaaaccaaacacccacaccttgccaaaacaatggcattacgaaatatttggcttgccaaaatttggtaaggttaactataacagctcaccctccagaaccgcgtagcatagcccacttacgcataccacgccacttacacttccatcctcacttggtgtaaatgggttaacccaagagtgatgtggttggagggacaaacccttataaattggttccaccttgctaaattagcaatgtggtactaaacatgcaaacacagctcttatagggcacacaggccaaatcctaattgggccaggatgtcacattaacaatggctataatccagaagaataccttaagatctaccaccatgttgaaacgaatggcataaattgcatcttttcaagattacttgccatcatggggtgagattacttgtttgctggttctggaggatgaagtagactggcaggtatcttcagttaatacagaattggcgatttggctggaggcttggagctttaccaatttagactagtttttagcaaaccgcatatctttgtcgcaaacatggtattttagattattcaacataacagttggatttattaagttctcaaggttttcctggcattagatatattagctttgagaagttgcatccctacaaataattagtagctacagacaagcatgtgtaaagtgtgaacaacctctgcaacctagaatgattaaccaaatgcagttatggtatatgcataccaaggcaaccaagtgtacagctgtatggatgcatactatgaagctctctaccaatgacaaatgacacactatattacactacacagtacctgataacaagtcaaaaacttgaaatagaataaagtaatacaagaaaatgtcaactatactatgatcaggaagttagcttcttaccacttgtacaagtaagcttttcagatacggcttcactgcacgacgcagccaatcaattgttagcctgagatacggctcaatccaatgatcgacttgacctttgcaattttgaaaaacgacttcaatcagcttgggagcaggtataatgtcagaatcttccatgttttggtctgtcataatctacaattatttgtaatcaactgtaaaaattacaggaactaggaactttacaaaatatttcagagcaaattttaatgcaacatgaatttaattcactcacagatgacagtgctctccataggctttgctgataatcaggatctttgcatgcaataaattgatcagtgccacgggaaatgtagttgtctaatggtaccagaatatctgcagggcaataagaacattgaataatgtagcaaaaggatgtcaaagataatacaattgcttctgaaaatatagttgatggtaggagattagttccatctagtggcctgagggtagaaccaagcaattttctacagatagaaacagtcttagcagctgactaaaaaaaattctgaaggatagacaaccaagcagttggcatttcaatactttctagtactataccaaatatgtaaaacaaggattccaattcaaaggaacaaccgatgacacaactattcctgatgttcttatctaaaatctggatgcacatgtgaatacaaaattttccttttgcataatggataccagataccggcatgctaaactatcacacagaaatcataatttcaattcaattaaacagaatcttaacaatacaagatggttctagtttcataaattcaattccttactaagtggcataaccatcttatataatcctgacgaatgaataatgtaagaatagacaatgcaaaggctgcatttggtccaaggtattagattggttgaaggtctaatcttgcaaacacatgcacgttaggaagcattaatttaacacaataaatgcctttcgaaccattctaagtgaggaataagttgacccacaaaataggtgcagcaataagcaagccgacctcaactataatagtttgttcttttactaataatcaaaacaacaaagcagatctagccaaacataatctgagactaactagattagtcgctggacacaaaaaaaaaggtttgagctgctaaaatccaggttaaggttaggaaacctaatcattttttattagcgacttggaagaattttataaatgagcacgaaccaaataaaaaaaataatcagaaaataatatgacatgcaaactgaacaaactagtgaagtgggcacatggaaactaatacaaggtgattcagatattattttaaatcatgcatgactttccaaattacaagcattcatacaactaaacaagattgtcattggaaaatagcacaagcaaatataacaaacataaaactgcaagaaaacccaggaatatgcttaatctagaactctcagtttaaaacaaacataattgcttgccattcaaaactagacttactctcaaagaaatcaatggcccaatcattaagggcctccatcatcaaaggccacaagccccacatttccagtgaaatggttggtgagtaaaatgtcatataggagactatctccagaacttcttcatacacatctgcaagacagagtcaaatgcatcagcggaaaactgcaagaaacaccccaaacctgattaaatttaaaacaaacaactcttaaacctttgataacaatttgagttcaaacaattcaattgtaagtttgtaactttgtacaagtatctagcaggttaaaggtatatcaccagggatgagcatgggtcaagcctacccattgacccatcctaagtaaatgaagtgaatagacatgaaatagaaaaggtgcattctagttgattagttgaactgaatatgctatatcttgatctttactcttttcaaagtaagagttggggtgatggcttgtttacttgtacacccatccagccatcctcctccacaaggatcttcattttaaaatgacccttttgcacatgcatacaaattggtgtgaatgatctcatctaatcatgtggacactttttatatttgaaagatagagcctttggtttttttaactgtggatccatagttatgagtgaataattttataccttgaccatctgaagtcaacattcttcgtaaaataggcaacaaagtcggctctatttggggaaacaaatgaggaaggctactaatggactcaaggattgtgcttatcgcacgtaagcaaccaacagcagccaaagcaccagtgtcctcaacttcttcgtcagcttctgaactagccatgcatctccagaaagcagcagcctatcaaaaacagtaacatgaagttcaaaggaacagaagaacttattgggctaaacacaatgcactgaggggcaacataccaaactctggcacaaaccaagtgcatatggtgccatctcttcaccaaatttgtcaacaattgtctcaagggtgaaaacgagatcttcattctcaacttcactcataagcttaaaaaattctgcaaataatacttaaagcatgatttaaccacaataaaattaaaaaaaagttgaagaaagtgatagaataccatcaagtagttgaggaagaattggtcggatctcatctagatctgtagaagaaatacaaaatatagattgtgatctattcgaaagggtgatccaagttaattaggtctctaagaaattaaataaagactacctttgcatgcttcaacaaaagaacggagtgcaaagactgaatccaccctaacaggaagttctggatcacgcaaaccagagattacacaatgcatagctttgcgaaaattgttttgatctgagaaattgatatgagcatactgcccagcaacccatgctgcctacacatcatatggtaaaaatcagcttaatgaaacaagcaaataagaagtactaaagaaaaaacaggggaataactgcattaatagaatacaataatagaacacaaaaaaggctacacaaagtaaaaatataatatatttaagtaaaataggacccttaaggtaacaagtcattcaaatatgataattgcagtcaaataatttgcaagaaagtacattgtggaagaactatcttataatggtactaaaacttagcatttttaaattggaatcttatattacatgtcactgccaacggaccaggggcaccagcggtggggcaagggccaatgatgttggcccttggatgacatcactgcagtgggggcatggtaggataacaaaggcacttgggaggatgactccatagccagcaggggacaaaagatgtcaccagatgtggaacagaagacgatgcacacaggacagcggcacctcaatagaggagaaatcaaatgtgatttgggggagatgtgagagataagggagaatctaaggataatttcgccattaaaaaaactgacagaattgcttctaacggtgtctgtgtaatgtgtatggcatccaagggaagaaaatttttgtttggtggcaatataaggaaaccaatgaatttctaaaggcacatgaggattgttctctttttataaaagagcactgctacacgtactaaatttcttttacaaaactcttataaacaatgatctcaaccgtttgatttaagtagatggaagttacagaaaatctagatgtactcacagcatgaagagtttagtaagacaaaatttagtacgtataaacttttcatttataaatatatgtgcatgcctcaaactaaattactggacaattgcattttggagacattgagaattcaaacttatgaatttcggactaggtagaatacttcaggacagaacctaccaaatgttccaagttttaagtaaaaagaggaagaattagatgcagaagtcatgcagaactacaattgtactaccaaaatatggtggcttcaagaaaaaatgttcatgatctaaaatgcacaccaatttatagcttgttacctttgcacgtaagtgtccaacatgactactgaactccggaaagacatgttgaaccaacattcgctccagctcagccttatatggttcagtttgttttagcctatcacacaatgtcccaattgcaagaagcgcaccatccttttggcggtatggcttcacttcaatggatgcctcattatacctgccaaaatgttcttcaatcagatattagataactcacaaagttaagcacacacatattaatcacaggatgacacatacctcataaatatttccacaataaaatggataaacttttgcagattgcttttccctcgttttcttaccaattcactcacaaagtccatagcagctgttcgaggactatacaaatcttcaataatatctgtacacaaaagtaccaagtagtatcatggctacagaaaactaatggagtgcacatactaccttgcagaacattgagaagaaataatgcaaattctttttaaaaaaagttgcttagatgaacatattaccatagcctttccgaacatattcatgaggatcttcatcccacaacatctggtcactatcattgaagcacattaatgggaagattatctcaaatagaattatgtcaatttgtggttgcataagctgatacatgctgttcttcgtgacactgcaagaaatacttacattcagccacaaagaattcagaaagcactgaatcccccccccctcaacaaaaaacgtatattacatactgactgtacactaaaataatgaaaggcatgtaaatataaatcaggcgaaaattatccatattgcatgaatgaagtggaagttgtgccattacaaatctgatgactagagcaatttgtcatggaactgagataaagactgattgcaaccatgtgaaacatgcggaaaaccagacaaaatggagaaagggagtggcaaaaacaatacgaaggcagaccacagagctactaaggaaatacagaatgctgctgcacagtttttccacaaacctgttggtaagatattgaagaataagattgataaccctatcaggcaaatagccaccagtacgtattgcattgagcaactgcaaatggcaccccaaaatttttccagcatagttcttttggaacatttgagcaaaggctttgctttctggtctctgaagcttcatatcagcaaacctgtaatgaaaaccaggtttagaatacaaatgacaagaatcacaaaaagtttacttgacacagaccgagtgtataaacggttcaatatatggataatccatttcttgactttccaccatccccaagatttcctcgcatcaggatccaatggttgtccttccactggaactggtcgctccagtaagtttaagaacaaaatcatccaagtattgaagacatttggatcaaaaagttgctttggaatttctagctgcagaaaatacatggcataatgagtattgaaaaaaaaatggaaaacataataaggcaaagaacttacataaatggatgaccagaaaattttgcatatcagcttgatcaagtcagctacttcaattggagggttggaaatcggaacaagatttcttaatatattcaacaaacgaggaaagcattcctcaacaatttgatacaaaggtatcctctcgtcctctgacttgaacctaatcatgaagaaagtaatgagatagtgtggcagctcacataaacaaaagacaaaaaggtaagcactgtatgatgttgtccagaaaaatgttcatagagcaaagaattatgttgtgcacccatcattttaagaaaactataacaacaatgttatctttacactatttctttgggtaatctctaaattacaataaagatcacaaagtcagcaaataaaacaaatagagtgaataacatgatgtgtagagatatttcacagcagagtaacagaaacacgtaaatcctaagttttttggagttacagaaaaataattcaaaataggaagacggatagagtgaatacaaacaaataaaaaagaaggtagaattctggcatttagactcactcatatttccgggcaagaatccttagcacatatagtgctccaaatatttgatcctgtgattctagattatgtgttacccaaggaagaagactaggccactgctcaggataatctgcaaggatcaaggtcttgatactttctccaagctgggctctacagaccatgaaatatgtgtcaattacttgtatgcacatttcataaccatcagtactgaagaatattgtgctttgtcatcaggaaaaacacatccactacaaatttcactgaaatactcatcaaaaataaaagtaccacaagttattgtttacaatgtagaacttgacagtgcattccgttcaaacttatgatgcttctgtgaaaaactaacctaaattcaatatctagaaatgctgaaacagtcatataggtctaacaaaactgaacagataacaccttgaaggcccgaaccctattccacagtggttttgattggtatggcagtggaaaagggatcgaggtgttacttatccagttttgaaggttgtaaacaacctgtttttaaaggcagggtgaaaatgaactttgcgaattcaaggaccaaaaatatattctatccaaagtacaaacatgagtcaaaaatggtattttcagactcatcttaactccaattggctggggtctaaattacttaaacaaatgtcagcattcaataatatgtgtaggcaaacattgtgactttgtgagacggccaaccagaatttatagattgacatcaattgtaagaagaaaagtactccagtattgaaataaaatgccttagaagtcaatttatctagaattcagaaacaacagtacaccaaaagcataaggactacgattatagcatttggagagaggcgcaaaaatgttgttcattaagaaaagggtaggtggacagtgagaaataccttagcaatggaggtaattgagtaacaaaacccaatatattctcacggaccatggacttgtcactttctggaattatatgtttttcttctaaagaaggacgaattgtaagtcaacgagacacaaggaattattgctcaaatagtaaccttttcataccaggatcagtaggtgaccaattcttcgcaacaaaattcttgaaatgaatgcttgcgaactgtctaacagccatatcacaatttccatccacaataatctgtagcaatctaaccaagtgttgtggtgtgtactgaaactgcaggaattaaagaaatatgaatacatgagtccgaagcagactgaaatttataaagcatagcaatgagccaatgacatcatcagtatttaatgaaacaaacaggactactcaggaaaaaggaaatagatcaaacacaggtaaaacccaaaaggaagggaggagcaaggacagtatgatgattagtcaccaagcataaaaaccattaaatgatcagctgatgtagagcaattttagcaaacagaaacggtacgtgtggaatgataaaagcccaccactaaaataaatggtcagctgatcagaattctattttatctctgctggtatatgacctagtaatgagttgtagtggatccttatctttcttgaaacaaggataacaacgaatcatcaaagctttctgaacaaattgcggataacaacgaatcatcaaagctttctgaacaaattgcaatggaagctggaagataagaaacatatgaccagtacaatataaaatgtaaatgtgtagtcttttgaatcccccattgtcaagccaaaactagataattcttcccttattggcttgacagttcattttggcaaactgtagtgttgggatatgttattatgtaacataagaaaatagcaaacataaactcagaaaaagagtgggatgcttgctccatatgtgactattaaatatacactagtacactatatattttgattatgaaggcatcaggtagaggtgtctgtttcatataaacttacaagggtctacgtgccaagtgaaagccctcacaaaatggccaactcaatgaaattgatgtccttacacatccaaatgaaattgatgtccttacacatccaaatgaaattgatgtccttatacatccattttgataacatgatatctaaacaaggttgccaccttagcatgtcataccaacaaagatagagctaactacaacaaagaaatgcaaactatttcgaacctaacttcacaaaaaggccaatccttatggatgtgcaaggagatagcaaacaaaaaggctaccctctcttagttcggtcgactttacaaacttgtgaaaggatgccattgcacctttagtatattattgaacagcaaatgggtaaacaaacatcagaatgccacacagagatggccatttcaacaagtttacgcatgtggaatcattataggccactagttgaataaaatatgcatgataacactatattagtggtaaagtgagtatacatgattgaacaggcagctaagctaccaactctgaggcgttaacatggatagcaataatgctaacaataacatctgcaacaagagctaagaactagtaaggcatacaacatgtaacaattctcatgaacaaatcaacaagaccaaaatccaacagcacgacggatttaagctaagcatcaggcacgtgcaggattcacacaccagtcaccgttcaaatttaaccgaattaaaacatcaaacaagccgcagatcgcacgaaacatggcaacagcagtccaaacgaagaaccgatgctttatccgctctttttatgccgttgtgcaactgatatcgaatcgattgatgataggagaatcaaaaagcgaaacgaagcaatcacgcccccaccggccccgctccaactctagctcagcgcgtgaataccccgttgccccccacagataccgagccagcacagaagcaaacgacagaggtagagagagagggggcggggtaggcccaggggctaacgcgtgatcaagcaacggggagcagcgagcgggagcgcgggagcgcgatctcacctgggttaggctggcctcggcggccttgcgctcctcggggacgtggctgagcgccgcgcgcagcaccacggccaggctctgcagatccatctccgggccggcttggggtaccggcggcggcggcgcgcggacgggggcggggggctagggctcctcgcggcggtggcggcggggggagtggagtccggagtcctctccttccccccgcttgtgtgggcgtcgcggagacttgggggaggcgcgtgcgggaaggggaaagaggagaagccgcccgtgcgtgcgtgcgtgcgtgcgggtgcgcgaggcggcaggcagggaaaggggactcaaggaggagggagcaaagatcaacgctagggtttggtcaaggccgcaaggggtttttggctttcgggttcaggcggccgagcgagccaaggtagagcttagctagcaataggccaccggccgcagcgcaggccccggtccgcgagaccgcgcgtacgtgtgcggtgtgcctctgctttccagtcttcatggactccgtgcacggcgacgcgccaaatcgtgagttcgtgacaagtacaaggtgggtggcaaccggcgtgggccttaatttggccgaatgcaacaccgaataggctgaacacaattacacaccgaccaaacaaatactaccttccttttttaataaattacgatgttgatttttttatgggacatttaaccatttatctttattaaaaaaatttacgtaattataatttattttgttgtgagttagtttatgacttaaagtattttaagcatgatttatatcttatacatttgcataaaacttttgaataagacgaatgatcaaacatgtgtttttaaaagttaacggtgtcatttattaaaaaaaaggaggtatgagtagaattgaagtggtagtttttattctgaacaatcctgaatttaggtttctatcctaaacaattataaagcatttaccgataaaaccgaaaagtcccctattttcatgtgcggctcctcaaaaggaccatacggaaaaatcaattttcacatgcgagcctcttaaatggaccgtgggcctattttcgcaggtggttaagagcaaggctaataatacagccgacatgttggctataaggttctttatagtctttctcagcctacccatataatagttagatctttacaattaatatatggcatacctgtctctctcacggagtttcttggttcttgtgttcaagccggctgtaagtctatagcccgcttctcctctctggcctctcttctctcctccaccttagcatttagccagcctatagcctactattatacttgctctaagaggtccacacgcaaaaatactcctccctcttctccctctcactcactttaaatttttcacctcccctccattttatttccactcatctctcactttctctcctctcctctctatctctttctcttctctcctctcctcttctactctcccgggaggggcgggaggcggcgtgcggctggcgacaaggtgatgaggcggcgactggcctcggggaggctggtgagtggtgacgaggcgggaggtggcgggctcgagcgtggtggcgagctgcccggcggacggcggtggttgacgtgctcgggtcggtgggtgcgcgaccgcggccgtgtgcggaaggcggcgaggggcgacggcgaccgtcccccacccagttccggcggcggcggtggcggcggccggcgggcggtggggaggaggcgcggcaacggcggatctggcgacagcgacgggagcaagcggatctggcgaggacgatgacgacgaggaggatgatggagactgcggcttctagggttagggttcggatttattgattttattttttttggtttttaatttttgcgtgagggcgacataagcacccgcacgcgaaaatcagatttctgcgtgcttctagacacttgggtgtgtgcgggtagcccatccgcacgcgaaaaccccttttggccacacggaaaaatcgttttcatagtagtgatttacccacatgaatacaaataaagaaccagattatatatccataactagtataaaactttaagtagaaaaccaaaccacatatccacgaccagcataatacttaaatattaaaccaaattaagaattcaatgcaacttgattcaaatcaccaactttgggtaatatatttcgacttccaaccttcgaatcatcttgaacgttggtggcggttgttaaaacccatttcgatcacaaaccttcggtaataaaacagggaaaacaatattgaatgcatcgatttgatttaaacaaaagtgaaaatatatgatatttttcacaaaagtgaattattttgcttgggtcaagcaaagaatgtcaagattaatattccaacatttttggttgcagactaaggggattccttttagatatcttgatatttctatgtattttagataacttagtaacaaaaatgaaaaataattgagtaaagaattgataaaaaaaacttagtaattggaaaggtaaacatatagctatttctaacaccacaaccaaacaacatctcatactagccaggctagactaatgcaaacaaccaaacgactgcatatgtatcacattaaattgaaaaaaaaaacaaccaggatgagctcaacctggatgagggagatgagccagcctagacagatacgagcaaccaaacacaccccatatgtctgtaggggagattggttttgataaattctgtgttatcttttttttgagatttctaaagtggttcttcacaaattgattattatatatcacgtttcttctggcaaggggatgagcatataaaaagatatatagaccggcaagatgggacattatatgtcagccaaaagattagggtgaacttggtttgaaattttgaaatacaaaaccaatgtttgttgtttaagttaataaatgagtaaggtttttggcaagacttctttaaaagaaaataattaataataaatcaatagcttaagttgagaggaaactaggggataccttttttgtcgggacttatgaaagttaagagtattttttttaaatatgggttcctagataattaataatggtgaacaagtcagattataggaggataagtggatagaaaatatttcctttaaggacagtttgtatcctattatcggatcccaaaactaatgattcggaaaccgacatgtttagtctgtatcaagccctggatcagtaaattgatacaggttcaacaatctgtatcttcatcgcatacatttgatcaaggctccaaatgagatttatttatgtaaaataatagggtatttacaaggttgtggctaactattacatcagaacctacagaatgacttaactctaatgtttggctataaacttaaaccatctatctaatctataattgagaattaagttagaatgaaactaacttatgtgattgaactcccagcttcggcagaaactccaaatagactctaaaaaagaggggttgaagcaagggtgagtacaacgtactcagcaagctattatattcaatatgaaggcatgaaatggtaatatttgagtagggctatgattacttgtagaaagctgagaataaagagggaaaaaacatgtgatgtttttaatgcaacagtatttaataaaatcttgaattatgtttctaaccaaatgccatatgagtctcgatactcaaatccatgagcacagctattcgaatagattcattttcactttactgcagtaaatgtacgttttacccgtagtccataactttccaataatcattagcttagtcatggcccagtatttggttactaacaatagtgacacatgttccatgaactctagtccccatgtgctctgaacatgacgttattagcagcgagatgagttctagtgttcccgaggtttttagagagaactaattgtatgacaccatgttatcgcaatcatggttcacaaacaagtcgcgacatcaatgaatctcatatatttacatgtgcctcagtaaatagcacaattgccctgctcggcataagtttgcctcctgcgcgaggacttaaaaacacgaaccactacacagaggtaccacattgttaattaacataataactaggtctgtccccattctagaagctgcggtcgtacctgttcatttgacataagtacttggtgataattatatcgaccaggacagtactagccacccggaaatcaaccaattcctacgtactgtcccaatctaagttcattaaattttatgcatattctaactaagcatggctaagtaaggtctagcatatatctggcttgctatatgttcaggccttcattcaaaatcataaatgactaacccatataatagagatatagaatatatgacatttatgctcaaaggggacgaataataacttgccttgctccaacgcaaatatatccaagataggcaacctaattattcggtcctcgaaataccacatgttgccatccaaaagacaatagactctactaaggaagaggaagaatcaaattcaataaaagtcattgaataacaagaaaaatgataaaatggcgagaagggctaggtttagggtgtaaacatcttctttatatggtatagggattattgggctaatatttcacatgtaagttctatagagttggaggctagaggggattaagcaactactgtcgcctatatttcatgtgtgggcttggttgctcaaaggataggatgtatattgggtaattgaactggtttaactggtatatggctagtattggctggtggtcggtttagttgtatttgagctgattatggagtagggcagtatctcagctagggtttggttatttactagtcgttgctagagttgggtagcatgacgactaggtttggtatcatttctagccgatgtcgatagacagcatattggctagaagaataggaggtggtgcaggtttagtggggtggaagtgttactccgacaactatgagtggcgacagagcggctaggatcatacagagcttgagagctaactatgtggtgcgctgtggaggtcgaggaaatagtaaaactctgaccgctatacgtattgaggcgtggggtgccaggagcagcacttcgaccttaggtttggttttgccgggctttacaactaacggtccgacgtcggggtcagtagaccgcaggaatgtccccatggaaggcgtaaagttccaaccaacggcttttagtggctaaagggtattttggagtaaaaggagatatttaaaaagcaaatgacatttaaataaatcaaggaaattcaaataaaattataaaatagcacattgggtatcaaaatgtagcttttgaatttagatgaatttaggtccaagtttcatcagaatcggatctacggtttaggatatatgggcttctaaagaataggatttgaattaaatagataaaatgagaaaagtcactgtgcaggggacccacctgtcaggcttttctttttctttttctttttctttttccttctctccttcttcttcctcccgttccttcttttcttctattagtagccgagagggggagaaaggagaggtgagcggggcgctggccctccggtggccggaatgcggcgacgccggcggcatatcgtgttcccgctcgatgcgtactcagggaggtcagtggctggtagagggagtgagagagaaggccagaacggcgcagctaagagctcggctccagccagattgggtggtgacgatggtggcttaaagtgagggggaataaaagggggagatgggcaaaatgagttcgccggagggaggccaacatagtggcgcaaggaaaaggatagaaacgctacggtggaggagatcgaccgtcggcaacgacggccggagcccggacatgggaggagagagagagagctcaaggagctcggcttgtgtggagtaaaggggagggggtgccgggtatttataggcggtgagccggtgaaagcaactccaatagaatggctaaatggctggctaagttaaattttagcaagtatggaggaaaaatgccctccaacagcctctccatcctgttagctaagccatctggatggccaaatctcactcctcattggccaaacttggagagtcactttgcctggatggccccaccactccctctcccaccccatctctctctccctggcaagaaggcagcagaaccgcacgtcggcgacgacaaggaggagagaggcgccggagccagccacgcccgccgccgccgttgtccgcgccgttgcgtccccagccgcgcccgccgccactgccgtccccggccgcgcccgccaccgccaccgtccgcgtcgtccccggccgcgctcgccgccgctgtcgtccgctccgtccccagcagcacccgccgctgccccaccctttgctcatcgccgttgtgtcgggagtacgggaagagaaagaggaagagggagaggaagaatgggtatagaggccgacgcatgggtcccgctgtcatagactcaaaatagagaggatggatggagaggctgttggagtaaacaatcaatttgacttgacaaatgaaatagagagttggccaaatagacatttggagagtcaaatctagagaggctgttggagatgctctgagaagcggtgaatcaagtcggttgcagaggcggtcgtcgatttggtcacgacggcaatggcgtggaaaacaaaggagcgacaccggcctcgttctatggttggttggcgatggcggcgcgagcacgtggaagctgcgtctgagttggcggcggaggaggagggtaaggcacggcgtcggcggaggcgcaagctgtgggcgacgatggacgacggcggtcggcggcgcgagtcgtgggcggcagcgcccatggcgcacggcaacagcgctcacagagaggagagaggcggctgcctctcgggctgggccgatttgggccgaggaaataaagaaaggtctggcccaaaatgaataggaaatcctccgaatttctgtaggaaattttgaatagaatttgtatttggagaggatttgaataggaaggttggacaaaggaacttggacacaatatatatttggaaggaatttgctcagcacttcttggaagggatttgaatattcgaagaaagttaaagataggtttagaatcaaaggatgggtcgacaattaattccaataaaattggaatcgcttggtttaggttctagggcaatagtggagaatttcttggaccataattcataaaaatagaaagggttttcaaactaaatttgaataaaagaattttagtcgaaagaaggttttatattcaaaaataaaattccatcaagaaatacctcaatttaaccaaatatatttttaaatgaaaaacacaaaagagattaaataccacagaaggattttgtgcaagttagttttaggaggtccctctaattatactgtctaggaggtccctctaattatactgtcctaagtttaggaggttattaagaacataagaatcggcatgatgcaagaaaaatgacacattttcaggaagttataaacctacccccttaaataaatctcatcctttagatttctgatgagtccaaatagtagtgtgggaattatattctttctttggttcttcccaaaattccggatatctgactgattaatctgttggtgaacaacttcatgtttttatagtacacgtaattgtatgtactgggtaatagaaagctgtatatcacttgattcaacctcatctgatttaaagttcggaaatccaacattcggtagcttttcccagtagagacatgccatacggtatttttgtatgggattcaatgtttctagcacataaatatgtaatcgtcatacttgttgcggagttttattaagatcttcccgttcttcttactattggggtggtcggacttcttctcgtatcctcagaatagagctgataaatgatctttgtctgttcttggtggcttcaacattttctatcgaacattattttcttccaactatatagaaaatatagatagtatcattagaaggtgtttaaaaaataaaagggtaatcctagggtgatgcagctaggggcccctttcggagggccccggcccgcctaagatttcatatgtgggattctctctagctaaggaggaatattgcatatatgactcaaaactctaagtataaaagtagcttggggcctagcttgggtcccaatcataccccaaatatgccttccttgtaggttctaggtcctcagcaggaaggacgtagaaacatacaagacttatatcttaagagaatgaggtaaggtctgcctcgggcccggcctgagcttgggccgcgggctcaccttagcccgtacaactcacatattactcaaggaagaagagtgacgagacttgccaagcttgaaagcggtttgacttgggctcggccttgttctgggcctcgggctcaccttggtccttgtatagcttgcatcccttgaacgtgtagagatgtagcctagagggggggtgaataggctttcctaaaattttctcaacaattgcagcggttaaattgacagggcccggaacctcctggtgatgaacaccggaactttcgggcaggatgagtagcccgaaacttccggagttcttgagctaggaacttccgggcagtagagataaattaaaactgagatgaaaaaacaggtcctagcaaggaaagtttaggcacacagaggaacaagatgaagatcgcagaatatcagcagattcacacaaagatcatgcacaagagagacaaagacgattttttcccgaagttcggatcacacgaatcctactctccgttgaggtgctccaaagaaccgggtctcgattaaccccttgcctcacttatacaaagatttcagaagaggtccacagccttcaacttaacacttctaggtcattttctagaattgagtgaccaccaagatcaaactcaaaaatccttctagaaaaggccacaagtgcaagttgctctacctaggacaacctctgaaaactcagcacaagaatctttactcacttacctcgtttccttgcggaggtgaggaaaaccttcacaaactttcccgggacatccacaagatctttggaagctcacgggcgacacctaaccgtctaggagaagatctccaagagtaataagcccaagtgacagcccacaaggtatctaaagtgctcaatcaaaacctatcttcaagccatctccaaaacactcctacactctcatctaatctctcaatctcacaagataggctctagatttgagtggagaaagcaaatgaagcttgggagtggctagaaaaccctagaacatgaaagaactgaagtggaatggccaaagggtaccctgggacgaaatccatatatataacggctaggtgacgtcatctagccgttattcacaagtttgaattggaaacctgccaggaggttccgagcaaaagtgccaggaacttccgggcagcacttaggaaattttttacaaataaacggcgcccggaagttccggccagaacctccgggtagccctctctgtcccggggagaaaatcatttttcaaaaacgattacaaaaatcttttgactcatggatatgactaagagcactttgtataccctagaaccacacttgaaacccctcttaatagtacggattttcctaaactcaatttcgaaagtgaaaaacctagtctaatcaccttcggtgattttcgcacttaggaacatttgaattggggggtctccttgcattcttagccatcacaacttgctttgggactaaactcctgtgaataaacttgataaacacgttagtcccctttaaccaccttgtcattaatcaccaaaacccactagggggtttaagtgcatcttcatccctctgcctagaggggtgtcaaaacgtacaaggcgcataatcttggaatattcttccatcaaccataccctctagaagctcatctaagaataatcaaccttctttgagcgcgggaggacaagacctcagaaactaccgggaagttgggcgtgctccatagccagctatgaggcagcacgcctcgccataaatgaaacaggtttatggggggatcctcggccagtctggagttgaaagggcatggacaagacgccaacgctaagttactttggacagtggcgcttgggacacgcgtcgcacatgccccgcgccacctgatttagccaaacgggcagagaagcaaccgtggcattgtttcgggtaggtcgggccttatcgggcccaccacgcaccacgtggtgaacacactggcggaggcccaaccatctaagacggagcccggagcccggggtaatatgaactgtaagacttgaagggtttcttgagaactgcgttagggaagcagccaacaacaacaagacggctgattagacaagactaagagtagatttctaatgatgcgagcccctccttagactataaaaggaaggggactagatacggatgaagggttgcattcttctaggtcagaactattgctttgtagcctaaaaatgcttcctttgtacttagctgatctagagaagacaatgaacaccaacacatgactagggtattacacctccgggtggcttgaacctgtataacctcctgcctctctcttctcgtgaggcggttgggccccacgaatccatcacgatcgcagataccgcgcacctcatgccgactaacccccagtcgaatcttcactctcggggattccccgctgtccgagggactgccccctcgacagttacctcttaatttagtggtgtacgtcatatatgaaactaggtgattccccacgttttgttgcagaatttcctaactaacttataataactttttaataatagagctaaaagtaaaaaatatattagttattaacaacaaatacaactggtttgtcaaactatgttcaaagaaaaatacattgtagatgaaatatgatatcccacactttgattatatggataaatatttattaagtattataaaaatgatcgatatatatatgttaaaaatattgtgtgaaggaagatgattggatgctgatttatagatgatgttaaatgcttgcataaattttgtatataattattgcttgtggatgatgcggtggcatgtttgtatattgagctttataattaatgggttacaactctataagataggattagatgcgatagtcacgtcttctataaaacttgtcataaaaagaacacatccagttgtaattttttctctacctttaattagctttgccataaacgacgtgggagtattattattcaacgctgagtcaaactaatgaagtgagctcccataaccacaaccacagaagaagagccccccccccccccgtttcctttttctcggacacggcgaccacctgacgacgcctactatttccgcgtcgcgtcgtcggcccgtctccgtctccgtctccctccccccgcatccccgggcggaggaggccaccccaccgccaccccgttcctttcccccccttcttcccttcctccctcccttcccccaccttttccgctcccccaattaacctcaagctcacccgcggaggcggaggcggagccggaggaggaggagggaagggccggtggcataaggcagcagcgattcttgccgccgccgccgcccgccgccgcactcccacgatggaccgcccgcccgcgccagcgccagcggtggcgctgctcctcgtcgtcgtcgtcgtcgcggcggcggtaatgctggcggcggtggagggagcgggggcggaagcaacaggggtgttccacgtgcgccgcagcctccccgccggtggtgcgggggcggcggcggaggcgtaccgagcgcacgacgggagccgcagggggaggctcctcgctgccgccgacatccccctcggcggcctcggcctccccaccgacaccgggtacgcggcgccacctccctccccttcgcttggcctctgctgctgccgtgcttgcttgcttgcttggctgatttggtgctctctcgtctcgccgcaggctgtactacacggagatcgggatcgggacgccgaccaagcggtactacgtgcaggtggacaccggcagcgacatcctctgggtgaactgcatctcctgcgatcgatgcccacgcaagagcggcctcggggtaacacaccatctcgttttcttttcttcttcttttagatttttggattctctcaactgtgggcaaaaccgtgcgttgcgtgcagctagagctgacgctgtatgaccccaaggactcgtctactgggagcaaggtttcgtgcgatcaggggttctgcgccgccacctacgggggcttgctgcccgggtgcaccaccagcttgccctgtgagtacagcgtcacgtatggtgacggtagctccaccacagggtacttcgtgtccgacctcctgcagtttgatcaggtgtccggggatgggcagacacgacccgccaactccaccgtcacatttgggtcagtcgtgctctgtccctgtcttaccgctgtttttgtatgagctaccttcgaatgatctactgttacacttagtattgtttcttagaaatgacatcacgttatgaaatctgcatgtgaattccagatagcttatgtctgtcacacgatgtataatgaaacttccctatagttaaggaaaaaaaaaccatgaaactgtttcaattcatcgggtggcaatgcctctggcctctaggtagaatttgtatgtagtaatgttttgttggaaaatgcttacatgattcctcccatgtgccagaggttgcgaatattttcctaactattttgtggctatgttttgttttatataaggtgactaagactcaatagccatgttctttgaagaggggtttttttattgcataatctgccattaagaaaggcatcaaatattgtcttggtgtaaaaaatattcattacatgctcttatgaagaatgtggcaatggagtaagcaaaattaacaattaacatggatgcatgacagtaacagaagtgtacagcaatgtggaatttagtaatcaatttagttatatgtgttgaagatgccaatgcaaataaatgcactcctgtcctttgtaggtgtggttctcagcaaggtggggatttaggcagttcaaaccaagcccttgatggaattatagggttcggtcaatcaaatacgtcaatgctatcacagttatctgctgcagggaaggtgaagaagatatttgctcattgtttggatactataaacggcggtggaattttcgctattggaaatgtggtgcaaccaaaagtcaaaacaacaccattggtgcccaatatgtatgtcaacgttgtaccaacacctcattattctgtttgctttttgctcatagtgaaatttcttaagctactttaaatataaatttttgactctatttgaacaattagttagcgaaacatggttttggagatttatcacagttcagtattagctattaagagacatattatatattttaggagattcatcacatcatgtttcaaaccctcaaaaggacatagaaatgtgatatttccctctgcatcattgcattatcttcttatcaaggacgcatggtccaaatctgatgcactatgtgaaacataattgtcctaattaaacgctctactttttgttcatccgtaactgcaatgtagcgtgagctgtccaattagttgaggttttctaaagtcaagcattcaaggttttttgagaaacgctcaggggtcttccggctagctccacaaggtggtgggctagacgacatgggttcgaagcctcaccccttctaattatttaatattaggtccttccctaatnnnnnnnnnnnnnnnnnnnnnnnnnnnnnnnnnnnnnnnnnnnnnnnnnnnnnnnnnnnnnn

SEQ ID NO: 14490 - DNA, 3284 bp, Oryza sativa
tattagctattaagagacatattatatattttaggagattcatcacatcatgtttcaaaccctcaaaaggacatagaaatgtgatatttccctctgcatcattgcattatcttcttatcaaggacgcatggtccaaatctgatgcactatgtgaaacataattgtcctaattaaacgctctactttttgttcatccgtaactgcaatgtagcgtgagctgtccaattagttgaggttttctaaagtcaagcattcaaggttttttgagaaacgctcaggggtcttccggctagctccacaaggtggtgggctagacgacatgggttcgaagcctcaccccttctaattatttaatattaggtccttccctaatattcgcgtcttttttttgggtcaaatttaatccagtgaaattaccatctgccttgaactattgagttgagcacttagggaatgaaactattcggaatatacgaataacagcttcaggaagagataatcgttagaggaattttgtatgctagctgaatgcctgtgctttgctacgaatagaaaatatattataatattgtgaaataaatattttttttccatgaaacgtgttacccatcctcctatgctatagggaatattcacctcactttgttttttatgtggctatccatttatggttgtgttttaatattgagaaattcaagggggtaatttgtaaaatttacaatggaagtagatggatggcagattcactgccaccaccactatcttcttttaaggtagtatatagattacctagtacaaatacctcacactggctgtcagcacagtgtagataacaggaacattgcatgctttattttgaaaaaaagtccattttactccgtcaaactatttcgttgaatcacttaacctataaactattttttggctcatcttccccctaaacttttaaaaatgcttcactttactgcttaatagcatttcccttctttgtttctctttgtactacttatattttaagctgaaattttttagagccatagatggctgtattatcaaagttccaaaatatttttaaattcttttcaagactgtttgcttgaagttaaaatctcaacatttaaattagtcttacatgccttcaatctatgtaaacagtgataaagaaaatcgaaaaaatattcataggtactccttccattccaaaatcagaaattccaaattgattatcatataaccatggtcccttcgtttgacgtgtagtatcattgcatttatgcatgcaaattgagtttgcatgcatgcaggtaggagggtagtaaaggtcccgtttcttgtgtatggtggaagttaaagtgtgcatgtttcttgatttttttctcgtaccacagtcacattaaatgaaatataagaaagttaatacttccttggtcttgatgaaaaaaacttatttgataattaatatggaatagagggagtaagttgtaatgcatctaacaacactaccaaatttcagtgcaaaatacaactttgagaaacaaaaaagagatactattagggagtaaggtgaaccgttttcaatagttcggggtgtaaaatgagctgaaaaatagtttaggggggttaagtgctccagtgaaatagttcgggggagtaaaattgattcttttcttttattattgtcatccctttcttttgactctggctcaaattgccatttccttttggaactgatgaacataccaaataactgtaaatcttgacatagatatcttcgaccttagatgtattgggttcatattttgtataatctctcgtactcatatgctgttagcatgattttcatttttatctgtaaaacttgatgtggaaaatgttgtgattctggtttataatatctactgctacaaatgttgagaagaaaatgatacatggtatgctgtagatgttgaagggatggaatcatgtgaaatttgtcgttgatttatttatctttgccgcagattgaaggatactattttggaattgcttgtcacctaactattttagctagaatttgttacttgatgtttttatggtggaaaggtggcttacctttgtagcatgcacatctcatgtgcagaataaatcaatgtgtggtgcagagatgtctttttgccagtatcctactctcttcttcatattttctcctggccagttcaacttaattctattgtctcatttatgaatctctaataacctctttccatggcagttactgatttttagggaatgtacacttttttggcagatagggtacatatgtacctgtgatatgtattgcatgtctgcaactggtttccttttgttccatttacaccattctaatacctatccatgattctactactcaggccacactacaatgtaaacctcaagtcaattgatgttggtggtactgcactaaagcttccgtcacatatgtttgatacaggcgaaaagaagggtaccataattgatagtggtacgaccttaacataccttccggagatagtttacaaggaaataatgcttgcggtatgaaatgagccctgcatttgttttcccatgttatggaggattgcatgcatgcgttctctttacatgttatatttctcaaccaatttcaggtatttgccaagcataaggatataaccttccataatgttcaagaattcctgtgtttccagtatgttgggaggtatactttacaacatactccatccgtttcgcaatgtaagactttctagtattgcctacatacatatagatgtaaatgaacctaaacacatacgtatgtctagattcattaacatctaaatgaatgtgggcaatgctagaaagtcttacattgtgaaacggaggaagtagtatctagctatattgttgagcagcaaaattgttccataatgttatgttcgtgactttcaaataagttgggagaagaatgaattatgagcccaactacaattttattcgttttttcttgaatacgcaggagtgcaattttatttgttacatttctaactatatatttttattcttctatgcagagtggatgatgactttccaaagatcactttccattttgagaatgatcttcctttgaatgtgtatccacacgattacttcttcgaaaatggggtaatgtaacatctcactccagtgatttggtcacctattggtatttctttgccaacttagttgttacaacttatgacacctataaggttataacatgttaaactggaatatgaaatggattcaga

SEQ ID NO: 14491 - DNA, 5292 bp, Oryza sativa
  unsure (1)..(5292): unsure at all n locations
tatttgcaattttgcacactatttaaagaggattaaatttggtttagtaccatctcaaccgctggtgagtcttaaaataccattgctaacatgaggggttttaaaatactataggtataaaattttggagggtggcattgccctaagctttgcagtccatggcaattgttaacatccaattaggacagagggatttcctgaaatgacgttatcactcctacatcctccttttcttcttctttgtaatttgtgtgatattgcacatgaccttaaaaagggggacatgtccatgcactacttacgtggtgaaagtggctatacatggttgaacccacatcttgctccctggtaaacaaaaaatgagggtagattggccattttacacattttcaacggaaaatggactgtgctggtgttttccaaatctgttcactttacaatggtattctgtagccactcttgtttacgattgtattttgcaacttgcaacaactgtgaaggcgatgacaatgttgcagattttcatatccaaattaattttaaactgtaaacctgtacaaaaacatggttcccttgcatactagttgcattgctgtttgcatctctgttacctttttcccaattagtaatagtcattcccttgcatatgtttattttattttatttattatcccttcccttcttttccaattgttcatgtttaatattggcattctctgttctataagatgcattcagccattctctatgacagaaatatttggatcagggttaagggaacttctgaataaccccttcgaaaccctcatatttgattagcttatacaccaatattcttatgattgcctccagttcttaccctagactcagatattccaaataaaattctaagttatataaaatacaaaaaaagagggtaaaattgcctttgacatggtctcgctgagaagctggaactgaccatattccagttttcccccagaaccaagattgcaaaatgtggaattttttgtctgtctcacaaaaggaatttgtttagttatttgaacatttcatactacattttaaaatagaccctccaaggagttaatttcaaaactgaacaattttgccggccacgccatgggtagtgccatcctgcaacatgcttattgttaccacaacattgttggtgacatgggcaaaccattgccacaacaacacatggtacagttttgctgtgccaacactgatggcatgggcaaaaaaaaaggttctgttatggaaatgacttttctaaggaattatttttaaaacattaataagaaaaggttcaaaaaataaaagaaaatccctacagaaattgctatgggttaacagcatagtactatagcattgcaactgttctcatgggtggcttatacagttgtttgcttcaggataagatagtagttttcttgttagtgaagcattagtttccttggaaatgattaaaatgttaggccaaagcctttgtaacaaaggagcagtatattaatttagatcaagcaaaattcaataaatgaagaatctagtgctcttctcgttaatcaaagagccatatgtattgacagtataggaaagagttccttgctagcctgagcttttgggcttttactaatacacacattataatagaattgttaacacttgtcgcacataaatatttcaagagagttggttctcactcacttgaatggactgacctttggatgcatgtttcgccaggatctgaacctgcgttcaaaggcagatgcattttcaatcccacctgagtcagaaatgccaaaatatgtaacattctaatgactgctgtgtcttgaaaaattgcactaattgtgtcgtaggatgcataaatcagactctaaagctctgttgttttgtccctcttcccaactccattccctcgttttccacgcgcacgattcctacactgttaaacagcgtgtttttttttaaaaaatatattctttttagataatggaattaaaaatccggcctttgcttcaacgaacctacagccaattattacaatattctctcaaaaagagcaaacactcaagcaacaaaaataacttaaaaaaataaagccaacacataaggagtaaacaatttctataggaaagttgtttaaaaaaatcatattaatccatttttcaaaaaaagctaatacttaattaattatatgctaatgagtcgctccactttacgtgcgtgagttattagttcccatcctcatatgccgaacgtagcctaaggctgtgttctttcccctcctttccctacttaccccctcgttttctgcacgcatgcttcccaaaccgctaaatggtgtgttttttgcaaaatttttctatacgaaggttgcttttagaaaaatgtattaattcatttttcaaaaaaaaggactaatacttaattaatcatgcgctaatgagtcgctccattctgcatgtcggagggattagttcccatctccaaccaacaaacgcagcctaaacctgccacattcagtggttcaaagtctaattgttccaatcaacgatcatgatagttaatttgaatttaatggagtactatagtttgaaatgatactataccgttgcattcagtcttgtagtagttgttatgttctgtatataacatcataatatgcaggttcacagatatatgttcatgacacttagatttgtgatttttttttttgtatttaagcaggataacttatattgtgttggattccaaaatggtggattacaatcaaaggatgggaagggtatggtgcttttgggaggtttgtcttgctcagcacatgcaaatcctttactcaatgttatatatctgatgtttttttagaactgttatatatatgatgttcgtgctattacctgttttttttccagatctggtcctttcaaataagttagttgtctatgacctggaaaatcaagtcattggctggactgagtacaactgtaagtttaacacattcaaatttgattgttatgagttcattccatagtactttacatgtttagtctattgttcttgctaatgtcttgacaatccgaaaatatatggcaccaaagttggattgagtttcacttcataaggaaaatgggacgctggaaccatgttatactaagcgttgttcagtaaaagagctttgcatgttgcacgcattgcgtgctccaagttctgaacatcttagtcatgggatggaatatgcaacttttagctacaaacatattctgggatggatgaagtacctaacttgtgtgtcataattggcttgtccgctctttgcaggttcctctagcattaaaattaaggatgaacagacaggggcaacatacactgttgacgctcacaacatctcctcaggatggaggtttcattggcagaagcatttggctgtgttgctggtaacaatggtgtacagctatctaatattctaactccggtgtatgtctcgactctagtggaaattcatttgatttaaattcttttcaccaaagagggaaaaagggtaggggtgtttagatggtgttctctgaccactcgagagaactgaaaaggaaacattgtacgctacacaatgtacccgagtgtgtagtgtaatgtaatgtaatgatgtggtgactggtgagaaaatactatggctgaatgtgcttttgggaggttctaggaatgatatcaggcccccatcttttgaatatactctgataatatgccgtacagcatattaaggaaaaaaataatttatatttttttagataatgataatttatatgtaaaacttttataaacttgtacatagcgatttaaaagctaactagcaataattaaatctaactagcaataatcacgagctatgctgcgcgcgtgcataagagactaactatatttgatagccagctagtattttttgtcacgaatatctataatcacacatatttcggtactgagcaaaccaaattttgttcaaattgtaataacataatgcgctaaaagatcaagttaatgtacaatgaggccttgtaataattagaaaacatctattagctagtagatctctatacgggcataaccccacagattgcacttaatgggcacgccaacaacaaaccatctattagatgaactttcatacatgcatatctccacatatatggaatctgatggcatgttaacgctagttctctaaacacttggtaaaactgtctgtacatccgacccttaatttgttctgcaatctttactatccattatttgtgctgcttttgggtacctaattaccaacaaagaatgatgtcagtcccagaacacaaggaaactaaataaaatacatctattggtatcatctatacgaagaaggggaaccaagaagtaaaactggatgtagtagaagtgcataatataaccaatataaggtagaaaaaaagaacatttatgggtcctcagacaactttgatgattataatagttgagaaaagtatgcatttgactaatcactaattattgaaacatatgactctactatatgcattcctaaagaggtaaactatatccaaattcccaaaaatcttggtaaacatgaatcagagaccatgccggatgacaattttagccctgtatgtatgccattcataaggcatagctgagaaaagtatgaccatcttcattgcaacatattcagatcatgtcttgagaaaattaaaataaactaagaaaatgagttaatatcgatgatcaatagtctattaactttatcttgttacctggtttatgatttagctcagaacccatcacattatctcaacagcaaaataagttgatcaatatactccatgttcatgcttttcaacttttcgttagcggcatgaaatttcgataataagtttagaactaatacatcatgtggagaagcatcattgatgcaaaagaatacaaatgtgcttaattatggcgaatcatgtgtagaagacaaatttatattgaatgtttttttttcaaaagaaaaggaataatatatgtgaccacgtttaatacttactgataaactgagcataccaatttataagaataaaagtacctgtggggtaatgaagtcattgatctaacggtaaaaatgaatggcattgatctgttggggtgacttcgatgtctcttatcctgtcattgaaagaaaaccatgctatagaatcagtagcaccatttttaagattagggtcagatatnnnnnnnnnnnnnnnnnnnnnnnnnnnnnnnnnn

SEQ ID NO: 14492 - DNA, 2891 bp, Oryza sativa
acccatcacattatctcaacagcaaaataagttgatcaatatactccatgttcatgcttttcaacttttcgttagcggcatgaaatttcgataataagtttagaactaatacatcatgtggagaagcatcattgatgcaaaagaatacaaatgtgcttaattatggcgaatcatgtgtagaagacaaatttatattgaatgtttttttttcaaaagaaaaggaataatatatgtgaccacgtttaatacttactgataaactgagcataccaatttataagaataaaagtacctgtggggtaatgaagtcattgatctaacggtaaaaatgaatggcattgatctgttggggtgacttcgatgtctcttatcctgtcattgaaagaaaaccatgctatagaatcagtagcaccatttttaagattaggatcatatatagaaaacaatatgatagcagaagaaaatatgtaaaattattttagagcttgaattgatttagtaaagaagtacacctatattagtccgttagtccgttaaagctctgaccatattcaaactaaatacatcgatttctagctagatgcagcataccttgggattatgtattgacttacagacacactgctggactattgtagttatcataatatgattcaatgagctatggagcttgttacagatttttcagctaaaaaaaccagcatggggatgataatatatgattaccccttaagcataggccaattgtttgtcttcattgctagtcgatgagagcatgagtttcgaagtagaaggggaaaagggaggagggcagcaaatcagctgaacatgattataggagaaggtaacaaagaagcatgtcatttctaatttgcattctagcgggaaaggaaaaaaagaatataaatcatatatttgatccggcaaagacataaaccacttggctattcaaatacagaccaccagggctgtaaggcaacaatctcatctaatcctgttctagaatatgcaactgtatttcagatttgtaaccttggatgtaaaaagggtactgacctacactctcattcaaaaaagggacccagtgatcaccattgtagataaactgggcttgagctaacaataagtatttgcctacttcgtagaacaataatctgaagtctataaccatcctttagagtttagacatgcaaacaaaaactgcagcataagagcaagaacaatcacctttaatgacataacagtatatgggcaaggaagaccacatacatattaattgtagcattcgtcataaagcagtggtcacacataacagcttagatatttaagtattggaggtaatatgtttcaaaagcaatcaataagccaaggctagctagagataatttttagctgaaaataatatcaacatataaatctttgtagatcctaagtgagcacaaggtttactttttttttttcccaaatcgatgcatatggaaagctgggcttacactaaatgtttagcaatatacagagttatagaaacagttaggttgttagaggtagagctagagctaggtgaataaaaaatcagtaataaaagcaaaataattatcaagtgatcgattatgcttatcttttcaaaatgatatacaaatcctagactgaaagtctgaaatctgcatacaaactggtatatagtgtatacaacaaaaggggattttcgtgctcaccttgaggtcaggagtacacaggttagcattatgattaagggaaaaaataccatgaaaatgtcaacgatggtgaaaacacaaccttaggaagtaaaatatacaacaaattgagttttctatatcaacatgtaccaaaaatattgtcattgtcttataaaggggaaaagtagagacaacatatctgagatgcatataaatggcaaatcatctgagtggcagcgagagcaacctcgaacacgcttcttctctttgcacaacacctgaaagaaaaggtttcatcagcaaattggggtatatgctttcacaggaccatcgaccatcctggctcctctccttaggagaatagcagatcttgcctatctactggtactgattatagggaggagacaaacctgctatatatgctacggctagtgccggctggctgtacggtggtgtgaacttgccactgttggtatttcttaacgacattactagaaatataattcccagcaatggcgcagaaatactcctggtatattatggttacagagtttatccgtaagcgcacggatataccattgtagcatttcactcgagagtattgcaagagtatcatatttgtttaatcccgtaggaagattatagtagagagaaccgtgctaataatttatatgttgcttgtaataatcatagtctaagtagggattaatataatccaaagggtaggatgacacacaagcatagaactactcattctcatattaaactatctaagctaagtggaaagaaaatagaaaagaatctattcctatacttctagtatacatattatacattcatcctagttatataattaactagctaataccctctttctgatgccctcatggtacttcaagaagccacccctgactgtcgagttccttacgacagcccgtcatgaccatacaaccggggctaaatacggaggagtaccctccctaagaaattaacttaggactatatatatgcgtgaaggaatacccatactgagctgtcaccatcaacgacccacctctcattcgtagcatataaccccaaataatgatacctagtaatctagacaccaggactaaactaccagatactactctaatatcatcgtcatgacatagagtaattgcaatagcaaacattatacccgtacctatgcat

SEQ ID NO: 14493 - DNA, 2806 bp, Oryza sativa
tcaaatgattttacaaagaaatccaagtcctcaaatgattcactcagtctctccaagtgtatcaatatgaattcctcacctttttgcccttttagattcctactctaaggtttgatatgtggagctcagtagggatcaaacatggcatacttgcattcacgtttattactaagtcaaaaacttagactaaaatagatgactaaacatacttaagatcaagatcgtgcaaagtgtgtgtgtgatatatggtggaaatgaaatgtgaagaaaaataaagaaaacgcttctcctttgtgcttactttcttctcccaaaaatccttctttttattaataaggagagggcatggctacattattatcttttttttcttttttttccaatatcatgctcatacttgagagagcataactttattattttcataaccatgcctttccctctttcctttttttttttcaaaaatgattttctttttaggagaagaaagcacataaaatcatggagaattcatttttagtggtagtatggaaatggaatggataattgctagctcccagtgtaggagtttagcatgtgcatatatgtgggtgtatgatcttgatcatagagcatgagaagtatctacacagttcacaagaatttgacaaagttcaatagaattgcaagtaaccaaaacatatatggtttaatcaacatggaatatttttggctctggtaggaatttatatcaaatgaggaacttcaatataggttaaacttcaatgtgggtgtattttgggtggatactgcccaaaaattttgttaaactttcattcatattttcatcacatatatgttagccttgtcaaacatctatcaaattgaagtccattttgcaaactgaaatcaaatttgacaaaaaaaaatctaacaaacctaggtcaaatttcacgaaaatatgataaatttaagtcaaacttgtcacaaatcggtgaaacctaaaataagtgcacaaatttatcattgttctttctcaatatttcaccatacgtaactatgccaaactaactaaaagcttggtaaaatgagtaagggcagaagggacattttatactccagttaacacatttacgtacccttaacgtaatagggtcagactgtgtcttcaattttgaaaaaaagatcaaatgagtaaagttgacagaagagggtcaaattagtagttagcttagtctagagcgtggtcaacgagaggaccacaaagctaagaaactaaatccaatccagcccacttgcttcccctttcctcctaccttgtggcccatgtgtaaactagggaaaaagcccatgtgattatttgcatttatgttggctgaaaacaggggcgaagccaaggggggagggaggaggcctggcctcccccaacgacagaatgaatactaattaatgaatctcccttcacctgtacactactagtgctagtgtgctacatacagcactgttatacgtacgattgtttttgtatgacgtttatacgatgaaacgtttctctccttactcctaacgttttttagcgatgaaacggatccctcccctgttgagtccatatccaaagcccaagctctaatgcgctggtctgctctctcgttggcatgcttgcatagccaaccaaagcaatcttctttctatctaattatatattaagcaattttcgtcctaattatatcttatatggtaattgtacttagcgctcctttattatgtggcaggtgaagcaaattactcatacatatatgttccttgcaccttggacagggatagcatcaaccatagttgaaagtagattctaatggccaaaattagaattggatgcagaaaaagttcatatatatatgaaccaatgtcaaacaaggtttgcatatgtttagatacagagagagttcctagagacaaacttaaagccaaagtatagtgctgctcagcacattaattgatgtcacatggtgatgaagcagaacttgtttcaaacattccactcttttagtcatgaggtagaaggcccaaaatatcttctattccctttagattagacagtaaatttagttagattaaatactacctggtagattattctaatataatctcaaagtatagatataatctcatgtcagatgctgcaaaaggttaattgggctttcgggcccataagcgatcctgccgcgtgtgcgtgcgccgcgcgctcgcgttaggttcccctgccgtccgcgccgttacgtttgatcgtacaaaaattggaagataaaaatcgtatgcgtagcattttccgtgctacatatcagtaataatcaagtttaagtccttaggtgactaatatttaagctgtataatttattatggtgtagtgttcaatcataaattaaacctcaattcccgtagtgtaatttaccaatccatttcaatttttaaatttctataatattaactaatatttgcaagatagggagtttgttgcttcttttgacaagatctaggtttatttttattatttatcagatagacttttagcttggatgatattatctctgcttataatcatactgcttagtcctcatatggctaaattaaaatttagagtaaatttcactttggacctgttttattgaccaaagtttcaccatgaactatgtctaactctaccttttcagttaacaccaggtattatgattaccttcttttgcaatttggacccgggttttaagacttcggccacttgatccgagcctagtgaactaagttcagggaagagaaatattcgatggaaact

SEQ ID NO: 14494 - DNA, 5172 bp, Oryza sativa
  unsure (1)..(5172): unsure at all n locations
ggcagaatggaggccaaaagcctcagcaagttagagtagtaggatttattagctctgtgtactgtagataagtaccactaaagagaaggcactgggaagggaaattatcacaagtgccatgttgtaccgataattcattgtgcctcaccatcaggtacatgtacatatggaacttggaacctctttgcttgtttttagtggcaaaatggacagctccatcttacttgcacactcattcagaaacaaacattgattcattccgccagcactacaccggagctgaagagcgcgccgccatgccaattcggagccggaaaagagcacgccgncgncacgccatgccgctccggagacgcggccacgagccgccggtggcaagggtggaggccgaggcgttgagcaagttcaccttcaccttcacctccacctccacgacactatcttcttcctttcccgcgcgctagtctccctcgataactctctgccctgaactgagttcaccagctcaagccaacgtggtggcccaaaagtattgatacccggtccaaactgtataagaaggtaatcatacttggtgctaactgaaaaggtagagttagacctggttcatggtgaaactttggccaaaaaatcaggcccaaagtgaaatttactctaaaataaataaatgcatgaagtaatgctacctatccatcttttatattatcatgtgttgttttttacaataatatgatttattacttgtggaaagagttaaaaatttacgtatatttgttacactattttttatgatcataatcacttgttaagctggccccctcgtgttaaaattctggcttcgccgttgcctaaaaattttatacatgaaaactctctatatataaagttatatatataaactttatatatgaaaacttaataaatagaaacattaggtatataaactttatgcataaaaacagttcgaccatctgcatgggagggagagagagaagagctctcagcaacggctagacacgagtagtggatgtcgatgatggacgtctcgttatctcaatcggcatgtggaaaacaacaacaaaatgccaggaaatcaaatagcggtcagaaattaataatcaatctaataaaaattaaattggaactgccaacccgaatagtgcggcgtggcttggatcgtgagtgatggccggtgacacgccgtgtgcgtcgatcagcttggctggggcgattcaaaaaaattaaccaccaccgcatgtgtgtatctgcccctataggcgatggctatcttgatgccgtcatcagcagtagccggcggatctcatcatcagctgaattggatcttggagcgaagacggtgccgacgactcctgagattagttccatcgcacttgtcgatgggaaactcaacacagcctctacctgacacgtcaactgtagaaactggaattcggcaatatgaaaaggggtagcgcacaagacctaaaagtggatggatgcggagacaatgatttaaacatgtttataccctctcattgagaggtattgatctgacgatcgggttgtgaataccccctaaggggcgtcctgccctccttatataggtgaaggagcagtcttataagatagaaacttattcacttacggtttaagtttcctatatctaatccacaaacttaacaaactaggattacaagtcatttcttgatacacaagaaaacataatacccaagtcctagtcttgtacgtattctatatacattatctatcccctgtaaccagttggatagcccagccgagtgaatatgtggtaaccataatctccaaaaaaaatgaaatgtagttttgatcttgattcattccctagggccaaaggccttaatatgtagcttacaattcaggcgattacatccagctgtacaggtaaaagtaagaagaaataatggaaacaatgagctgcatgatttcagctgaaaataacaacaggtaatcactacagttgtcctggtgtagtgacctccgcctgatctccttcgcttttctctccatcgttgatagtcgtctgatcctcataagtgtacccatcaaatcgttatcccagctgaagcttcctctgcttcccatctataacttcagtcctaagtctgaactccatttcagttcacagctcctgacaatacccttccctcgcaagaaccttgtcctcaaggttcaaaagtaggaaatgctgcttggatgtatgaggtagcctcagcaagagttaaattctgcttaagaattaaccattgtgttactgaagcatcattcctgggaaccgagcttcttttataaccatcctatgacaattgtgaagtcggttggttaacacccctaaccattattggcattgaatgagaagttgccatctgaagggccaagatgagggggccaaaagaggtttggtcaactctctagtcccacctatcggccactccttcggctgggatactgactggagggccctctacatgttgcaccatggattgactcatttgtagtcggttttgattgacacgtggggcctccaatcattgtgatctcttctgattggctggtagtgtgttcttcatatggtgggtggttgttggtatttcttacgaccagagataaatctgcaagtgcatgaaatactgctgtagcacttcaccttcgggtaaccccaaaaggatagcaaacttagggaacgtgtttaatctacctaaggctaagactatatccaaggactacaactattggtagctagctaggctagagaggactttctacatgttttagttatctaagctaagtaaaggtaattttctatccgttgctttgggcaccgaccgctgctggtctgccagcatggttccggctatagttgtatgatatatccgaacatggaggattactaggacgggattcagggctgtcaccccctaccggctacctcttacaaatccgtgggatacacaacaaacaaagataatctctaacctagacatcacgtctaagttattaattactaatctaagggcctgtttggcacagctccagctccagctccacctctcctggagctggagctcagccaaacagtttcagctccacctaaaatgggagcggagctgggtggagctctctcacagaatgaactagagaggtggagttgggtttaggcagctccacaactccactccagacccaacttctggagctaaatttaggagttggagctctaccaaacagactctaatactttcgcaggaactttcccctttatccagagtcttagtactagagcacttagtacaaatactaaacaatgaacccgcaaagatggaaatctatctcacttagactaagtaattaaataacaaaagaaatgatcccaaatgcttacttaagagaagaagtttctccgaatctagagcagagtgtaccgacagctccggtactcctccagaattcctcctagaaagctacacttaccgaggtagaagtcggagagagcaccaaacttccgggcactcctccggagcttttctcactctctacctattttctaatgtacaaaagatataatagagcctcttgtaatttacctcaaagttgtgtgtattggaatgagagcctctcctccttttataggctccaaatgacggttatggccatgaaaaatgaccaaaataccctccaacagtcattggggagtaatcagggccgtccacgtggacacagatggcgggaggcgctaggaatggtttggccaaacccaaaaatactcctcctggcctctccttcggctaggacgttgtttatttgggccccaacatcatgtactatgatttggcccaattctaagtggttttgattgacatataggcccttcaatctgtgtaaacgcgtcctgatggtgcggaggtgcattttgtcgcatgacgggtgtgttttctccttaaaacacctgcatagacatatttcaccaataatagtggaaatgattagtaataatccctatcactaagttggataccatattttatttcattatatgcaggtgttaacgatcagatattatgatttaaggaccgtcaacaacacccccacacttaacctttgctcgtcccgagtgaaggctatggactctacaataggttataacttcattactaataattatgcaaacaaactattcaaagccatacctgtacttgtgagtctttgtagtgtctaccatgcgatcctgggcaattgagaaatggaacaatcttgattcaagttactctaacttttcatgaagaacaacttgaggtttttcaagtaactcaaaattataactttgctttgcttctcaattaattctctcgatcattcaatgtgtatgattcctcacaaaggcttatgattgtgtcttttcattttctaccatctaataaggcttatgtggagctcagggtatggaaaagagtagagcattacttgcatcacatatattgcaaagtcaaataatggatccacggaaatacaagacataccttctagtcaagaatgtgcatgtgtatgtgtatgctaaatttgtgggtggaaaaaaggataatactactactaataataataactccttttgtatacctactcatcctttagcatggcaatcttttttttcttttctttctcttttttcccttttaatcatcatgatgctccatactcatgtgagcaacactttttatttctttctttttgcataggcatgcctctctctgtttttttgttgaaagaactttggagcaagagacataaatgacatgtagtatttattttatggactatggatgaaatgaatgaaaaatgagaaatattaacttccagtagaagtcaagcataggtgggtgtatgtgatcttgacaatgaaagtatgaaaagtatgtcacaagggttacaatatttgacaacgctcagtgtaataacaagcagcgtatgtagcaagctaataatgaatgatcaacctatatatatgtatatatatgtatatacatatatatatgtatatacatatatatatatatatatatatatatatatatatatatatatatatatatatatatatatatatatatatggggcaacatatcctatgcacacagg

SEQ ID NO: 14495 - DNA, 1932 bp, Oryza sativa
  unsure (1)..(1932): unsure at all n locations
nnnnnnnnnnnnnnnnnnnnnnnnnnnnnnnnnnnnnnnnnnnnnnnnnnnnnnnnagtattaaaggaaggaagcctgagacatgaataaatatgtcatatattatgtattaagttagtgatataaacttaggtatagatgtagataatgcctaattgatcgatttaatatatgatggacacttgacaaatatattatttattgtcagtatatatatacaggataaaaattccatccatacaaacaatatactccagatttggctagaaagaaagtagtatgtgataaatacgtgtatgtgatctaaagttagttgtactatgttatattttgatatgctccaagaacctaaacttctgtatacttatatgttcccgtgccaggtaatagtggcaaattaaatgatcaaatcatatggagtacataataaataaattaatgtgatgtattgtgacaattatagtttgtataattactagataacatgcacgaaaatcgggcacaagacttgtactaatttgattggaaatatatatcttcatatcaaaatggttttttgaagctactaggtgccgtgtggcaattattacaatatttgatactctaaaagaaaagaccaaactggattattaattgacagatggcttgcaatccttgcacgctttcaggggcgccggattcacctgatcttcagattgatccccatgagcctgaacgagcaacttgggaggatccactctaatcttgacatcagtgagtttatctgcgtctgtctcctgtgatcagcaaacaagggaaatgattatattggaggtcggaaaaaaaagaggtacggatcatgatgcatgaataaaattggaaaaaagaaacccaagaatcgttttgatccgattcatcatctattattttctgcgcattttggaggtattcattctcatcttgcaagccatagtgattgacaaaagccacccaagcattttcaaactcctgtgctgtgcatcctttatcaaggacagagggcatccaatactttgcaaaatcctgtgatgtgtgtgcttgaccaaccttgtcgacgtttgatcttacaattctagtatttgcatagtatgggcatcgtcggtgctaggatatacgcgagactgaggtaaaagagatggagacgaggatttttataaagattcgggcccctgaactgtcaggtaataaccctacatcctgttggccggagccggagttacttttattcaccataatcacaccagtacaatatgtgaggtagcctatctatctgttgtcgacatgccggtttaaaagtctgactcgtagtcgacaacaggggtaaccttgctcctcgagctcgcgcccgacgaaatcagagacagtgctagatccctacggacggcctctgaaggtaccggatagagttgatccaggcgtatctctgatgtcgatatccggcggcttgtcttggcgtatgttggcttgtatgctgtggcttctgttgttccgtatattgtggtaggtgtgttgattgtggtggtcgtcgattgtgttgtccgtgtcccctctcctcctagggggtcttgtatttatactcataggtgtctccttgtccaagtagaattagggtaaccaatatggatacaatctaagtagttcttgtcgtttccatgtagaactcgggttgtctttccttatccggaactcctcctatatccgcaggttgttttcgtataggacatggtatgtggtgggtcctgccgagatgtagtcgactactattaggtatgtggtatccataaccctgacaattattaattgacagatggcttgcaatccttgcacgctttcaggggcgccggattcacctgatcttcagattgatccccatgagcctgaacgagcaacttgggaggatccactctaatcttg

SEQ ID NO: 14496 - DNA, 2575 bp, Oryza sativa
catagtatgggcatcgtcggtgctaggatatacgcgagactgaggtaaaagagatggagacgaggatttttatacagattcgggcccctgaactgtcaggtaataaccctacatcctgttggccggagccggagttacttttattcaccataatcacaccagtacaatatgtgaggtagcctatctaactgttgtcgacatggcggtctgaagatttgtctcgtagtcgacaacagggtaaccttgctcctcgagctcgcgcccgacgaaatcagagacagtgttagatccctacggacggcctctgaaggtactggatagggttgatccaggcgtatctctgatgtcgatatccggcggcttgtcttggcgtatgttggcttgtatgctgtggcttctgttgttccgtatattgttgtaggtgtgttgattgtggtggtcgtcgattgtgttgtccgtgtcccctctcctcctagggggccatatatttatacctataggtgtctccttgtccaagtagaactagagaaaccaatatggatacaatccgagtagtccttgtcgtttccatgtagaactctggttgtcttttcttaatccggaactcttctatatccccaggtttgtttcgtataggacatggtatgtggtgggtcctgccgagatgtagtcgactactattaggtatgtggtatccataaccctgacaatagcccccgacttcaatgcaaatgaacaaattcatattctcgaccgctcactatagagtaactgttatcgagctcaagtgaccgttctcggtgagttcagagataatgttagacttcctttgtcagcctcgtgcgggcacctaaagggtttgtttgagtcaatctccgacgtcaaccaagaaagtacatagcgtacgactaagtctcccatcttgctgtaatcgagaatttggattaaagtcaagaaattttatctcggcgggtacaccatctcttcattccgtattccttgtcgagatccagcaaccgttctcgagcgatcgagaaggcgtagagtctgcgacggaaccttgtcaacattggtcgtactcgccttagtcgatcttggtgtagaaccatagagacatggagccttcgtcaatgtcgaataggattttcctgaaatcaatactcagaaaagaatattagatagaaatagcccccgagcgaatgcccaaagggtgacatgttataatatatatggtaaattgaaaatgaattaaatttatcaaccaatgttttgtgtatgagcgtcttccctcttaccgacttcgatcagtcagtttgtagagttatatactctccctagcccccagccttgtcgtcggagaatcgttctcggaggagaaggctcttggacctttgacctgccttggttgaacaagcactgatcctagcccccagccatgaagttggaaaactcaatttccgattacacgacttggttaatacgcacggcgagaactcttacacgactagatcttacatggtcttttgtctctacaggatccgacaaggccttatcggctctgggcgtccccagccgaagttcccttaagttcctcggaggccttgtcaagacggcgtaaagggacagtaggataggtttcaacgctaggtgtcgtcatggtaagggatctctgggtaaaacatttggcgatagtgtgtacctgatatcaactttgttgaagtagaggtagtaggagaattgctacaccgctggtcgaggaccaggtagtagtcgtaactcgaccactagaagtggaaatagtgggagaatcgctacaccgctggtcgagaaccaggaagtagtcataactcgaccactagaagtggaagtagtgggagaaacgctacatcgctggtcgaggaccaggaagtagttgtaactcgaccacttaaagtggaagtagtgggagaaacgctacatcgctggtcgaggaccatgcagtagtcgtaactcgaccacttaaagtggaagtagggggagaaacgctacatcgctggtcgaggaccaggcagtagtcgtaactcgaccacttaaagtgaaagtagtggaagagacgctacatcgctggtcgaggaccaggcagtagtcgtaactcgaccacttaaagtggaagtagtgggagaaacgctacatcgctggtcgaggagcaggcagtagttgtaacttgaacacttaaagtgaggcgagagagatcactacgttttactggttcgagaaccaggagtaggagtcttttaatcacctataggggcgctaaagttggtttattacatgtgcatatcatgtggccagcatgactcacatacccaacttacagcatatccggatgtccgttcgcaatcatgtcgggtgatcaagccgacggcgttcgcgaggaattatccgttaacaaccttttctcgagtagtccagcgatggccggtgctatgagataggtcgtcggtcttcgttggcaggttgggtgcgataacttcgcatttgtcgagaatgttctcgataatggagtgtactcgaccataacctaatcgagtgctca

SEQ ID NO: 14497 - DNA, 13815 bp, Oryza sativa
gatatatgccggatatatctaccaaattagtagatcaattaaattaattaatctactaattaccttgtttgtcatgccgtgcgtccttagtagagattcatgcctgcggtagattaggacgtggattaatatatcaccaggatcatgctgactgtgtacgggttggacacggtgccgagttcggcctggattggccgcaccagccgatgtcgcgggcggagggcctgatcagtagctcaaaccgatcccacatgccgtcatcattggggtgactctccacggcgacgatttcctgaagcttggtcgatcttatgagatcgaattgttgatgatgatgatttcgatctcatcgagggacatactccggtccggttagatctcctatagccgaagttgtcgagtagtatgttgtcggagaatccatctcttgaacccatctcgtcgaaatcctgaagcaccaaaatccccctacctggcgcgccactgtcgacgtttgatgtcgcaattctggtatttgcatagtatggggatcgtcggtgctaggatatacgcgagactgaggtaaaagagatggagacgaggatttttatacaggttcgggcccctgaactgtcaggtaataaccctacatcctgttggccggagccggagttgcttttattcaccataatcacaccagtactatatgtgggtagcctatctaactgttgtcgacatggcggtttgaaggtctgactcgtagtcgacaacagggtaaccttgctcctcgagctcgcgcccgacgaaatcagagacagtgctagatccctacggacggcctctgaaggtaccggatagagttgatccaggcgtatctctgatgtcgatatccggcggcttgtcttggcgtatgttggcttgtatgctgtggcttctgttgttccgtatattgtggtaggtgtgttgattgtggtggtcgtcgattgtgttgtccgtgtcccctctcctcctagggggtcttgtatttatactcataggtgtctccttgtccaagtagaattagggtaaccaatatggatacaatctaagtagttcttgtcgtttccatgtagaactcgggttgtctttccttatccggaactcctcctatatccgcaggttgttttcgtataggacatggtatgtggtgggtcctgccgagatgtagtcgactactattaggtatgtggtatccataaccctgacaattattaattgacagatggcttgcaatccttgcacgctttcaggggcgccggattcacctgatcttcagattgatccccatgagcctgaacgagcaacttgggaggatccactctaatcttgacatcagtgagtttatctgcgtctgtctcctgtgatcagcaaacaagggaaatgattatattggaggtcggaaaaaaaaaagaggtacggatcatgatgcatgaataaaattggaaaaaaaaaaaacccaagaatcgttttgatccgattcatcatctattattttctgcgcattttggaggtattcattctcatcttgcaagccatagtgattgacaaaagccacccaagcattttcaaactcctgtgctgtgcatcctttatcaaggacagagggcatccaatactttgcaaaatcctgtgatgtgtgtgcttgaccaaccttgagttcatctgatcgcatgtacgcagagtgcacatttgcttggactgaactgaaagtgtgccaacgacaacgttcgtcgctatacttccacaatccctgcttgatctcctggcttcgagctgcagtgttcatcttgtccatatgatctgtctgcatgaacataaatagaggaatatattgagtagtaccccagtagcgttgaacacatatcagaaaaacatggatagatggagcacatacctgaacgtcgtcgccgataagattcaacagtaggaactgaaaagccgaaattcttgttggtgacaaaaaccagaggatagaacgtatgagaagaacaaagtcatccggccctgatatttattgtcacctgtagtggcggccttgagttggtagggcggcaaaaattgaaaggaatcaccatgtataaagattgtatttatggatatagatacagctatgaaagtggtacctttcagaatatcatttcttaccatttatatgaatatctccattaagacctggatactgattgcataaatcagtatacagctggtgattttgtttcgtaaatcacatatacatctgatggacaataaaagagaatgaaatccatttcgatctatttcatgccaatttattattctactccaataacaaaattcgaatgttgcacatatacctgacgtatcagtatgataccatgggatgaatacctactgtctcagccatactatttgttaccttgttcctttgttagcttggggttataacatgattagatgttgggttagggattgcttagccatgcttagctcaactagcacataataggggaactacattaatgcatagatttcagattctagattggtgttggactataaccaccgctctggtgttggttaactaaaatatactaaatggtgcgctgtgggtgcatggttttgatggtcgcacccatggaaattaaggaccggttcgtgggatgtcctggaaaaacttaccatacttaccacaaaccagcatgggcaacggctgggcttgtagtgtagctttcctctagctgacgcatccaggcaagggtgagcgtgatggagttcggatgggccctgcgatagcctgtgcggctttcagattcacctaggcacgaaaggggactgcccgatgccttgcgaggagtgggggtgaaacctgaggtgtggtgtgtttggttagaggaggttatgcgaagggtcctgtcacggcctctttccggtatgttgtggtggcatgccggcgcacggaaacatgtcgtggggctgtgtcttttgggtacagttgtccatctctgatcagagtaaaactattcgaatagccgtgcccgtggttatgggcggtcaaccagattcaccgtgattagtctcaccctagcttagtctaatggaattgattagttcaggtggttggttgggcctgttgcaatgcggtgtagcgttggacaatggatggttaatattgattaattattacaactgttttactattttcaactactgtttataaatgctagctttatgcaaatgatcccctttagccttcctttggttatatattgcatcataccctccgttccggtatgacttgttgagtacagtgggtagtactcagtcttgctctatctcccaaccctcagagttcgagtatgcgttagtggtggtttctcagaggagtaggcttcgtccgtgccgtcgaggatgcctatggagtggtgttcccgctgcaatccaagtcaaggcttagctccagttatctttaattttccgctttatttatgtaagacttttattatgtttgtaagacgtggatctgtatgtcaactttgttgtttgtgtaccttggccggtcctggacaggggttataatgcacattctgcttggaattctattcgagaatttctgggcgtgacaagttggtatcagagccgaccttggccgtaggacaagccaaatagaaaccctaagagccaaattgtatttgtttcgggaaaaatttgggtttgttccttgggtccatgggaaaaatcttgatcgctccttcaattgaaatttgttcaaatgaggtcagtctagggttttagtaaaattatttgagaattatttgacagtcagtcgggatttaatgggaggtatgcattaggtcttcactaaggaacatgggttgcaagttatttatgctcttattatcattgttattattattacgtatctaattcctcattatcttattgtaatgtatgtcagtcttatttattcgctctcatgcaaaaatgatctatgcacaaaattctgctcttattcgcttactttatttcagtcctttactgtttattttataattggatttgatcatacattgattctccatcctttgtcttctatagatggccgactgtcccctaaagcaccaaggtcagactatgggaggcttcgttgcagagttgtcccgcatggcgtttgtgattggttttccaagggagctgcagtacaccagcatccaccctcttagtggcgagttcccacgtcaggtccgcttggagattcacggcatacactcctacctgcacaacatggaggtgacagcttgtgggggcacatttgagcatgcttgtgaggaggcctccctcaagatgatggcccatttgagggagcggcatgacggcaccctgaacaccaccgcctaccgcttccaccctcgccgcggttccagctccaacaccagcaccttcaagtcagcttggggagagaacgacgtcaccttcggccacatgagtgaggtgatggagggctacgacaagctgcacgccatgctccacaaggcaaccaagaggctcaacgaccagaagcttgtgaggatcgctgagttgcaggatgagaacggtcgcctcaagaaggaggtagccaggctgcacggatgctcaccgccaggaggagcccgcatccgcaccatgccaaggaagtcgaccatagctccagtgcgcattcagcttgcgcccaggaacccgccaccacctccacctccagcacctcccgcagctccggcgccagctccagctcctgctcccgtgccagctccagcatccgccctctccttcgtgccagcttcagcctacaggggtccagcaggtggcagtggaggatggctgccagcttctcccagtggtggtcgtgtgatcatcagcagttccagctctgaggcaggcagcggcgacacctaccagctatatatgctgattttctttctacagaagtatatactggactctgtatgtactgcttttttctatggagtgctaatatgctgaatttttctatggtcgggtatatactgaactttgttacacaaaagtatatactgcattttccatagatatgctagattttttcaatagagcggcacatactgtcttttctaacaacgaaagagtagtaacatacttaaaaaaaaagaatagtatgtatccccccccaaaaaaaaaaaagaaaagaacagtatatactccgacaaaaaaaatcagtatacactacaaatttagaaaaatggtatatactataaatctagaacaagtggtctctcctaatactctagaaataacggtatatatatactactagtttctgcctctctgctttccatctcgtattacatgtattgatgcgtcaaatattttcttattgatgttgatctaatattttaatattttcgtgtagaacggtcgccattaatttggagtgaggaaattcaaacaaagtactgtgttgaacgccttgaaacagaggaataggaaggtttgcttgttctgatcaactagtaatgccgagggagatcgaggtgtgacaccgtcgccgtccgccagggaatgtcatgggagagtgcggcgagatgtcgcccacctgcgcaagggatgggaacgctgccgatgagatttagtcgtcggcgtcggcgccgccgcctggacactagggtttttattttctactatttccttttgatatcgggaatgatggatttgtgcgatccgttcggtatggacgagtccatttattcaggataattaacaattacggaaattatttctttccacaaaaaccggaacgggttcgtgatgctgcgcctgttagcaggtatggggatactcatcatgcaggttgggatcaacggtggatgagagtaggagtacgtacacctgggagtatagaagcattttttttgaaacatatatatgcataatatatataaactattgttgacggtcattagcgatcagtttcgactgtcaatattactgagatagaggagaactagttatgcttgcattgcatatccatgttagaacaataatattccactagtatttggttcactaaccttttacagagaataatcataaagtggaagagaatcgacatcgaatcagacgataaatcaatcggacgatgtcgagaatcagacttgtatgaattggccaagaactcagaattgacacgatgaattaggccaaaattcacaagtttgcaatgagcaacagaacaggaggccacctgccgagtttgggccaggtgggcccagcccatggtttggccgaacctgccatggtgccgatggatgcagggtttgatggacggctgggattgatccccaatgtcggttggagggtattaccgaccattccaaccgtcataatcgtcattacctgcctataaaatgagctcactctcttcacttcaacatacacctcaagcaagagctctctcgtattctctcaagttagtttagtgttcttaagctagtggaataggaataaagtagaaatcggagtccggaagccttcggaagagttcgggtatggctctagtagctcttctcttctcttttgtaagttttttacttttattagaatactcttatttatacaattatggtatttgtcagggttgtggataccacatacctaatagtagttgactaaatctcggcaggacccaccacataccatgtcttatatggaaactgacctcggatatggagggagttccggataaggaaagacaactagagttctacatgtaaacgtcaaggactactcggattgtatccatattggttttcttagttctacttggacatggggacacctatgggtataaatataaggccccctaggaggagaggacacggaacaatagatcaagacacaagatcaacatacaagccaacatgcgccaagacaagacgccggatattgacttcaaagataagcatggctagtcccctacggtatctacggatactgtcaggagagacatagcgctgtctttgatctcgccggatgcggattcgaggaggaaggctaccctgttgtcgactacgagtcagcacttcagatcgccaagtcgacaacagttagataggctacctcaaatattatactggtgtgattatggtgcataagagcaacgaccggcttcagccaaccggagtagggttattacctgacaattcaggggcccgaacctgtataaaatcctcgcccccatctcttttacctcaatctcgcatatatcctagtaccaatgatccccatactatgcaaataccgtagtcgtgacatcaaacgtcgacagtattgaaatactttccgagtatatgaatgcgaattttacattatgttcgtgttatattgaatatactgctagcttatctgggagatgcgttggtacgggtataatgtttggttatgcaattactctatgtcatgaagatgatattagagtagtatctagtagtttaggcgtggtgtctagattacgggatattattatttacggttatatgctgcggatgagaggtgggccgatgatagtgatagctcagtacgggtattcctccgcgtgtatatatagtcctaagttaatttcccggggagggtactactccgcatttagccccggttgtatggtcatgacgggctgtcgtaaggaactcggcagtcaggggtggcttctcgaagtaccaggagggcatcggatagggggtattagctactatatcagataactaggatgtatatatactatgtatatttgaagtataggaatagattctctttctgttttcttcccacttagcttaaatattttagtatgagaatgagtagctccttgcttgtgtgtcactctaccctttggattttcttaacccctgcatagactatgattattacaagtaacatataaattattagtcaggttctctctactatgatttttccatgggattaaataaatacgatacccttggaatactctcgggtgaaatgctacaatgatatatctgtgtgcttgcggataaactctgtaaccataatataccaagagtatttttgcgccattgctaggaattatatttctagtaatgtcgttaagaaataccaacaacaatgcagcaacatggccatggaaataaaaaaaaatgaatcgatctttagtcccggttggtgttaccaaccgggactaaagatggctcaaccggccacgtggttgagcgatctttagtcccggactaaagatcgatctttacttccggttttttcacctcggactaaagatagcgatatttagttccggattggtgatcccagttggaaaaccgggactacatgggttacaaaccgggactaaagacggtttcttcaccagtgtagtggccagatttatatccattatctgaaaaaaacacacgtgcatttttctcaaccgcaaaaacccatgtagtttccagtttcctcgtactctctcccggcaataattggtgactgcttccacttttagctatttcctgttcacggttccccacatcttttgctagcatgcccctacccattcatattgaagctcatagaatagcccattgccagagatgaggaccagatgaggaaccaacaattaccatttaaaactccataaaatacaaaaagggaagggatagtacgcactttgctgaagagatggcagctcctttgttgttatcaacaatcattttggctctagtggtggtagcatcctctactcatggtaccatggccaatggggtattccaggtgcgccgcaaattccatatcgtggacggtgtgtacaaggggagcgacataggtgcattacaaacccatgatgagaaccgccatcgtcgccgtaaccttatggctgcagagctcccacttggtggcttcaacatcccatacggcactgggtatgcttcaatcatctctgcatttggtcatgtctgtgtttgcttggttggttggtttggttattagggttaaaaaatggatcttggcataggctatactacacggatatagggatcgggacacccgccgtgaagtactatgtgcagttggacaccggtagtaaggcattttgggttaatggcatctcctgcaagcaatgccctcacgagagcgacatattggtaggtttccttgtagtgtttctttagtttcagtcccttaatttgcttgcaaaattcttttgcaatttagggtttttattcattatagaagttgaaattctggattgtaatatgtttttgtttttgtcgtgggtacgtgtatttgcttgtgtgcagagaaagctgacattttatgaccctaggagctcagtaagttcaaaagaggtgaaatgtgacgatacaatatgcacttcgcgaccaccatgcaacatgaccttacgttgtccgtacatcacggggtacgctgatggtggcttaacaatgggcatccttttcactgatcttctgcactatcatcaactgtatgggaatgggcagactcagccaaccagcaccagtgtcacatttgggtgagttattaaagaaagagcactgctacacgtactatgtttttcttactaaatttttactaacaatcatctcaactgtttgattttgctaaatggaagttataaaaaatctagatacactcatagcatgacatatcaatgtattacaattcgtatgtgaaatttattgatttacaactgaagtgatctattgtaaaatgccattgataagcaatagttcaacaatatgttttccatacgtgcaatactctttcttttttaccatcacatcatggttaacctcaaattctgtctctagtttttacaaaatgaccaaaatatcattgagaacacacatatacccttgacagacttcttttattttttacagtgaccaaaacacctttgataactctgttaaaccctcgacagactttcgcgagtgcctgttgcagtttatggtgaaatgaactttccattagaggacaacaaaggccccttaatggttagttcacagcaatggagaaaaggtagaaaaataacatgtatgatggcataacatataactcatatttataaaatcgaaacacaataaccaaatctaccagagagttgtgaatggtacgaacaccaaaaaccaaaatggaataaaaataatcctctaaccttacagagtccacgatgaagtctggtgtgcaccggtctgaccgctctgatgctgtcggtctgaccggtgtagagtcgccggtccaatagccttgcttctccctttgcctgacactgctggtccaaccatctagaagtcacctgtgtgaccactgtgccgccgccggtcagacctcaaggatgctaccagtctaactaccgaaacaaagtaaaatacaaatcaaagaactctttagaagtaaatcaactttattgtttctaattgtgctcacaaagtgtaacaataacactcatttctcaacttttgactatactcaaaatttaggctaaacccttttttttttcaaaactgttatctcacagaatggtaccaagaggctcaacccctcttttatttataccttgaagtggctgcacaaagccacgaattcaacttggataagtagttctaatctcatagaaaacctacccgaacaagtatacaacttatcgctttacaaatcaaactccaatcttttcaaatttggattccttccaaatttgagtcatatttgttgatggcatttcatagagtcgagtggctgcatgttgatggcattttatagagtcgagcacttgcatgctgatggcacttacaatgttccttttcataccaaaggcattccattgcacaagtacacagtaggcaatcactgccggtctaacggttgctataggctagcagtgattaactatatataatgccggttcatgctggcttggatatttttttccctaccaacccatgtgtatgggctatgatagacctagcatctctgtcggttcagcaactggtagtgataggtgaggccaccactgctggatgacctcatctagttcaaaaactgatagtgatgcattagttatgaatcgatggtgatcggagtttccgtactggtattgttttattaaatctgaagcattattttactgcatcacatggcaacaattaaaccatacatatattttttgttcactattgtctataaggtgggtatgctgtattgattgtcttttattgtagatattctttttgagaagccatgctatataagtttgcccacttaggacctgcttgaaattgattattgactgtatttttttcatggattatctgctttgattatatggatagacaaaatattttcagaaatatattcaacagatagcttagaacaagtggtccaataagtatacatgcaatagaagaatgttcaattttagaggcgttgagcaaatccatggctataatccagcgaagtagcagaagagacatggcataagttaatgctcctgtggggggctaccattggatgttgcatcacacaacacactagttctttttcatatgaatggtattttattgcactagcacacatgagctaatcactaccacccatcactactggttgacatgcatagtgccaacaattattgactattaatgccatatcatgccagccgggttgggcatttaccaaatcctatgtgaattcactatgatagcctgagcatcgctgtcggttcggcccccggtagtgatagccgagatcactagtgtcggctggcctctgctggtttagaaattagcgtagatgccggtgatgggttttgtgtaagtatttttatttgcttttcatgtaaatctctgatgaactcatcacatgacaataaccggttatggcggttataggtatattttgatattttctatgccttgttctccataaggtgggcaggctgtattaattgtgttttattatagctgtgctatctaagaaggtgtgctatatatgttggcccactaaggccatgtttgaaacaaattattactagtttatttttgtggattacctacttgagaaacaatcttaacaaatggcttggaaagtaatctaacctatgcagtagaagaatattttttagcaaacatatttttagggacgtggagaaaatccgtgacaataattcgatgaaatggctcccctgtgcttctaggtgtggtttacaacaatctggaagtttaaacaattcagcagtagcgattgatggaattattggttttggcaattctaatcagactgcgctatcacaattggctgcagcagggaagacaaagaaaatattttctcattgccttgattccacaaatggaggtggaattttcgctataggagaagtggtggagccaaaagtaaaaacaacacctatagtaaagaataagtgagttaaccatgcactttattatgtttcttttatggtcacaatttaatttggctctactttaaatacatatatttttaccctggttatagcatcttccggtatacttgtttaagaagcatttatcaacccccctaaaataagatgcatttatccacttaaacatgaactgtgtcaagtggtacatctctggtacaaacgttgtgaaaaaaatgtatgtgttgttgttcttgagtgttcttattaggcacaatgtttcaaagttttgaatgcacatagctatgtgaaaatttatgttggctgtcttcaacatggactgaagggtgctcttaggctggaatcgcttgaaccttaaactataatttttaaaaaagctatttatatactttagtacatgatcttggctctccaccagtccctgttggatgttaggtttatgacaagtagggatatatgcatataatatcaatttgtattgtagtgcacgtatgccttcttacatgttgtaaccttttgagaatacatgtctttctgcgtgtaatccagactcgtggttccaacacaaagaccataaccaaccttgtttggttctattctcgtttccaccaaactaatgctattgtatccattttgaatctgtataataatcactggacccaaagcatggatttacaaatttgagggaatatgcatagttttttatagaaatacttatcatgtttatctgcatcttctgaaaattaaaagcaacaaggcatttggaacttttgagcccactcacacaccacgcacactaactcacatcaattcacgattctatcacatagtgaggtatatcaccttgtgaacctcaagtcgatcaatgttgctggcacaacacttcagcttcctgccaatatttttggaacgaccaaaacaaagggtacattcattgatagcggttcaaccttggtgtaccttccagagattatatattcagaactaatacttgcggtatggcaaaagtactgctattcttttctagtggtagaattgtttgcaattacgtttacatataactctcaaccaattgcaggtatttgccaagcatccggatataaccatgggtgctatgtataattttcaatgttttcattttcttggaaggtatactctataacacaaaatctagctatagtgcagagacattacattcaccaatggactaaataccagaagattcataggattcatattgagttctaattcaatcttttcaatgcctctgaattccgctttatccatcaaataaccccaatttgttggtactccgctaacattacccttgttttaatacccaa

SEQ ID NO: 14498 - DNA, 4887 bp, Oryza sativa
tacccttgttttaatacccaagtaccctatacatttgttgattgtgaggaaaaccagtaattctctaacaattcccattgggtcataacctaataaagaacgctgcctactcaaaccgaagctttgttatggacaattttaagtcttgaataatactctaaatgggtgaagttgcccaaattaccaaaaccttagagtaaaaataaaaataaaagaaacttttgcttttctatatgagtttcagacaaaatataaggtacgatggagaagcagtagtggaaattgttttcattatactatttactcggtaaaagacacataaactgctatttcatctgctacagcagcaaaacctatgtcaaaagtgcagtaagggtttatttagaggatttcctatttcttttcggattacttagactgctccatagttctgagggatggggtatattatatgcaacttagtcttcagatggtagaatataattattccattttactttgtgattattctaactatgttgttgttttcttgtgcagtgttgatgataaatttccaaagataactttccattttgagaatgatcttaccctggacgtgtatccatatgattaccttcttgaatatgaggtaacatgacatttcacccccatgctctaccaaagttggtataaaaatttgttcacaaattggtattgccttgtcttattacttctgacaacttaacacttcaaacttgtcacggccagaaaataccttttccgaatgctagtgtattaatccccgtcgtaggaaaatccggggacaccacaacagacttgatacaaaagacacatctttattaattatcacgatgatatttatattattacataggcacattaggcctatcaacaaaagaaaaacaacagcggactagaggacctatgactccatcttcacaagcgctcaacagtgctataagctaggactccacttaagacttcttcaaagcttctccgattagaggataaaagattaagaatgagtacaaccaccatacttagcaagccacaccaagaaatgcacacataatgcaaatgggtacaagcaataatgatacatgttgacttttgcttaaaacccatttttaaatagtttagttttaaaacacatttcaaagcatgatcctaatctagtcaatttttttagtcaagctgcacacttgcacgtacttgcgttaacccaggccatcaaattgcagttccaatcattccagtttaactaaataaaatctctaacttgggaacattgctaggcttgcccataaccgagggcttggctattcgaatagatgatattctgatcatccatgtccttttgtttctgaccatattaagctatgagttaagccttgcccactagacatgtggttgtaaggaatatgcattgtaacataggcccggggaccaatccttatatatgatggccaaggtgcgactaacagaaccaagcacattgagcccaacctaaaacaagtttgagaattatgaaaagaagtccaacatgtccaggctaacaagcctctaatccaccattaatcaagattatatggttattcccaaagtccagatcattagaaaataactatatgtttatgttagggcattgttaagcataatcctaaaatctctagtaaacaccgcacatagagttctcactagatagttttggttttctagggttgtcaaaggtaattactcaatattcaataaataaggccataacaaagaatataggaaaggctaagtaaaacagttataacgcgataaatttagtaaagcgaatgcaaaaatttaaattaaaatactttccgtaaattgggattcaataaggagagcgtgacttcccttgctcaacggaacaaacttccgagacttcagcaacgaacatgaactgcacgactggaatctccaaaatgacaacaactataggtgacccaaaacaaagccacaactctaagagagaaatgataacaagacataaaaacaacatacatgggtaatttaagttataacaaaagttcaactggtcaatttggagctcatttggccaagagaagacaatccaaaatttaactgtagtttaaatgaagatttctgaattgtttaattattattgttcccataaattatgtgtaacacaacatcgctcgaggagagaaaggatcgagcgactaacagccaggaccaacgggtcagacggctagttcaccgtggatcaggttcaccgagacgatgcacgggaatagagcacctacatgtaagcctcaaagaaaagactgaagagtggatcccacatgatgccaaacaagcagtcacgtgcgtctaaacgcagctacactttacgtcaaaaaaatgcagctacacgcggatggagacgacaactggtgactgcggcacatgactggtagtcacctaaggcaaggaaaataggagggaaagagcggaaaccggattctcaccacaaacatggcgacatccaaaatagcgaggagggaattgttggtgaggaagacaatggcgagcttgagcagtgacgacggcaactggtcaacgacgaggggacaatggagggattggtgctgcagacttgagggaggcggtggtgagtggtgacgtcgggaagcacttggacgaggaggggacagcggccagaggaagatagtggtgacgtcattcgggttgatggcgggggtgcgttccgatggtcttcacttgatgagaaggcacggttgaggaagaggacgatgagggaatcgaagaccgacattgaaggtagacaagttaacgcagtggggtggtgctctggcaaggctggagggactgccgaaggaggaagaagacggcgttcttctctgatcactagcaaggatgaacttccagcgatctccaggcaaaatggtggggttgctgagctataggaggttaatgcgtggccaggggtggcggcgccgaggtcttccatacgtggcttgggtgggtctacgggaaagggtggcaggagctcgccggtgcagtcgagatggcaggagagcaagagagctcgaggtggctgtgaaaatggatcgaagggaggaagacagcgccattttataggctgggagaggaagaaggggaacggtcgtgagaggagccacaggccattaacagcgactatgaattgggaggtttcaaatctgcgatataaagccaaattaataggggggaaaatatgacagaattggagagatgaaagtagggaaatgatttttgcaatcaatttgaagaagagacgtctgggaaggcggatcaacctcggtggcagtgctagtgctagctagggagaggggaactgaattggcgggttggaggtggaagacgacgacgcaacgacttcctgggctggctgagccgtgcccacctaggccgagcaaggtagacccgggagaaggaggggactttgctcatgagccaacggaggaggacaggaagcggactttggctataatcggcccaaagagaggacatacttgtttttaggttttttattttcataaactctgaaatttgttttgctgcatattttaggatgctctgaaaaaatcaaggaaaaactgaggtgacattttagagcatggagaatttaagaaacatactctaagccacattcaaacttttcttgaacatgttcttgaacttttctcaaactattatagcttttaattatttctattattcattttagaatgtgatctttaatttgggatgaatttatcaagacatcacaaaaatgaaacatgaaacaattatatgaagccaaaatagttcaaagtccaaccatggattttatcccatacatattgcgggccacatcatgcgctacatagatatatgtgctagtcatataatgggtacccattaacaaacattcgctaaattgaatatatatgtacttcgtgtcatactttttttcttctttgtactgacagagtaacttaggctcatcgtcattggcattataatgtagagaattgtttaattagttacaagagagataagaaataatctatatacattaaatagacgatgatatctccaaaagtaactgtacggttttgagtttcaccttcagctgtcaaattttagttcttgtttcgtacgtgaagagtcccattctgagattctcaatcaactgacagttagttgtttcagtcatgcatgctactctgtttggtatacatgcttttgtttaatattttatagtgcaagtctatagatatatgttcatcacacttagacttgtttggagcagggtaaccagtattgctttggattccaagatgctggaatacatggatacaaggatatgatcattttgggaggtttgcatatattgctctccaaaagaaaattcctttttcatatttttttttatgctagagccattgccctgttttttttcagacatggtcatctcaaataaggtggtcgtctatgacatggaaaagcaagccattggctggacagagcacaactgtaagtttcaacttgttcaaattttatcgataaattgttatattctgttctaacaccagcggttgaggaggcatgtggcggtagcgagggcctcagcccaataggaaggatgcatggaggcttgtagatggaggcacagaataaagtcattggctaggagtaaggagtatgaattggatgctgaactagctatgcccctgcatcttggctgttctagccatggcaaggatagtgttacggctacaatttaggaggtgatcaaggtatggcgaggttgtataattgtcaaactagtggccaaggccctagcactctaggaatccgaggcgccag

SEQ ID NO: 14499 - DNA, 508 bp, Oryza sativa
  unsure (1)..(508): unsure at all n locations
agctcggtacccaagtttacttgacacagaccgagtgtataaacggttcaatatatggataatccatttcttgactttccaccatccccaagatttcctcgcatcaggatccaatggttgtccttccactggaactggtcgctccagtaagtttaagaacaaaatcatccaagtattgaagacatttggatcaaaaagttgctttggaatttctagctgcagaaaatacatggcataatgagtattgaaaaaaaaatggaaaacataataaggcaaagaacttacataaatggatgaccagaaaattttgcatatcagcttgatcaagtcagctacttcaattggagggttggaaatcggaacaagatttcttaatatattcaacaaacgaggaaagcattcctcaacaatttgatacaaaggtatcctctcgtcctctgacttgaacctaatnnnnnnnnnnnnnnnnnnnnnnnnnnnnnnnnnnnnnnnnnnnnnnnnnnnnnnn

SEQ ID NO: 14500 - DNA, 429 bp, Oryza sativa
  unsure (1)..(429): unsure at all n locations
agggcgaattcgagctcggtaccctgtttttgtcgtgggtacgtgtatttgcttgtgtgcagagaaagctgacattttatgaccctaggagctcagtaagttcaaaagaggtgaaatgtgacgatacaatatgcacttcgcgaccaccatgcaacatgaccttacgttgtccgtacatcacggggtacgctgatggtggcttaacaatgggcatccttttcactgatcttctgcactatcatcaactgtatgggaatggcagactcagccaaccagcaccagtgtcacatttgggtgagttattaaagaaagagcactgctacacgtactatgtttttcttactaaatttttactaacaatcatctcaactgttnnnnnnnnnnnnnnnnnnnnnnnnnnnnnnnnnnnnnnnnnnnnnnnnnnnnnnn

SEQ ID NO: 14501 - DNA, 714 bp, Oryza sativa
gggagaggagagagggggcgggagatgggccgaattcggcccattagagagaagtagggattttagggttttctttttataaaacctttttaactttgtttatttcttaataattattatttgtgctttgaaaattccactaaaattaatttacacattttgggcttttaggaaatatacaaaaatcctccaagccctatttgacttttaactttgcacattttaatttttgaaggctttcacaagcattttaattattctaggtataatttagaggatgtattttagggtcgatttgggacgcgacaactggtacaggtatggctttgaataatttgtttgcatgattattagtaaggaagtcgtaaccctgttgtagagtccatagccttcactcgggatgagcaaatgttaagtgtaggggtgttgttgacggtcattaaatcataatatttgaccgtcaatacctacatataatgaaacaaaacatggtatccaacttagtggtagggattattactaatcaattccactagtgttggtgaaatatgtgtatgcacgtattttaatgagaaaacacacccgacatgcgaggaaacacacctccgaccaatcagacgcgagcacacagattggagggcccacaaatcatgtgaaaccggccgggaacggtcataactgccataaccgccatcagggcccaccagtcattgt

SEQ ID NO: 14502 - DNA, 7932 bp, Oryza sativa
ggaaaaggggggggaaaagacttcttttagggtttttctttttttataaaacctttttaactttgtttatttcttctccattattatttgtgctctgaaaattccactaaaatttatttacgcattttaggcttttaggaaatatacaaaaattctccaagccttatttgacttttaaatttgcacattttaattgttggaggctttcacatgaattttaattattctcggcataattttgaggatgtattttagagtcgttttgggacgcgacaaacctacctcccttaaacggaatctcgaccccgagattcggaaggactggcgaagagatcgggatgggctgccttcagctcgtcttcacgctcccaggtagcttcttcttcggagtggttgctccactggacctagcaaaaacggattacccggttcctggtcctgcgctccatggtgtccaggattttcattggcctctccacgtaggtcaaatcttcgcgaacttcaatttgctctgagtcggcctgctcggatggcactcgaagacatttcttgagttgagacacatgaaacacatcatgcacgttgcccaaggaggcgggcagctccagctggtaagcgacttctccacgccgagcaatgatgcggaaaggacccacataccgaggtgcgagcttcccctttgtctgaaacctatgtacacctcgcaatggcgtgacccgaagatatacaaaatcacccactgcgaattccaggtcacggcgacggttatccgcataacttttctgccgggactgtgccacctttagattatcccgaatgattctgactttagcttcagcttctctcaggatatcagtcccgaacacttgactttccccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcgaagcatatcttcgaggatctgatttagacgctcggtctgtccatctgtctgcgggtgatacgcggtgctgaaattcagccgggttcccaactccatgcctgcagtttgactctagaaatccccggtgaattggcttcccctgtcagacacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatcttcgtactgcccgggtgaatggaatagggactttcgtgagcttcctagagtatcagctgtttaagttctctgttatctgggacgcatacccgatttccgttccataaggttccgtgttcatcttctgtgaaaccagcagctttaccctgtttcatattcttgaggagtccatgcatgtccggatcattcttctgagcctcgcggatttgatcgagcaaggtgggcttggcttccaacgcagctaagaatccacgacccactatgcttaggttcagggcttccatctgttgattaagttcgggtggaatgcctcgggcgttaagagtgttgcaatggcttttccggcttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccaccgctgctaactccaaatcatgggtagggtagttgccttcatggggccgtagctggcgtgaggcataggccaccacatgaccatcctgcatgagcacgcaccccaatccttggcgcgaagcatcacagtacaccatgaaatccttgcgagtatccggcaagattaacactggcgaggaaaccagcttttctttgagagtttggaatgccttctcgcattgcgggctccacacaaatttctcttctttcttcaacaattgtgtcatgggccgagcgattttggagaaattctcgatgaatctccggtagtatcctgccaaacctaagaaactgcgaatttgagtgactgtcttgggttgcttccaatcggtgacggcggtcactgtttcggggtccacagcaactccttcagcagatatcacatgccctaagaatttgacttcggacaaccagaactcacacttgctaagcttggcatacaattgatgttcccgcaactttcccaacaccagacggagatggtgctgatggtcttcctcagattgtgagtatatcagaatgtcatcaatgaaaaccacaacaaacttgtccaagtattccatgaacactttgttcattaagttcatgaagaaggcaggtgcattggttagaccgaatgacatcaccgtgaattcatacagcccgtatcgcgtggtgaatgcggtcttcggaatatcttcttcccgaatacgtaattggtgatatccggaacgaagatcgatcttggagaatacagtggcacctttaagttgatcgaacagatcatcgatccggggaagaggatatttgttcttgatggtgacttcattgagagctctgtagtcaacgcacatcctcttcgtcttgtctttcttctccacaaaaatcacaggagcaccccatggggaagtactcggacgtatataccctttttctttcaactcttccaactatttctttacttcggccagttcatttgctgccatgcggtagggtcgcttgtacagaggagtggttcctggagcaagatctatccggaactcaatctctcgcttgggcggcataccaggtagttcttccggaaacacgtctccgaactctccgactatggggatttctgacagtcctatctgatgcagttctgaacttctaacagaggttgggggtgcaaagaagacaaccggttgttccggccctcggtacagggtgacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgattagcagagggtttctaagcctttctacccccaactgatttctccccacgaatggcacagatataaacgagtgggaagctccagagtcgaacaaagtggtagcagggacggaatggatgaggaacgtaccaacgatgacgtctggagttgtcagcacgtcctcggccgtcacatggttcacacgaccccgagtgacatccttcccaccgttgttggagcgaggaggcgcttggccttgctgacgcctcggctttgggcatttatccgcaaaatgcccgggctcgaagcagttgaagcacagacgctgctgaccttgagcgtccctgcggccttgaccaggctgcacggctggcgtaggaggacggggcacacgagtcccttgttgattctgctgctgctgcggctgtgggacgcgcaccacgaattgaggtcgaggcgcggagcgaggttgttgctgctgctgctgcgaagaggatccccctgggtagggattggtgtagcgaacccgctggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcccgccaagaacttctcttgcttctcctcatcttcccgcacatcctccggagcgtaacgggccaggttgttgaactcgtgcaaatactccatcacggagcggttgccttgcttcaactcccggaactccctcttcttgagggccacgactccggcgggcacatgggttctccggaaagcggcggtgaagcgagcccaggtgataggttgcccctctggctgcgtagcctggaagtggtcccaccatagagatgcgggcccctgcagctggtgggcggcgaagatgactttctcctcatcgctgcactgcaccgtgtctagctttttccccacggcatgcaaccaatccaacgcatccacggggttgttggagctcgagaaggtaggtgggcggatgcggaggaattcggcgagtttagagtgttgtggaggtggtggtggagcattctgttgtggcggattttggaggtggtggaggaaagcagtcatcatgttggcctgctgagcgaggatttgggtgagaatggcattggtatctggtggtggtggtggaggcgaagcagaaggtgaaggtgggttgccctggtggttggggttgctgccttcaggttgattgccatcaccggtgttaacatttctcctggtcgtcaccatctgaaaaccccacacagaaccagcaaacagagagagctaacaattaaaactaaccacccacgactactataattcttgaatttattactgatattaaatgagttcattaaagttcaagttgcttaggcaaataaaataaagacaggctccgacacagttataccacaaccggcataaccatgccccacacgactccaacaagaagacaaacgagaaagaacacacacgcaagcctactaactgctcgtctaccgctgcgacgggccagggcggaaggtgagcaacagcgcatcctccgtgctaccaacgccggaggtttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcttgggacggcagtcctctccctgagcgatcttgagctgatgcagctgcgcctccaccgcatctaggtccttcttgagctgcaggttctcctgacgcagctccaggatcttcatgttgttctcgaccatcccgcggcgcaccatctgatggaaatcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagtgctggtgaagagtgccgatggcgaggagagcggcgttctgacaagcggcggggaaggaatctccacccgcggtgactgccagcgaggtccgctcgggagagccggagaggatcactgcagtgacctcccaaccagcgtggggctctgcatcctcaccctcctgctccgggagtggcctggcctggtaatccactccatgtggataccccaagaccacgcacatgcctcgcagctccaagacgaagccagtcatgtccaaaccacgacgggtgacgctgccggccatctacaaacaaaacaaaaagaaaaacaacattttagagatcagattttgggcgataaatgaagcagcaagacagagagagactagaggattttcacaaatacaagagatttttatttcgaaaatactgctaaggcttgggatctaaggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccggcacacaaagacaaacgagaaacagcggaagactagggtgacaaccacaggcgcttgacggcaggcacgagctagacaccaaagccttcatcttcaaggaactcctcttctggggttgggaaaaattgagcaagactaagtacaaccaccgtactcaacaagacacacccgcaagtgcagaataaatgcaagggagtacaagggaatcatactgtagagggttagggttgcagtaaacagcatttaaagacatttagttgctcaaagctattttgtaaacgcgattctagaactatacaatgttattaatcaaggccgtgaacccacacgaacctgccttaatccaaggcctatgatgatttcgaccgaactggcaacccgaccctgggtcccagctcgtcccaagccaacccaggccaaccattccacattttagttgataagcaggttttaagaattgaaacactaacttgggtacattgctcggcttgcccataaccgagggcgcgtctattcgaatagattatactctgatcagaggtgtacatctttacccacaagacacatcttcctcacgtgcacccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccagaccattccagagtatccaggtgatatgaatatttcccaaagtctaaagttgtaaaaccacctaatgttacctaattaacttgcgaagcatctacctaaaattaaactagtggtgccatgagtagggtgtccactagttgaggttttgtttaatctagggtggacaaggtaataataacaataacaataataatatggtcataacaaaggtaaataggcatggctaaataaaacagtggtaacgcgggaatttaaataaagcgataatgcattaagttaaaattaaaataatgttataaactgggattcaatatgctcaaggatgatgtgacttgccttgctcgctttcccaaacgtcggcttcaacttccacgaagagcggatcctccgaagctgcagcgtctacacgaccaacggaaaagaaaaggcttttactctaaataactccatataacagcaaaaataaagcacaaaagtgggttctcgacttcttaaggaaaaattagagacttgaatggtccaattccgagttcaaatggccaagttatggccatttgaagtttatatgctctttaaatggatatttgcgaatttcttcatttaaattttaattaaaaatccatttattgcgtcagccgggagaggaggcgcgcggaccgggtccacgggagtggggcccacgcgtcagccccat

SEQ ID NO: 14503 - DNA, 1865 bp, Oryza sativa
  unsure (1)..(1865): unsure at all n locations
ttaggaaatatacaaaaattctccaagccttatttgacttttaaatttgcacattttaattgttggaggctttcacatgaattttaattattctcggcataattttgaggatgtattttagagtcgttttgggacgcgacaatggccgaccacagtgcaagttataagagaggttgacgctagtggtaggcccacggcgcccaggactgtcattggaagatggtctaactgctgcgggctagcggcacgtgagaacttcgggatcctccataaaaatatcgggaaggtcacagaagccgagaaagaacgagcttggatggcaatggagaaatggttcacatttccagccaaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaagagtttagggaatcaagcgaggcacatcgcgtactgcaacagcggaatgagcacccgcatcggctgggcaccgcagggtacatcggcaaggaggcaatatgggcccaagaagatgcagccgctgcagcagtgaatgtccctgccccgttttcagacatccctgaacaaagagctcgcaactgggcgcgggcaaggggtaaggtcaacccggacggctctgtcacatttgagaacaaaagtgatgccgtcgtctatcaggaactagtgagttcactacttaacctaactaatttccgttcgtataaagtacaagttcgtataaacgactatcttcttttctagttgggcttggttgctgaacaagcttcacaaagcgaggttgagtccgtgccgaaaaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaatacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcattctttcacctaatgcagggcgcagcacagtgtgtcctactagcgagagtccacccaactttcgctcctgaagtcgctgagggcatggctttcaagccctcggttatagacaaggtccacggcgcagacctgctagctaggtatgccaaggtgtccatcgatacagtaaaggacacctggtcaggctatccgctgcccgtgcccccaaatgatgaaatcatgactttgggcgatgcgtgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcannnnnnnnnnnnnnnnnnnnnnnnnnnnnnnnnnnnnnnnnnnnnnnnn

SEQ ID NO: 14504 - DNA, 1036 bp, Oryza sativa
  unsure (1)..(1036): unsure at all n locations
ggtaccctgctggtgaatcaggtgacaaaggtggtggttttcaggagggaatggtcgaagatcttggtccgaatggcaatggattacaaccgcagttcaacattttccaggaccggatcgactacgtggtgcaacatgctttgatcaaccaatcaggagtcttggtgaataccttaactaacatggtaaaatcaggggttgatggcaaaatagctgagcatcaagttacagggccagtatatttgccaggtggtgtttttccaaattacagacctttggttacaggcaaccaacagggttcttctagcgcaccaccaacacagtcgatggcaccagctgcggcttctgctccagctgcacaggttgcaccatcattggcaccgggacaaataaccaatcctaggctgttgaccagagaacagccacagcatggtggacaaaacatcaatcggctaacccaggagaaggtggctgctatgttctatccaaatcaaccaactgccgatctagcgctgccgaaccagcatacgtcagcagcaaaccttgctaaatgcatcggctaggatgaggacacctgataatcagctaaggcagcatgttgcaaatcgagttatccctgagcacttggttcataatgtgcagccagatcagtcagtgatacctcaagttatacctgaacatttggtgcgtaacatccagctgaatactcagaactacaaacggggtcacttaaattatcattaccagcctccttcacctcatgtgcatcaaagggggtcacctcaacctcagtttgctccccagtttaatcagtttgagccaatatcacagcaaacacaaggggaacctcagcagagacagtgggccgatatgattgcagatgtgatgagggagcaatttgggtttaagccgaaggatactgggaacttgtatcggcatccatatcctgagtggtttgagagaattccattacctgcccgatannnnnnnnnnnnnnnnnnnnnnnnnnnnnnnnnnnnnnnnnnnnnnnnnnnnn

SEQ ID NO: 14505 - DNA, 678 bp, Oryza sativa
  unsure (1)..(678): unsure at all n locations
nnnnnnnnnnnnnnnnnnnnnnnnnnnnnnnnnnnnnnnnnnnnnnnnnnnnnnnnnnnnagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagcttcaccaccgcgtcaatcaccgccttcccgccggagtggatgcacatgtgctcgaacgcgcgttggaaatctggcacaatcgccgccacggcctttgggttcccggcgacatatgcgcgcgccacccgccacacgtacctgcgtcatgcaccccaattcatcactgaattagtagcaaaataactataagttaaccaataaattaaattaatcattaattatgtgtttgctggctcggca

SEQ ID NO: 14506 - DNA, 1411 bp, Oryza sativa
aagttgaggtgaattgcatgcttgaattgatctcccaaaggtgatgtcaagatgaatgctgcccctactccttggctgttgtgtgcaccgtcgaacgccattgtccacgtttcgttgtcgatttggttgtctgacttattatcaggcatagtccaatcggctacgaagtcggcaagtacctgggacttgatgcctgtccgtggcacaaagcggacatcaaattggcttagctcgactacccatttcgcaatgcggccgacaacgtctttgtttctcactacttcaccgagagggaaggaggatagaactatgaccctatgggcttaaaagtagtggcgtagctttcttgatgtcattattaccgcgtagagcagtttttggatctgtgaatatcttgtctttgcgtcgtggagagcttcgctgacatagtagactggtcgttgcaccttctctctcttgacaacaatgacagtgctaacggaatatggcgtggtggcaatatatagaaataattcttcattaggttagggggcaacaagtacaggtggatttgataggtagcgcttgagtgcaatgaatgcctcttcggcttcctgtgtccatacaaatttgtcttgcttcttcagcagggcaaagaaaggtggtcctcgctctctcatcctagcgacgaacctgcttagtgccaccatgcatccggttagcttctgtacttccttgagtcttgtaggcgacttcatgttctcgattgccttgatcttctcgagatttgcttctatttctctgccagagacgaggaaactgagcagcttgcccgatggtactccgaacgtgcacttctctggattgagcatgaggcggtatcgtcggaggttgtcgaacatttcccgcagattgtcaatcaatgagtcggttgtcttggtcttgacaacaatgtcgtcgacgtaggcctcgacattgtttccgagttggtcactgagtacgccctggaccgtgcgctggaaagtgtttcctgcggttattagtccgaacggcatcttaacgtagcagaataccccgaacggcgtgatgaatgctgtcttctcctcgtcctctttcgccatgctgatttggtggtagccggagtacgcgtcaagaaagctcaacaactcacaaccggctgttgagtccatcggttggtctattcgaggaagagggaagtgatccttgggacacgccttgttgaggtcggtgaaatcgacacacattctccatttcccgttggccttccgcaccatgactgggttggctagccactctagatggagtacctctctgatgaaaccagctttgagaagcttgtcgagctcttcttgtatggcttgttttcgatctggtgcaaatctccgcagtttttgctttactggcttggcat

SEQ ID NO: 14507 - DNA, 731 bp, Oryza sativa
  unsure (1)..(731): unsure at all n locations
cacttttttgtgttgattcctttgtaacctattcttttctctcacccacctatgagaagaacacgattgattattaaaaatcggtctttgtggcaatgcccataatggataataatccaatatataagtgggcatcatccatgtaccattgaagctccatggtgcataccaaggctaataccatgaagaaggagaagtaggttgtcgtcggtggtacgctctcgcttgtctcctaccttgcttggtaaataacttgatttccttggttgctcatcttttggaatcttcgacttgtcatattgccccccctgagttttgaagtcttcaatgtggtcttgtcctttagcaatccaatggtgcgtataggaaaaggtagctcatccacttgcatttttgtaaaagtcaatcatccttcatcaatggccaattgaatttgtctacggaatacattgcaatgatttgtggcatgagaataagagttgcgccacatacaatatactcaccgcttcaattcctcaagtgttggtatgacacggccttgtgacaatttaatttgattcttttctaataagtagtaaaaaatcctatcgcatttggccatataaaatgtgaactttacctcctcttgccaattcttgcgaccaccgacttaagagaggaccaaacgaatggatttnnnnnnnnnnnnnnnnnnnnnnnnnnnnnnnnnnnnnnnnnnnnnnnnnnnnnnn

SEQ ID NO: 14508 - DNA, 1035 bp, Oryza sativa
atcagtggcgggctttcggggtcccggttgaaacaagcacgtgctaactgtgctgcgttctgggcacctttgaccggaaagttaccctcaaacgagggtcaattagcttgtaaaagcgctgcctttctcctagaagggggcgtgcccactcaacaaggttgtgctcaccatttgggcggttcttgtccattgacctgcgccctgacatcatctcaagtagcaccacaccaaaaactatagacatcactctttgatgtcaaatggcctgaaaagtggaaaaaatacaagaaaattataccaagagtcataatgaaaatcgcataaaataccaaaggcaacaaatctgtgtttgaacttcatttgcacaaataatcattgaaaaacccagtgcccagcattagcctaatattcaaaaagattgttgatgatatgcaggcaataatacattttcctggaaatcaaatgaatgacaaacatctaccatatggacaacatcacttaactctacagttgcactcttagacatatttgttttgcccctgcaaatgtgttttcacaacagtgctgggatttctaatcaaacaagacgcacttgtgcaactactattaattgtaatgacaagtaattaaatattatggtatttcccttctacattattttcccaagatcaagtgtaaaggcttaatatagttcataaatagagctgacattaattacattaatcatagccaaagaaactaattgatacactgtatacatattattaattctaggaagaactaactaaaatattttgtatattacattcacaatattttgtacattaaccactaatctactatatcatgacaattcttcttataatcatttccattccatagatttaagtgtcgccgataagagagaccgaaagaccatagggtgcataaactgatcgttgatgcaagaactggtatagtaaatcgcatagctgacctgtttttgcatacataggagagataaacaaagtggaaagtggactatcttcagaccag

SEQ ID NO: 14509 - DNA, 732 bp, Oryza sativa
  unsure (1)..(732): unsure at all n locations
ttccttctctttccctatttaatcaccttgccacatcatttttcatcttaggtgacagcttatttaatactatggacatcatcctagtcattgggttgggaatggccttatacacttcgctcttgacagctctcgcccccgtacgtgccgattagccacaccggtcgccgctctcgttctcctcaccgttgtccccctcctaccaaatttagtggatagccagtacaagcatttgatgcaaagaaataatcgtacgtttcatccatgcattcacatgggcacgggggtgaacgtggcaatcgggggttcaattctcgatcctccttcattaaacatgatgactgtaccgtactgttgcttgcgccatactactgaatcatgcaatgctcattaattaaacaaaccaaacaacaatccatcactaaaccggctgtaggggccttcctaacattgggctatttggatgtaggataggcagcggcagggtgggctctcagatctagtcccacgtcacacggattcgtttctctctgcatgtcgtatggatttgtttcgcttgtgttatggtatgttactgtatctaggagaaactttatagccaatacgtggtttagttggtaggtatcttactgttagagcttcaatccgttctagacacaaannnnnnnnnnnnnnnnnnnnnnnnnnnnnnnnnnnnnnnnnnnnnnnnnnnnnnnnnnnnnnnnnnnnnnn

SEQ ID NO: 14510 - DNA, 858 bp, Oryza sativa
  unsure (1)..(858): unsure at all n locations
nnnnnnnnnnnnnnnnnnnnnnnnnnnnnnnnnnnnnnnnnnnnnnnnnnnnnnnnnnnnnnaaattaagcgaaacaaaacgagtaacatttgagaatgaccagaacgaatatataactttacataataaatagatacatacatgtagataaagaacaataacactagtggattaatccgttcgatcacaaatatatatcatttaactttttttaaaaaaattgaggaagtacgaagaaaatagaaaaaaaatacatgttacttgatggaatataaaaactcaacccaactttttagaatactaaagtttattttcattttttattttcaaaatggtaacttaaggcaacttatcatttttcaagtgtgtaaaatccattgcgggcgcaccgccactcgacctacgcgttgaaggcggtggcagcgcagcagggtagcggtgggcgcatgcattccaggggttgtcggcatcgggtgcagagtcacggagcgcacgccagacgttactgcaagccttgaagccggtgccgaaggcaagcatccagaggcggtcaccggcacggacgcgacgcttggcctcaaagtaggcgagctcgtagaagacgaggctgctcgacgtgttgccgaacctatgcagtgtggcgcgcgccggctctacgacctgtggcccaaacgccatcagctttaccaccgcgttaatcaccgccttcccgccggagtggatgcacatgtgctcgaacgcgcgttgaaaatctggcacaatcgccgccacggcccttgggttcccggcgacatatgcgcgcgccaacccgcacaagtacctgcgtaatgcaccccaattattactgattagtagca

SEQ ID NO: 14511 - DNA, 7138 bp, Oryza sativa
  unsure (1)..(7138): unsure at all n locations
ctaccagaagagcctctgcttcttcttcttcttcctctgccgcagccgatggcgatggatcgccatggctgcggctgacggccttcgccgtgctcaccctccactcggctttctctgcatatctggctagagatgacgcgaggctggtcgccctcgtcgtcgtcggctacctcctgatgctggtgctgctgttctatggcctggccgtgcctgtccaacagaagagagactaaggtgaggcttcagcaatcagtcctcaagcatgaacctgccttgtttttttttcctttttgctggtttggttttcttgcatggtttgatcttggtattgaactatggatgttatgtacaaccctgtacatgctgatcaaatgtgtatctgtatgtttaattattgatgttaccaaagaatcacatgtataatataagtaattcgaaagagccacacactatggagttcagtgtacacttgcacaactgcactgagctgttagagttattgtacatatactgatctagatcaatgcttttatttgaatacttgtaccatttgcaactttgatcaggattgtctgctcgagtttgtactttagcggttgcatatattggaggcgtgtgattgatcagaaatgtctagttttgtatacaaatacaagcacttgaacaagaaaatcctttgaagttcacgtcagggaaaaaaaaaagcaatcttcttcacatcaaacaaaaactccctggaaacagtgtaaaagacaatagcatgaaagtcggggatatgcttctgaccatcatcacaccggcagtaaaaaatatcagaaattttgtgttgtagattttcttagtatatgacaatgaagttttttttttttgaacgaaccattcagatgctacattgattattattttaaaaatattcccaccagatcctaaaaaatatgaaaattcaattaaacaaaccaatgatttttaaaaataatctctgaaatctcaattcaaatcaccgtccccatgttttaagcctcttgcaagcaaatatgtagttcttcatactgtaaaaactttgcgatcgaactaataatagttggaaatgggatgcgttaggattttaaaccaaaatacagtacatcgcagcaaatcatcataagttaaatcagatgcctgagatgatttggcgcaagctcgtcccattcaaaagacttgggctgtgtttagatccaaagtttggatccaaacttcagtccttttccatcacatcaacttgtcatacacacacaacttttcagtcacatcattttcaattttaaccaaaatccaaactttggatccaactaaacacagccttggtaacttcaacaatactgtccctagaataaaataaaatgatatgacactagaacagagaatagcttagtactaactacccggctcttaggataaatcgtattgactatacatgtttttcttacttttccaacaagtgctgacctaatcccaacagcaaactcactttcaggctttcagctattcccaaataaattttctgaataaagtcatagacatgacaagataacgttcacagatcaccacaaataaactttcatttcaaccaaaaagaatgcataaatcccatttgtatatgttaccatgaaagagaacataatgatagtactggtaacagatactatgattttgtatgaactgacatgcctcttctcttcagtgggcaatgtcagtcaggctgcaatggtcaacacagagaatcaatgatttgtggtcaatcacaaacaaagagaataatccaagaaccaaatcctaaatcctgcagctaaaactgaacttactagttattacaggtgtaattaagtttccaaagggccttgctgggacaatcatctcatcacagatcatctgtaaatcagaacatcctccttggttgaatagagctgcattagacatgttttcctttcccacaaaaatgttctgtcaagcaagcactatgaacagaaacaaactagtctgtcaggaaggatcaggatcatgcagcaaaagaccaaaagtagttattccggtgaaacagttgcttcggctattcagaacatttgcataagatgaacattagcgatgtaagatacaatgtgtctctcaacttacaaaaacgatatacgagaggttttatgacagtaataatgcccaattttaactattatagcgagttgactgtagtcaacccagccgagtcaacgtagaactcacgcaggatccacactttggcagccaacctttcttcttcctcttttcccctcctccatctctctaggccgggaggcaggcggcatgcctaatttagatgggtctaatttgggccgctaccattggtagagtccaaaaatataggtgggccggatttagtagtcgcgaagtaaattttagcgggcctacatggactaggcttggctagctatctgtctgatagattagatattttgctaggtgggtgctgacgtgttcacctttctctcaaccacacgatatctcatagtcttttactccgaaagttggaggttacacgtgtgctacaaaaaagtttcgagtcacctgtatgccatgacacaaattttcgtttacctatgtgtcattccatccaccttctgttagagaatgagctctgatatatgagacccacatatgaaaatgaccaaattacccttgaagcattttcatctctactactcctctcccgtgcaatgccctagcctagccgccgcctctcctcgccggcacgccaccgcctctctagccgccgccgccgccggtcgtcgccggcacgccgccggtcgcagccgccgccgatttctcttccaaatgttccaaatagagcaagggcaaaatagatctttcaaacctccgttagtctccgttagtgttattccatccaaagtggcgcacaggtaaacgaaagtttatgtaatggcatacagatgactcgaaacttttttgtggcacacgcgtaaccttcaattttattaatggcgtaggggtaaaagactcacgatctcaaattcccaatcgaacggcggacacgaaaccaacgatccagtttaccctcgccgtcgccgccgccgccgccgccggagattccgccggcgttcacgcgtggaagctgcggacctgctcctccgcccccatccgatctccctggagcgaccgccacctccagagtccagaagctcagcttcgccgcccgagctcgatcgccgtcgcgcagcgtcgcagctcgagtgcccccccccccccccccccccggcttcgcttcgtcggcggcgaggggcgacgagctaccggatgcattaccagaatcagcagccaatcgagctcgccgtcgcccgcccacatccacaccagaatctgcagccagccatgtatcagaggtagtattatcttacctgcaatcctgcattatatttttgtatggttttcccgcacgatttgatctttggtactccctccgtttcacagtgtaagtcattctagcattttccacattcatattgatgttaaaagatctatccatctagatttattaacatcaatataaatataggaaatgttagaatgacttacatcgtgaaacggaggaagtatatgtgtagtaacaatcagtctgtatgctcataaaatggtgtgtttatatatatttatttattttaagaatcaaatgtataagcgattcgaaagaagctaacaaactatgaggttcaatatatacttgcacaactgcactaactgaataattaacaatttattgtacatatagcctttgtactcttcgcaacttttatcttcgtcgccttcttggatttatgcttcagcggctgcgtatgtaggaggtgtttgattgatcggaaacataattggtatgcaagcacttgaacaagacaatcctttgaagttcatggcaggaaaaaaaaaagcaaatcttcttcacaacaaaacaaaaactccctgcaaaaaattgtgcacaagacgtcaggaccttcagtggaaaggatatacttttgaaaatcgtcatacttgtagtaactagtaagtataaaaaaaatgcttgttctgaataccaaaaatatcagaaattttatgttctttgagatgatttttttcctgaactaaccgttcagatgctgcattgattaataaccttaaaacttctgcgtccgtgtttcaaaaaatatgaaaattttcaactgaataaaccatgggatataaacaagtgtttgtttgagaagtagattactgtcaaatggataagaaagaactagaaaagtaatctatgaatatgtgatgacttactagttacaattcaaatcactgttcccatattttcagcctcttgcaagcaaatatgttgttcttgatactgcagtaactttgcaaactgaaaataattggaaatgggatgcattagcatttaaaaaaaaagaaatatagcagtaatccatcatgagttagaccaataatacctgagatgctttgaggtcaagctcatcccattcaaaggatggatttgtaccttcaacaattccggcaccagcataaactaaagtgctatgaccctagaacaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcgtcttcattcctcattcttgcagctaactgagctgacaggtgttgtactcttggaagtttccgaagggccttgctgggatggacaaccacatcatcgcagatcatctgtaaaatataataaattccttggttgaataaaactgcactggccatgttttcccccaataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaatannnnnnnnnnnnnnnnnnnnnnnnnnnnnnnnnnnnnnnn

SEQ ID NO: 14512 - DNA, 1448 bp, Oryza sativa
aggacttacttgaggaacaatgaagtaaaatgatccaaattcctcccattcaactgaatgatcgctcgtggcatcgaagcggatagcaccataagcacgaatcagtgggcaatcccttggaagaaatctttatggacataaatcaagtcattgggtcagcaccagcatgaacctcattggaataaaaaaaaataaaagcaatcatgaagcaacaatcaagaaattcaaagataataaaggatcatgtgaatagttcaccatcaccaacaacacagtaggagaccatgtgaagtgttcactgacacagtatgggccaagaccagcatgaagctcattgaaataaataaataaataaatttataaaaacaatcaaggaattcaaagataattcaagatcatataaagaattcactaacacagtgcaagatcatgtggtttttttttctcttgaacacacgcaaaagttttgtgcttcatgataaaggagcaccagagaaaagtgtcttaaaccaatacacaaagcacttccaagtgagcatttatcccttctatttatttttcaggaagaaatcgccgtaaatttcttattaatccaactgaaatttatcaaaaaaattactagcaactagctgttcatttacttcttaaatttgctacgcatggttagtttctactattgtaatctctctatttttttaaaaaaagttaataacatcatatactaccccatcctaaaatataagtatttttattttttgaatagtgtaaatcaaacatttttaactttgactcttaatagcaaaagaataaaaagaaatatgttcaaaatcaataaacggagtatggtgagaaacgtccagggtctacagctaactctatagagtggtgagttagacaacctaagtttgaagcttcaccccttctaataatttgatattaggtcatttcctaatattcatgtctttttagtaggaacatatcctatgcatacaaactttttgtgcacactccgtgcacaataactagcaaatgtcacgaaaaattctataaaaaattgtacacatacttcaaacagtattacatctatatgtaaaattttatcttcaaatttattatattttagccgtaataaaaaatataaaattctgacagatttttacccttaaaactgtcagatttttcatcttttgttactgctaaaatttaatgaatttgaatacgaaactttgcatatatgtgtaatactaataggagtaaatgtctaattttttgtagaacttttcgtgaaatttgctagttagtgagcacgagaagcttatgtgcgtaggatatgtttttagtatagtcaaagttcaaaatcaacatttatcatcatgtattaaaaaatgtagtagtagatggcaccatcgattacctcttgatggccgcgccagtcgcggaaggagaac

SEQ ID NO: 14513 - DNA, 5656 bp, Oryza sativa
ctggtttgcgaggtcactaaccggtgtaaggcgtgaggagaaaaaaaagggtgagtcagagtaaggtgaggggtgccccacgcgcgcgcgaaggggagttcgcgtcgcgagggaaagcgcgaagagataagaggagattctctctatttctcagggggataagtggcacacccgtaattttccacgcccctagctgccagcctgccacgtggcagattcctacaggtcagcactgtggtcatttacctttcaccttaaaggcctgtttggaggagcttctagctgctgcagcttttcccagaataaaaacctaggaaacctaatttttgtagattctggttcttagaaagcggctaccaaccagctgcatctcagaatcttaaactcccctaaacatgtcatctagtttccatatcattaaatacattgtaacataagcaaaagtctaatgtagcaagagttaatggtgagagaggtaaaaagataaagaaattatttctcatgcaagaaattatctctacacaagaattaagaatgaaaagatactatctatataagaataaataggtggataaaaagagaaaagagaggtgattggatgggaatttaatttgaaggcacccaacccaggtcatccccaaccctttattatcagtaatatgtttcctcctttggaagaagaaagtagtgttgaataatttaagaaagtagtgttgaataattttgttatcttttgtctcgtctctattatataggagtatatctgaagtccgcatggtacacgaaatcaatcaatcaaacttatctgaaaccattttttttcttttccgacagattttaaacaaatttgcatgcctacgtcacttttatgttccaaaggatattataaacaattcacgcgactattcttttacttttccgacagattttaaacaaattcacatgcctgcgtcgcttttattttcaaaaggatattataaacaattcacgtgcctacgtggtgtagccacagaatgattttttacgtctaagagtacgtgtaattgtacaggtatttagacagggactgaatatgttaatagtactcatttgctcagcatttaaaaccactttactagacaccttgacaagcatataaacagttagtttaattggagcaccataaccacaagcacagtgtggacaatgacagtgtgaaaatagtaacaaaaaattgtcacctagaagcaagttcataattttgccgagcttgaattattggggtgcaagggttgctcattgaacaagtgctaacaccgataacagaaaaaaaaaatcctcaaattaaacatggcagttcttggaatctaatagactgcaacaaccaaaagatgcgcatgcgccaagatgtttttcaactcatctcaatttcatctttgaaatgtaagtacaccctgagaaaaatcaaggcttgagggccaccgcaatgccgacctttgagctcttgtcaatggccttggtgtcaacttctgctgagatggtccacacagactttggcctccactcgtgctggagcagcgcgctggccttgccggaattgttgaagcgggccttcacgacggtaagcgggtcgagagtgtgctgggtaccgaaggtgagggagttctcgttgctcgagaagctgtgggtcagctcagctccaacagctgtggccgaatggttcacaatgtggtaataagatgcagtgagactatctcccttgttgttcctgcaagacagtttcaaatcaattatggattttggatttttggtaaacaatacaatcaactagcaagtcctacatatgggatcagttatatctatctaaagatgaggataatagagattgatgattagttgatatgagatgcaagccaagatacttatttctagattcaacatatttgtttgattttaataaaagaatgtaacaccaaacgtcagttttcaatgttgataaggtgtgtattgtgcaaagtatcttgatcgtatatggtcaactaaaatagtagcggcttttgaatggagatcacaaacatggcttgtaaacattatcttgctctctgtagttaacgagaacaaggaaacatgtcaactacaataagatattaacattgataagtttactctattttatctcatgtttcctaccattattgaaagaggtagatcatgaaacctgataaaaatatatatatataaactctatttgggctataagttgttcagatggcaagaacagacacattgcttctagcgggacagatggaatggtcaataggatgtacaaatgtggatttcacaataacttaaagagttatgaagttagaagatgatgaaggtaacaattcactgtaagcccaagacacttacaggttcaatgacgcgataagatcatcattactgaagctcaatccagcattatatttggtcaagttccccgtggcggtatcaagtgagacatcagcaccaacagcaagagccttggttccaaaaacactggagagattgactacaggactggcagtcaaaccaatacttgcactaacaccagcataatcatgcgagtattgaagctcaaactgaaaccaaaaagagggagagtgaggacaaccaaccaagaaggtttcattgaaaataagcagtaatgtggtgcatgagcaaattacctttccagatctttgatccggaacagcaaagctcaagatggacttcaatcctggtgttagctcatcaacggttacagtagtaacaacctggccaaagatagaagcagtcaatacaaaaaagggagagcatggcataacagctaatcacagaacatattgctcaatgcaatcaaaactagtagcatattcggtacgaattcgtcagatggcaacgtaaaatcatttcatatagaacaaggattcaaaccattgcaatgtagcaggcaaccacaaaatctaaataagttgtgtgcaagtttatttgggtgtgtctgtgtatttcatatagaacaaggatttcagaccattgcaatgtagaaggcaatcacaaaatgtaaattagttgtgtgcacgtttatctgtgtgtatgtgtgcgcaagcgtgtgcacacgatgtgtgtgcgtgagagaaagagtcatacatttgagtctgagtttgctttcacatctacagtgatgttcttgttctttatctgtgattggatctcaccaaaaatcagatcagccttctttgtactggtagcagtgattgcctgcatcaaggaataacaagtcaaagagctaaacaaataacatcatagctgccacaacaggcatgattgtatcaaaatttacaatcatacaggaaaagcaacactaagataaccctcaaatatacaccccaaccagtcaccacctttacaagctatcattacgaacatgtaattgattagtacagcctttagtagtttaggttattccaacaatacaagacagttttgtgtttattatgcacaaaattcactttcatcaatgcttctcttagcaggagcacacttcaactattccacttacaagcacttgcatgaagggatttctcccataacttttagttttctttaaaaaccgtaagcataccaagggcaaagtataataattgcataatgtaccaaacaagagtcctccctgcttcagtaatagacttgctttcttaaataaagaagactaattaaactaatgttctgcaaccaacaagttcatgttcaaccctctttcaaaacaatcaaaccaccaatcagttgccaagcatgctgttgttttaacccaactccctacctatcattatcaataacaaaaaagacctacctaggatatagattactcctaaatcattttaccactatccaagagataatctctcgaacaatcttttagcttacaaatcccgcgtctcactaagcaacaggtacattgctaatcctcctaaacaagcgaaacaaaccaaggcacaagcgagacctggcaaatctcccggcattcatatacctcctacaatccactaactatggactataaataaactaatccatcgcaaagatcacacatcacacattaacaacagcaggtaggggcagtaaatcacacaaataaatcaagaaagcctcttacatacaacaagtcaacaacaaaaaaaactcgagagcacttacgacgccattgctggtgtaggtggtgagggtgaacttgtggtcggtctggtagtccctgtacagcagatctgcagcaaaaacaaacaactcatcatcaacaacaaacaaacaaacaaacaaacaaacaaaaagaaaatcaaatccaagaaccaccaaagctctaatcccacaagagaaggggacgcggccgctcacccctggccttcttgccgatctccgggtacaggcctggccccaccatctcctcgtcgacgacgcgatgcggcggcggatagcttgcgcgggtgggaggaggaagaagaaggcggcggcggataggaggtggaggttgcgggagaggagaggagaggagaaaataaaggcggaggaaaaaaaaaacacggcgcggcgaggctgcgtgtgggccctgataaaccctagatttttatttcgtttctggttttatctttttttttcttcggtttttttctttattttatcctttgcttctgttatatcttgagttcaaatgacgttgttatctctagatgtctcaagtatctaacccgtcctttggtatcatcttggtatcggatttttttttgttgttcaaaattcaaatggtttataaatttgtgatgatatcaggtgcagaatgggttagttcaataatattttaaccatttattgcaaataaatgtaaatactatttcattgaatctaaatttcacattttcataattcacaattgaaagtatattgtatgcctcttatcatctacttgttaacttatcagctacaatattttaaaacttaattttgatgtgttttcatcacaatctaattttcagcactgtcttttacacccaacataatatagatataaaacttttttcaaaatttattataattgtttcgtttattttgccacgacttgtcagttataactcaaaaggtcaaagcctatgtcaactaataacctggttgtgcagctataattatgtgttgcttttgttgtgccccatagcattttcattttttcagagtagctgaatacacaggctggagatgtggctgtctagcctgctgagacttgagagctagagcatcaaacgggtttattcttttccaaaccatgtgattgaatgtaaggattctaaagcatatattctctattcaacaagatgtacatgattgagcgatgtataatcaaatagtccttttgatattgtgtctaaacttttgatcaaaatcttgtctagctagattcatatgttcttatgttccaaatcacgaatgcattgcaattgtatacagagtgcatatcggtataatggaaaatattgaaaatgcgacaaaggtccatgatatatacatatcttgatccaatggtccaaatggccaatggataataaatacataataccgtgtgtgggtttttatttccattgcagcttaaatgtaactaaggctgtattctttt

SEQ ID NO: 14514 - DNA, 15180 bp, Oryza sativa
tttccattaacacgttttttttcaatctgttaaatggtgtgcgtgtgttttttttgcaaaatcttttatatagaagtttattttaaaaatcaaataaacttatatttaaattttataatcattaatattcaattaattatactctaatggcttacttcgttttagctgtcgtaaaaaagctaaaccaaatatatccaaactaggcctaactcttcatcagccaatgagtgaatgtaccgtgaaagtatagcacgaatgtcatttgaggttccattagaaaaaaaaatggaaaagcaaaataaaaagggcaagttagggatgacttaggataaagaaagagttggatgttgatttacaagccatggtacattaggcaattaaaattcgactaaggtgacattcttataaagctgtctccatagcaaacacggcaattttagttaaaaaaataaacttaggttgcgttcgttgctccatgttggaaacttatcctcccacacgaaaaacgaggtgacttattagatcatgattaattaagtataagctaaaaacataaaagaagtgattaatatgatttttttcaagcaatttttctataatttattttcaagtattagcatttttttctatttttttaaaaaagaacgcatcatttagtagtttaggaaacgtgtgcgtgaaaaacgaaggagcgaaggttagaaaagaggataaacgaaagacacgaattgctgataaatctataaatataatgcattctgaaataaacaaataaagagagagagagaaaaaaaaaaacctccaacatttttcaaatgaatcatgcttcaaaggcaaattttgctatatgacactcatattttatgtaattagcttatagatatcgcaaaacgtgttaccactgaaagataccataaaaactagtaatttgctaatttgctaaggacactttcggctcaattggagagaaaaaactagtaatttgctcaggacactttcgactcaattggagagaaaaattctttaaaaggatgaggatgcccctaaggccaaaaacttccaagctgaggtcgtgtttagttccaaagtttttttttttccaaacttccaacttttccatcacatcaaaactttccaacacacataaacttccaacttttccgtcaaccaaatttccaatttcagtgtgaactaaacacaacctgtggctagagcgaaaatggaatatgatgtatgctagcgatatacttggggtgatggcaaatttaaagttgcataattttcaaaatttcactccatgtttgaagcatgtggtactagggacattctcgtctttcataagaacttatctcttcaattgaggcgaaagtgtcctctagcaaattatcaggttttagggtatcttttaaccgtgacacgttttttacgatgactaccaacaaatcacacaaaatttgaatgacctgtagcaaaatttactagcttaaaattgatgaagagggcaaaacctacacatcaaaatgtcacttcaagcccataatcctacccaagccaacatggcccaggctttgagggccgtgtctacgtagcccaaaatcaattaaacaagaggttaaggagatgttggtttaggccctgtttcattcagcttagaattattataatctgtattattagaagtaagctgaaaataaacaagtagattattatgatatattattataatctataagctagattagtataatctaataatcttctagggaggagctttttccggattattgagtggctaaagacccactacccttagatgcttccaataatctagagacaaataactcgtagcttattctaaaccagcttattataatccagcttagagtaatcaaatttaataatcttgattaaaaaaatcttaaactgaacaaacaagcccttagctaggcctaatgttggaacagccagaacatcttgctttttggtaggcttgttaggctttgttattccaactagaaatttccttttgaaaagggaatgagaatagcagaaatatgttagaatgtaaattaaagaattaaccaatccaaaacatatggaaatttacatgaaatttgcaggagtttttaacccagatgttttgctctttttttttggggtaaaaatagagaaactgtttcttctgcaaaggaaagcaacgctgtctttgctttgtccaaaacaaacttaaggccccatcaaacggcatatttacaaacgaaaaataattcatgaataaaacttttatatacgtgttcttatcgatctaaaagcaacgactgaaaaataaacttcgatgaaaaaacctcaaaatcagcttcaaatttaaggttacaaatttaaattttgactaataagcataataataagtgaaaagatgaggccatcaaggaaaaacattctacagaaataaacctgtcaaataaaaagttctatgtataaataaacaggcaagtgtttgactttcttggcctaatgtattaggtattttgacaagggaatgttgctctttattacttatccattttgaaatatagcaccctacatgtaacattatactacctccatttttaaatgcataatgtttttaaatatcaccacttattttattaaatatatatatgtaaatataatttattatgttatgacttgttttatcattaaatactttaaaaatggcttatattttcttatgcacactaaaattttaaataagatatatagtcaattgtgaagcatgaaagtcaacatcgtacgtgacaaaggaaaaaaatatgtgttgttaatacattttctaatcaaatattactgtaatgtacgcctccctaaaaaaacaaaacactttcaggctcatcctcgtaagttatattttttcgggacgatggaatataaaatacgagtattttattatctacaaagataatatggccttatccgtaaaaaaaaaatcaatctaggagtgaatataccccatataacgaatctggagtcccgtcctatcagattggcacagctccatctcccatataacgaatctggagtcccatcctatcatattagccaaacagtttcgattttgctatatctcactcgaaagattttttcttatctctcactcgattttctcactcaaatttacagtgcattttcttgtaagttacagtgtaatttataaaacttacactgtaacttttgtaagttacactgtaatttttgaatcttcacatgtaaattttaaattttgtattggatttggtctttttcttgaggatatggtaatttaatattcattatggggtttcttaattgctttttgctttttattatatctatcggattttaatataaagattaaaaatctgtgtgatacgattataaaaatctttcgaaagatgtataggtactcccaacagttttgtggagctctatcacaaaataaactatagagttgtggagctgggtttatgcagcttcacaactccactccagaccctgaagctaaatttaaaagttggagttgtaccaaacaggccctaagtttttttacgaaggaaggtaaccacaaagttatgcaacaaatcacctataaacatcctgtcatatcaagataaatcatatggcatcatcagccggccaacaataggcataagccacaacgctgtggatctcaaagaaaagtcatgacaatgtgcatcaccacaccatcagctgcccagcatcaattcttccaaacgatccaataatcccttccccctccccatccaaatcaccttttaattattctgcgtccgcgatttcgcaatcacccgaattcatttcgtgttatccccaaatctcgcgtcatctctcttgacctgggccaagcaatcgatcatcccgatccactcgggctttaaacaaatcgctgcaaatttgttgttttccccttaaatttttatgccaagatcgcttaaattcaaccggccaggtggggatttcctaggagaggaaggcgatggcgccgccgcggaagcagcagcaggaggaggagatggttgccggcggaggcgaggcggcggcgccgcgggcgccggcggacgtgatcgcgcgggtgttctcgcagctggactgcgtcgacctcctcagctgctcgctcgtgtgcaggtcagtgagcagagcacgacgcgattcccggttcttgcacgcggcgtgttcgacgtaatgcccaccccgacgcctcgagctcgctcgatgcagtgaatcgaatccgttttgctcgatctctccgagtcaatggctatgatgtagcttgctgtctattggtatctgccttttgcttacaggctggatcatagctctgctcttaacagtggagagttgaattgatgatggatcatcgctggtgaattagggagatccctaaatccgattaattttcgtgttttaagaacatttcggtcaagcaaacggccatcatatttcttgctgaattttctgaccaaagtgaaactacagttagtttaattggtgcttgatcagttgctaaaagaagtgaatactctttttttttttttgtaaaagaagtgaatactgaacacaagaatattcatcttttcttctgttacctcaagcaatttgctcagtactagtacccttctgacctgaaactttgctcatcattttgtgaatcatcaggcaatggtaccgcgactccgcggagctgctagaggagtggagaaaggagtacatggaggcctggaaccagtttggtctctacgtcaagcagcagccgcagcagccatgcccgacctgctcaagctcgatcagaaccctgcgaggcctgtgttcctgagaactgctgctccctccattccctgtcctgccattttcacaaaggcaaaacatttgtagatggcaccaacttctgtattgcacatgagcattggtggtggcagacttgtgtgttttgggtagtgtcagtgctgcctctgcaacagattcatcagtatgtgtgtacatggtgaataaaactgatgttagttacatggtggattgctcttctgtataattgtattgttgattggtgtgtaatgcagtaatgcaatgtgcctcttgatatatgcaagaaaattcatgtgaacaaaaccaaacagcaaattcatgtgaatctgccattattgagccaccaaaaaccaagtacatgcacacaccattattatgaacattgcctctaggccctgttcacataaacccctccagctttgcacaacacaaagcctgataggcacacatcaagctcaatctgatggattttctacaaccatacaacacagcataatatcaccaaattcctggaacttgcaatctgttataagtgatataccaaccagtactataatatatgtctgacaaatggtttagcgcaactcatgaaagtcttaacaaccatctactcatctagtaggtaacaagtataagatccacaacttaaagagagatttgcatgcgtgtagacctaaaatatactccacttaaccattgctgtaacatttaatctcacacgatatgtttctaggatagtgatgaagaactccatgctgcttgcaaaaccgaagccatcattcagtcattgcgttcggcattggcctggaggaggccatctcttatctgcgccgcgacatccttgactgctccggggccatgggggatgaacactgaggtggacttggaggaggccccaatctccttcatggtgtcaaagtactgggtaacaagaaccatgtccatgatatcctttgcagtggttccagggacattctccgagaaggcgagcacgctgtctctcagcccatccactatggcctgacgctgcctcgcgataccgacaccagccaggtacttggactctgcctctccttcagctttcttgatctgtagtatcttctcggcttcggctttctcattggctgccaccctcaatcttgcagctgctcaacaataccataaatcaagatgttagatggaaataattctgagtacatgttacagaatcaatcaaaacaatcaatgtgtaaatgattatgtgattgatggaaggaactattgccaactcagtattcccaaaaagctattgccaactcaatctttggcgagaagatcgaaagcaagcaacaattatgcagggaaagggcaatggttacttgcctgcgttgatctcattcattgctctcttgacatggacatcaggctcaatatcaatgatcagagtttgcacaatctcatacccatatgcagacattgcctacagcaatcataaatccagtcagtccaaaaacaaatgttttcttgtctctaggatagcaaatagtagacaaaccttttcaagctcatcttcaacagcctttgcaatatcattcttctgctcaaatgcatcatccaagttcagctttggaacagtagctctaatgactaaaagataaacgatgtcgcccaatgagaaacgtagaattcctttcgttcactaattaaaaacttagcaggtatatatgatgctcaaaactgaaactgttaacttcaactagcctagcaaagaacacacgaagacaaaactatatatgaaaagagatggggacttcgacatgtgaaatagaattttcagacagatggaagtgcagaacatttaccatcaaagacatacgactggatttgttccctggtgttgcttagtttgtagaaggcatcagatgccttgtcagcaagagcacggtattgcacagatgcaacaacagtgacaaagacattgtcctaaattcacaaagatccatacattagagctaggaaaaaatatacctagtgagttatctcaaaaatgttaatgaaatatttctgttcttcactcatactgagttagtgagttatctgggtttcactttataacagaaatatgttcttcactcattgttcactttccagcaaagcatgaaaaaaagaaaaaatagaacgagattggagtaaacctttgtctttgtttcgcagcggacatccagctgcttcacacgcagtgagaggtaaccagcaatttgctgtcctatgcaccaaggtaagaagtggcacccaggctctagaacctcactaaacttgccgaaattttctttgatggctacagttgactgatcaatctgtactaaacccaaacactgacccatgtcttacctgcaaaggaaaacgacttaaacttgaaagatggttcagatactgcagaaagtataattttatttatttatcatctcacaagtgaagcttgcaatgcaaaatcagtgaaggtatcactgaaaagcgaggctacaaattttaggatatgcttcacaataatttgtacagattgaagttaacagtcccaactcccaagtaacagttagaaaagtgtgaatcatgcccaatcagaatgacattacatgatgacaaatataaagtagttcgtaatgcagctcaatgctttgaaaattagtaaatctgagacaccacaaaacagctcaatcatatcaactcgtggcacaatatcaaattcatcccccaaagaactcatcccatctaattatttcaaataagcgcatgcttgagacagtaaaaaaagtggatcatatgcaatcaaaataataatacatcatggaaacttaaaatatatatatacatatgaaacaccacaacacctcgaaaaataagtcacaaaaaaacattcagcggtatccgttagaaaaactcgaatcactaaaaccaactgatcagatcagtaagcaccgcaagacaaacgagtgttggcatggcgcactaaaagaacactgggatcaaaggaaacgatcgccaccaagatgcaaatttcttggccacctaaaggcaaactaaactagcacacccaaactacataaacaaacagatccatcacacaaacccgcaaaaacgactctcgaaccaaagctttttagtagggtttaaacacgctgaatataccccacaaaaaagaagaaaatatttcttccactttaatttttcacaagcataaccatctcacaaaatccccccaaagaaccccaggcccgtgcccgcattaccaaaatccatctaatactcggagaggagatgaaaaccttcaagaaatcctcgaaaaccttcttaccttcgatcgaggcagaggagaatccgacgaagaattcaaattcgccgaagtaaacactgagaggagatgattcgtgagcggttgcagctttgatttgctttggggttttgagagctccatcgtgtgggggtctatatatacacacagacgcggccgagaagtagaggcggtgctctttaatttaattaattaccgcgatggacggcccagatcttctctcgatgacgatcggacggcggtgattcgcctgtccgtcgaatatggtagtcgcggatacttcttggtgacgggaaaggactgtaattaggaaatagttttatttttggtcgatgttttaagaaagtttctagtagggttttattttggtccatatttacaatgtcctgatcgatatatttattaccttttcttttagaaaatgagataaaatttgggactacctatatttatagttatagcatcatatttttcaccaaaaaatagttgacatgtatttacattgtaagttcctaaattacatatgtaattttaatgtaagtcttaaaattacattacatatgtaaataccaaaattacgtattaattacatatgtaagtgatgtgtaagtggggtgtaattttttagataatggaagctttattaagactcagtcaaatataccaagatgatacatttcaactgagctcacccccggcctctgcataaaatgcacacaaccaataaaaggacgaaactaaacccccatcacgaaacatagatgttagtgactatcaatccgtagactagatcgccacctatgctcttgggtaaaaacatcccgtgccacctggtccaaacgtcgagataccaccgcaatagtatcctgcaatcccggtttgtggaggatagcccaggtacgcagccaccgggtaactagagtaataacctgtaaaggagaagacactaacttgttataaaaaaataaccccgtttctgcttagccaaatggaccaacaaagagctgctgcacccatcaaaagcagatttctcatttctttaggaacacatgaaagccaacgcccaaacatatgagtaacatttcaaggaggttgaaagttagaggccatatgaataacggaccataccaaacgagatagatgacattggaagaacaaatgttgaatggtttcatccttatgacgaaagcaacattttttactgcctttccaattttgtttagctaggttatccttggttagaattactccccgacgtaagtaccaaagaaaaacttttacttttagcggtactttaatcttccaaatacgtctattaatatttgggacgtccgtatgaacaagagctatataatgtgaattgaccgagaagaccccagtgggatgtaattactgtgcaaatttgtataaatatataattagaataacaaatttgactgctacaaagacaggaggtggagaaacggatgttcattgtgcacacgatgtccagcgcagcgcatccaagccattaaaatccaactgtactcagccacgtaatgtagcgacactttttcagcaaatccataaaattttggtcgagaattatggtggtaacattgacaggttttaaatttttggagtatattttccacgaacccaccgggaagtaccgtgtaaactttcaatacgagaagagaaacaacatagactaaaaatatcgtcgattttctaaaaatgagttatgagatatttctaaatgtgcaagcatctctctgtcacatttcctttttatgtttggaaagatgtacaatatatatgaaaacaggaatggtttccaatggtccatatgcaatgcacatatataggaagattatatccctaaatgatgacctgcgtgaattaggaaggacacattattggtataatataatagcactggcacacataattggatcgttcctcgcaagctactatcttcgagtaatacttgaaattgcaagtggcatcctgcatcattacaaggcctaattgaatcagcctttaggttagacgttcgatcgagaggcagtgatacacaaaccaaaccctctgtttggaacaagggaataaaatcgaattttcgccaccaaaattcttccatcacaaacatgactaaatttgtgagtgctgatttctgagaaaacatatggtaacattctaataaatagattattcgtggacacgaggatttgaaattacaagcaatatactaaagagaacttttcaaagatatatctttagaagcgtggagcaagtaatgcacggcaataatctggtgaatacgcagaaaagaacacaacctcacattcacagcgtgttcatgagccaagaaaatttatgaccatgcaggaaattcaggttttgcaccttccaggaaacagtgtaggaatgatggcattgccttctttaagcgaaatgcaggtaaaaccgcggggtgtgtatcactatccgtttctaggcaaaacgcagagaatcacgttgcctctgctgcaggtctgcaaccaagacttggcttgctgcaagaaaacagtatggctctctgcaaatatgcatccacaagagaacaagagatgcacagctgggaaaatgcctatagatcaacaagagggcattttttggagaacaataatgcactcacaacagaaccacattggcatatctaccaaccatttttgcattttagggtatgtgcagtttcgcataaacagtctggtaggatgcacctatgcctcctaaatgatgtaagggcaatcattaggaggatcattgtgtaattaaattaaccaaagctagcttactttggaggaaaaatatatagaaaagggtctatcagcatccagttaaaacctcagtgcaaacatccacaagggaaatctggtacctacagctccttttcacctatatccattttcacatgtcaatctacaggaaagatcaattcagattgcacaacaatgttcagccaagccactcagccccccaaccaagttccaccaactagaccaggattctctagttatttcacgttcggcttgggtgagtagcggaacggggaagcacgggggccatcggacaggctcctcatcggttgctgcccgttccgagcaaatgaaccctgcaccttaagggcatggctcctaccattcatgctgcttgagtgcgccattctctcagcttgcattgtctgatagaagtacgaggagctagccatgtccttgaggttgagcagtggcttgagaacctctaccacttggctcatcagtggccgggctttcgggtcccggttgagacaagcacgtgctaactgtgctgccttctgggcacctttgaccgagaagttaccctccaaacgagggtcaattagcttgtagaagcgctgcctttctcctaggagggggcgtgcccactcaacaaggttgtgctcaccatttgggcggttcttgtccattgacctgcgccctgacatcatctcaagtagcaccacaccaaaactatagacatcactctttgatgtcaaatggcctgaaaagtggaaaaaatacaagaaaattataccaagagtcataatgaaaatcgcataaaataccaaaggcaacaaatctgtgtttgaacttcatttgcacaaataatcattgaaaaacccagtgcccagcattagcctaatattcaaaaagattgttgatgatatgcaggcaataatacattttcctggaaatcaaatgaatgacaaacatctaccatatggacaacatcacttaactctacagttgcactcttagacatatttgttttgcccctgcaaatgtgttttcacaacagtgctgggatttctaatcaaacaagacgcacttgtgcaactactattaattgtaatgacaagtaattaaatattatggtatttcccttctacattattttcccaagatcaagtgtaaaggcttaatatagttcataaatagagctgacattaattacattaatcatagccaaagaaactaattgatacactgtatacatattattaattctaggaagaactaactaaaatattttgtatattacattcacaatattttgtacattaaccactaatctactatatcatgacaattcttcttataatcatttccattccatagatttaagtgtcgccgataagagagaccgaaagaccatagggtgcataagctgatcgttgatgcaagaactgtaatagtaaatcgccatagctgacttgtttttggcatacataggagagataaaacaaagtggaagtggaactatcttcagaccagttatgttttgtctgagtgatgaccagggtttcccaaaccgccggggccagggttaccgcaccccggcagtaagcacggttaccacgcagtaaccgcgataaccgtgaaaaaccatacaaaaccgtgcaaaatttatcaaaactttaaattattttttaaatttatttgaatttaaggaggttactgcggtatttatattaccgtacccccgcggttaccggcggtaacgtcaaccctggtgatgactgatgaagcacttacctgtcataacatactccggagctgcataaccatatgttcccattactcgagtagacacgtgagttttgtcacctacagggccatctttggcaagcccaaaatctgagagttttgcattgtaatcctgcaagagtagcataatatacaaaattacaagatgtgaatcgtgtggtgtgcaatacgtaatccaattcaaggacttaaaacttacagcatctagcagtatattagatgttttaaaatcacggtaaataactggtctttctgcttcttcatgaaggaaagcaagaccctttgctgctccaagagcaaccttcattctgatggaccaagggagaggaagagaccctataggtgaatcataaatcatataagattcaatatttctatctatttaatattttttccagcagcaagatgcaatgaccaaacacttcagaagagctactcaaatatgaatgataagttcattcattaaagcacaggcattgtatacaaattgaagtttcaatgtcttgagaaactggtcagacacgtacttctgaatagatggttatctaaacttccacgaggcatgaattcataaaccagcaatctttggtcatcttcaacacaatatccaatcagcctcaccaaattgggatggtgaaggttacctaggaaatcaacctctgcctgaaacgaagcagaacaaatgtcagtcattgggggttctaatgggaatggtaccaaacatgaacggaacaaaagcaatttgaacaataagaataacaaagcacataccacccattctttgtgcccttgaagcccatcatgattgagtgttttgacagcaactgtaaggcctgtaccaggtttcataggtgcagttccattctcttcaatccaccctttaaaaacacatccaaaacccccctctccaaggatactctcaggcctgaagttccgggtggcacattttagatcattgaatgcaaacttgcgcaactgtgaggcaacttttatttcctctccagctttagatgctgatgaactgctctcagcattactagtagttgttgagcctgagactactgatacaactggatggttcctgctaccattttcggttgacttttctgctgttccatgaaatggataacagttttaatatggcatactaatgagaaacgaaagaccatctcctcaacaataaataaaccccacaacactaattcagataaacacaagtaatgaaattggcaaactgtacagtaacttctgggatacagctgaaggacacagtgaagtgtaaagtttagttttggtctttttgggtatggatcccaagaaaatacgactttctcatgttccattcattcatgtccatcaatgaatgcttaaagcagccaagcagccttgatgagtgatgactcatgatttcaaacaccacatctgctgtcaaaacaccatcaaagtcaggtggctgatcctaacatatcaacaaccattcctgactggagaaaccaatggtgctcatttatgtgtgccgttctaattaatttgctacgagattaagtgtggcatgcaaggagcacgaacaaccacatgccacactaaaaatagaatagaaaccccaaaagaacactcatgccactggtcccatacagtcgctcatccaatatctatcttccaatttaaacggtaataggtagtaatgagaactacagctcagcttgaaatatgatgctggatgatatgtatgatttgccgactgtttaccgataattacgtgtcctacacgcttgtcgtaataattactagtcaatttgtacattcaatgcccaaaacagggacgcgcgcaaagcgctgaggattctaagtacaaaaacatagctgcactcagctctctacaaaactatatgcctatgcatacgtactcgacatttacattctaacctactataacctcagcgctaatcaaggccatgtggttacatcacatctaaatatccagacatatttatggccaaaatccatttacataacagattccaaattccaattatagtcgttgcaggttagctcatctttagaaaggacgaaagggacgttaccgccgtgcgtgctggcgctgctggtggaggtgtccaccttggaccgcggcggcggtgggcagctccccatcggccacagccggatgcagcacccggtggccaccgtggcgttctccccgccaccgccgccgacgctgcccttccgtggcagccgccgcctgctgctcccgctgccgctgccgctacggctcccgctgcggctccggctgcggcggcaccacccccacctctccctctcctcctccccggagctctaccacccgtcgaactgccccagctccggcggcgccacccccatccccacctcgcactacacaca

SEQ ID NO: 14515 - DNA, 15501 bp, Oryza sativa
  unsure (1)..(15501): unsure at all n locations
aatcaaaccaaaccaaatcaaatcacccccacctacaccaccaaatatgcctcaaccccaccaccaccaccaccaccccccatcctcacccaacccaagctcaccaccacgcccggcttaccgcagcagctgaaccaggtagacagcaggacagcccacctgcctcgctcgccggcggcggcggcggcggcggaggaggaggaggcggcggcgagaggtggagggggaataagcggagagaataatggatttgcgtcaaaagaaggaaggaaggaggagacaaggaagcggaggaaaagcacaaatgttcctcgcttcgcttcacactctctctctctcttctcttcgcttttttccttttttttttttttttgggctgcttctcttcttcttctcggctttaggggaagggagcacgtggtctacgtggaccgcttttgcagcgtgcggcggcactgtcggctggggcccgcggcgaggggtggggcccaccgagccgatgtggcgctgacgtggacgtcggcgtaccctgcacttctccctccgtttcgtcattttaaatcgaactttttttaaggtttaattaagtttataaacaaatttaacaacattgagaatgttaaattaggtttattaaaggtaatgttgaatatattttgataatatatttattttgtgttaaaattttgttacagtttttttataaagttagtcaaaataaaaataatttgattaaaaagtaaatcgtaatagcttagtaatataaaacaaagagagtactgtgtaatcttgttgtttttgcagggaatgattggggataggggggaatgaagggctgtccctttgtgagatttttttcttgtcccagttcgtcggtgaagagattagagatgtgaagggttacagtgctactctcgtcgtttcttagtttgattttgttggcgtccaaaaggtgtcacaaactcataatttgttaacctagcgtttgcttgattggttatacacttttattacttctcgaattcgcatatggtggactctaccttttttttttagaacatcgtaaactctactggcatagttatctctaacttattgttgcccacattttatatgacatgttggcatgtttcgattagtgctaatttataccatacgattttttttaaggtaaatgtgataaatatatggatgcatttagtttgttaccaaatattagtaatatctagagaattttggcaacaacacatttagccttatcaaaactttacattgttatcactttactaaaattttggttttgccaaatttttgaaagttcattttggcactaatctaaacatgcatgtctcatccctttgacaaagtgaggtggagcagggggaagcattagcggtgtgatggtggagtcgtgatgcatgtctccgcccactacgattcaagtctagtgtcatgaatattacgcgcatataggtgggttttaataggaaattagtgagttcaatgcacatgtccagataatgcagcgtgagtgtagtgtgagtgttctatagcacatgacaccaagatgcagtccagatatcatgtggacaacgagaggccaacggtgaggcatgatatcttaggaaaagtcatgtgctcgggttgtgcatgtgcttctttatgcgcatcgcacaccctcatggacttcttcacgcgccgtccatgcgctcgtggacttcttcatgcgcatcatatgcccttgtggatttcttgatgcgtgatccgcgctctcggggatttcttcatgcgtgatccagccattcttcggcggtgaggagtgcacccccgccgagctccgcctcatcggcacgcccatcgtctcagtcccgcgcaccgaccggctctggcgcatgttcctcccgcccgccgccgccccgtgctgtttcgccatggcctcgccgtcctccgccgcagttggtgacgatgacgcggctctcctccccgccgtcctccgccactcccgtcgcaagcgccgcggccgctcccgccgtcctcaagccccggcggccgacgccgccccgtgcccctctgggagagaagatagacagagaagagagagaagacagacaagagagctgacatgtgggcccaagggcatttttgacatttcacatgatttctctcctcttcaaccggaaattattattctaatcgacgcggtgtccattggcaaattaccacgtttatggagtattttcccccaaaagtgagttcgagcggtgttccacggctaaaactacgaagtcgaagtgtcctttagcaaaatttgccaaaaatataaggcacattttgtttaacaaggtaatccgtattatccaagaatttctttactaatatattatttatgtgacactttttttactaatatattatttatgtgatttcaaaaataaaatctaatatttttaatacgaatgcaatcacattaatttcgtatacaaattatacctaattaactaattgttgatcgcccaaatgaaacataacatgtctaatatatttcgagggagggttatagctgctcttttccctcaccttccctcctccatattagcagaaacctatataagagatatgctaattcttgggtagtagcagcggtgaggagctagctcccagacaggtcggacggctttctgggttcggctgctagcgtcttccttatagatagctgttgatgttaaaaaaatcgatcgatcaccaaaaatattagtattcgctcgggtttcacgacatcactagctccatcactggttagtagatttgaaaatctgtgacaaagcaaaacttcaagtacacgttactattaggtaagttggttgcatcgtgtgcttcttgtttttgcatctccgatccatgacgtccattttgctgacgtgactgtcaattattccgaccaaatatcaaaacgttcgtgttgacaaaacggccacatctaacatgcactctcacatgcaccggcaaaacggcgctcgtttgactctcgtggagtcgtggttaatttaatcaaattttcttctttcttctgcgtattccaaatggccattagataaattaagcaaagatcggcatggatttttttttgcagataaaccgatcagcatcggaagatccaagtatgcttcaactgcattgcattagtcagatcacacgtgctcttttggtgtaaatagtacatggtctcacatgtatcttgcattgcattattgccagttcagctcaagacataaacaacggttttagagaaactccaggtcaaatggctgccgactaatctcccaacccagctggtcaacgttgggttccgtctccacatgctattagaaaaataatttaaaaatagcatccaatgtgtcactgacatcagtgacatgtgggtcagtgagttaaggcctcacttagcaacacgcattggatgcttatattttgtaattcccgcatatctgcaatgatatattgagtcatttgtacatttaaaataaacaaaaatgttacatatgggtacttttttttctgatgtatgagaataatatgtttctgtacaaccacaaaagaatcatatatgctaaagtcaagacataaaagaatattagtcggcctataaatctcacaatattatcaatgcacaaactaactattatcactggatgcctttgctcccttggcaacctttatgaagacatcctccaaggtggtatcaaccaggccccaggcatgcacggtgaaccgtttcttcgcatcctcaactgcgcgaaatacctcggctattttcacctcttgctttggcagctcgaactttaaagaatcatatatgctaaagtcaagacataaaagaatattagtcggcctataaatctcacaatattatcaatgcacaaactaactattaacactggatgcctttgctcccttggcaacctttatgaagacatcctccaaggtggtatcaaccaggccccaggcatgcacggtgaaccgtttcttcgcatcctcaactgcgcgaaatacctcggctattttcacctcttgctttggcagctcgaacttttgagttccagataggtggtagatcttatttgcgctcggagacaagtcatgaactagccgttcaacctcttgttcttggtctggagatgttgtcattgtgaatatgtatgctcccccatatctcgcctttagctgcattgtgcaaatgaggttttagatctggtcataaagcacacagtgtgattcaagaaggcaataaaatgtacctccttaggatttccaagacattggaaatcgccatcgacaaagatgccaagtcgatcacaaagtacttcagcctcctccatcgagtgcgctgcgagaatcacatttgatcaacactatttgatactcttgtaaattttaaaatcaataagtgacgcgttaggaatctaagaattggacgcgaaagtagaaagggaaaaggataagtactagtaagaacgatcgcacggtttcgcttggcctccttcacaacattccacaagttatttcttgatgcggggtctagcccagtgcttggttcatccatgaaaacgacctacagaatgtgttgtcaggttgcataacacattaacaaaagaacaaaaggacatcctatggaagggttaaaaaaatatacagaaaagtactttggggtctccaatcaatgatattgccacactgagccttcttttcatgcctccgctgtactttcccacttgcttatcaccaacaccaccatggaacagatttacgctcttcagagcatcctcaacagcctaacagtggaaaaatcccagacatggttcaaatacaagatgtacatatgctgagatagctgagcagtatagtttatgaaatacgtgacaaaacaacttcatatggtcaacaatgaaatgtggatattaaatttaaaaataagtgaggcagagtagaggtaccttcaccaacacagcacctttaagattcttcagcctgccataaaagaacagatgttcttttccagtcaatggttcccaaagtaagctgcatttcagattaaaacgtattactataaaaaaaataatctggtctgggaaagattctttttggtcagataagtgctagttgtagcaaatactcatgctgtgggcacacccccatgtttgtatatatgtgatccatatccatattgatatccattccatgaacataggaagtaccagatgtaggtttaacaagcccaatcatctggtaaaataacaaaacaaggttaataaaggtgagctgccacaactaagcaattttcacaaaaaatggtaccacgtgccattttagtactataccatactaatgaaggatgttttcccagctccatttgggccaagcattccaaagcactgcccttttggtacggcaagagataatcctcgaaccgccagcttatcagggtttccatcccttccaggatagatcttcttgaggttgtgacatataatagcttgatttgcattgcggcctaccaaaagttgctcaactacttctctctggatagaatttgtataatgaataaatttagaacatatgtactccattaaatctggactggcaaagtatagcaggtaacctacttcttgagcaacatctggcttctccatatcgacaattactttagaaccctgttgcacaaagctaggcttctgcaatgacggtgtgtgcttcttctgtaaacacctgaagaagaataagggccttttcctgacaccaccacctactggagagacttgatccaaatagaatgctaacataaggagaaatgcccattctactgtcatgatgataaatataccacacattccattgattgggtctctcaaatttccccatgtcatgccagaggctcccatagcacttccagagaaagcatattggccaagttcatatagtcctcgatagagggaaaatcctgggacaatctccattactaacaaccaaccatctgagtagaaaacaaaaatgcttgttacccatattatgtaaattaagttgaaaaatacaacagatataataacttactgggaaaggtcctgtcctcaacaaagaaacgaaaaagaaatgcccctagcaagccagagccaaatacataaatgtatccaatcactgcaggaggaaatatgtaatttgtgacttccagtaagaaacattttggacttataacttacaaggttgaatcactaaccagtggctgtcttgacagatgaaaagaaagatgccacaaaaaatgcaagtgcaatctgcaaatttatataaatgaagaagaaagcaaactgtatgctgtagtcattgagtctgaagaaatttagacctacaaaaaaaatctattgaaatatctagatttatttgtcagaacagcaccttcgtgaaaatagattggaagaaaattaccaattaaggagccaaaaatcacaaaaaatgtcatatagataaccgatagagcaaagaaataagcataagaaattagccagtaaggcccatccttcagaccatgcatcttcatcataatttttagcttttgttccttctcatacaccagatatgtcaacataacctggaaaagagagtcaatttgcaagctgtacaaatcctgaccataacacactcaacactccctttttcttttgcatctgaacttgttaaatcacatcatactcactgggaaaagtagttcaactatccatgtgaagaatagcacactgagaagagaagagagatcaagcctaaaccttgttccaactttgggcatctcttttacatattcaagcagcatatccaccccacttcctctgataaattttaggtatgcattggatatctgcaggaaacaaagcataaattgctgaattgtcagatggttctgtaatacaccgaaattactcaggacgaagttatgaaaaggaaaacatactgcattcaccaatcgtggaactcgtaatgctgcgataaatgaatatgcagtgttatcattataagtagagttgtaccaaacatttatattgaggtcatatcctgtcgtgttcaagaagtcataacctgcagagaacaattaaactatacagcacacatcattgcaaataaccaccaccatttatacgaaaaactacatttgttatgttttgaagcaattatttggagatggggccatggaattatctgtactatgtgtggcattcaaaagcagtctgttggaaggtattcaaattcaaaatgtgaaaaaaaaccactgttacacaaactcattctggttgcaaattgaccacaaaatggtcacattgagatagaaagataacctgcaacaaactcatttgtttctcctcctctttgtacgtaacccttaaacagttcatagttgataactgatgcactttcacgccacaacatctgaacttcaatacactgtatatctggttcattcaacaggacatcagaatacaatctaggcagccctacgaaagagtctaaatgaacgatgaacatattgtatttattgttgtcaaacagactgcataaatagttaggaaaagctacactacacaacgtactagacatgtacaagtctcaccacacaactactatattccattatctaaaaaaactagttgtcttgtttctgtttgattgtattgaaagtagaaaccatgcaaaatgaataacagaacaggaaaatattttttagtcccttcaaatgtaaatgaatttgtacaggaaaagttttgaattgcatatttgcatccctagcctgacttactagcaaagtaacttaagtttttcaacacaagtcacaaattcaacattgcaaagaaggaagctttaacttaccgatatgtaagggtacgccccctgcattgtatggaatggtcccaaacatgaagggcatgcaacgaggctggagaagatgcaaagttttaccagaggaaaaagcgggctctagcaattgggtataccatggctgtgtgtctgaaccctatgacaaatcagtccaaccaataactccataagctatttttcaagaaaaaagcgtgatctacaagatgtatactcatgcagccatcgaaggaactcacaacaactatcctggagaggatatcaagatagtctgtcacttgagagggagaaaagggaggaggcatcaggtagtctgtcacattaggcaacggataaagggcaggaaacacccgacctgaaacacctgtcaattggaagtactcaagaactatgaacacattcacctaattttttgaaatatgaaaagttcaagtattcattttagcaatcgatcagcaatatggaaaatatgacacatacgctcagctaatgtttggttctctccagtgacgaggagagtgacagggcaagacccgtcgccacggcacaatgggttaggcaaatcgtcgaacggctgcgatgcggtcccgacagcccggaaccctggccaggggacctgaatcagggccggccaccgtggtgggctgggcacctcgcagctccatacctgctccagcgtcgagtgctggatgccgcactccttccgcaggcaggtcccatccaggtcactctcggtgcattcgcagccgcactggtacttgggcttgtcgagctccccgttgatcacgttctgaagcacgacgagcagcacgcagatgaggatcgggaagacggtgatgccgacgttcgtcttcaggttccgcctctgcacccgcagccaaagagacaagaatcagatgccaccaccaaaaaccatcaaccatatgcctcccaccctcccaagaacacagatgaaatcgatggctgcccatcatccatccaaaagccccaaaccagagcagcatgattaaaccataagaaccgggcaggcatatccacaaacacgtcgcgggcagcaaggcagacacagagaagggatcaatcggtgcggctttcctggaagcagaggttcttgcggaggagggcggaggcctgggtggagaagctgacggggctcctccccctcctcctcgcggaatcgtcatcatccatgggagaggcggaggcggaggcagatggggagtagccgctacgcttcggcggcggtgaggaaaaaaagaggcgttcggagttgggattttgagttaaaccgattgattgggtttggtttaacttgtcgcggtttatatatgccgtcgatttctcggctcggctcggctcccgccaaatccgctttctccgtcggtgcttagggactagggactgtctatgctatcgattaaattgcacgtacggtccctatactcgtatactactgtcctgtttggagaactaactaagttattttgaaagctactattttttatacaagaaaaaaacctttaataaaatatccctaagttgtttggatccaaggattattttgagagctatttgacctttaatgcactttcctatgatttagatttatgaactactccctccgtttcgaaatgtttgacaccgttgtctttttagcacatgtttgactgttcgtcttattcaaaaacttttgtgaaatatgtaaaattatatgcctacataaaaatatatttaataatgaaacaaatgataggaaaagaattaataattacttaaattttttgaataagacgaacggtcaaacatgtttaaaaaagtcaacggcgtcaaatatttcgaaacggagggagtattaaaatatatttttgggtttctgaatttatcatggtgagtgctatatatgtctaaatagggttcactccgcttcgtgcagtgacgcaacatgtcatgtcgatacgtatcatccagggtttgcgaaaccagcggtaatcgctctgccaaggtcaaaatcgtggtaacaccgctaaattcaaataaatttaaaaataatttaaaattttgataaattttatatgttttcttgtgatttgccaaggtaaccgcgtgcttatcactagggtgcgctaagcttgctcccgttgataagggaaaacccgcgcagtcacatataaaaagaactaaaaatatattttcttctctctgttttttaattttatttttctatgtaactgacacgtgggttccactaatatatagatgccaccatggcatgccacgacatgttaaaaaactaaatatgtgttttgagagcttaaggaaatagatgacatatctacacaagcctatagaccacccgtgcacttccctctgaaatttatatgtagtacgcttagtgtgtaattatattgtaatttctataagataaaactatagtactaactttcaaaacccagtaataacgcattatttccgtcaagtgaaggtcgtggggccaaacccattcatcccgatggcgtgcgctgtaattttttcatttccctcctgcattaatcttgaagcaaatataacgattcaaaattatgtaaaagtcgcatacaagttaaatagcaattgtgtataaattacaatgtaaaattattaggagaaatttatcgacaagcaaaattgtgttgcttattgacatgaagtactgaccatagcggtagtatattgcattattgttgttaccctcgtactccctccgtctcaaatcaaatgcgagattgatttatttttttgacggagggattatttaggtcatagcagtagtagatctacaggatgggccgggtaagggttggagttgggccaatcaaaagcacaactttcatgggccgagcatatttgtccggttctggcccattaaggatatcgggccgatgatttgtgccagcccgattaattcgggtgaagttgatgctattggaccttttttgggcctgtttttctctctctctctctggtttaacttgcaagaagccattgagacggtgtagggcaaactgaattttatgacggctgggatgtgacttgtgagaattatcgtgattcaaaagggtacggatgattaaaaatcaaacggagttttatgggaattaagttgatatacataaaaatacgttcttttatcatttgaataaagatgattaaaattctcatagtaaaatgggaaaaaatatttgcttcaaaccagtgcagatggtatattgattagtgaaactaccatagtactctgcatttttcttgacagataatgtcattaaattttgatataatattcgaccattcatcttattaaaaaatgtataaacgttattattagagaaacttttaaacttgacttatcgttttgcgtgcgcacccgcacacatatatttttttttaaaacaacatgcccaaagttaacggtgtcatctattataaagaaatatataggttcaccctatccgtgtcacgaaaatttcttgcgcttcaaaggggtcagtagcatactcatgatgggctcgtcctaatgttcttcttctgagtttgaaagatttgtggaggaaaagtggagggttcaacttgctataggaattgataccagctattcactcattcgaaatggacgattggggtataggacaaatagaggaaatatatctttgctacagatttcaaaggaaaaacttagacatccactacaacgtactaccaattcttttttccttccctaagttcaagacaaatcaattaatgctcaaaacatcctgtgactataattttttcaaaaaaaatcataaacaagcttgattgatttaggctgtgttcggaagtatctcttcccaacacgcgcagtacacacggaaaacagagcggtccattagcgcgtgattaattaggtattagctaatttttttaaaaaagtttgatcactatgattttttaagcaatttttgtatagaaacttttttttttataaaaaacgtaccatttagcagtttgaaaagcgtgcgagtggaatacgatggagtggggttgggaaccctgggttccgaacaaagccttactatgattctatgaaatatttatgtgtttaactaatcccttcaaacaccatgttttactttttttctatcctgcatttcaaataaaccctcaataactagttgaatcaagctttatatcttttaaaaagttatgttttcactgtactgttgtcgctggcggcgtgatcaaccatccacagatgaaatcgtgttaaggccgccagcgatggatatatgaccctattcgtaatagtgccagttgctcttgaatgctagtagacgcaagcttagctacgcggagcatatgcacgaacacgttccggcccatatctgcacctattcaagtatgggctctcacgttctcggcagttactcttattattctacagtggacttagatgcatggccagaatgaggttcttgacaacatttgcagatggcatacacaatccaattgtccaagaggacacgttcaggtaggttaagctatgcagcatttactggttttgcatcatggcaacaaccaacggcttgtgcataggggtggtaatatgtgcccaacattttagcctacaaaatatgatggctgaaaccaaaaaagagttaggctgaggtttaatgagctaaaaatatttaagaactgaaatgggttgtgaaaaggtccatgagccttaacctattaccacccgctacgtgcacttttggagactttgttttggaagggccagtcgaagttagggcagaggtagagtatgggagggggagggtgcccacgaacccgtccaaaaaaaattttttagcctcacctatttttcatcatgcatgtgtgcacccctcaatataaactttagcacccgcatcagtttacacttgatctaaaatagaacaaattaagctttactccgtttcgttctagcgtggaccccggtcctgttacggtggtcaatagaggtggaaataatatgtgcatgtgttgtagctcgttgtattatgaaacttgttgtcatgtcgttcttttaaaaaataattgtaggttgtgtgcatatcgttatcatatcctatttatatatacatagaccgatcgagcgtgattttagattaattacatcaacttaatatagtagtatgatatgaacaaatcttactttatcttttaaaatacttcacacattcttcttcagtccattaaaactttgtttaacttacgcctccaaattggcatcgtatcttagcactcgatccgtaacttggaggcataagtttacttctaaagaagtactcccttcgtcctaaaatatttatgaatgaatatgatattctgaaacggaggtaatacttaatagaagaccgacaatgcggtaacacggttgaggcatgcatgtaaaacatacgtagtattatattacggttggccgtctttattacatacacatcgtgtattgtttctatacatttgatgcgaaaaactattttgagctctaaatagcacgtgccctcattttttatatccagcggaaatgattacaaaatatttcggaaaagttaattattgagccgcagcatatacaaacaatcatgtcgtatacatccatgttcgcttgttttcagctatagattttcctcgatccatggggcccagttgatctaaattaaagcaaccactgatgcacatgcagcttcagtcactactacacactactacaggaatgattttcctaggcaggagtcattttaaattgcagacggaccttaagtggtcgcatctgcgaaaatcgtgctacattttcgtgtgcggctctctaagacgaccgcacggaaaaatcaattttcctagacgggccacttaacagggcttattttctcgtgcggacctgttaagtggcccgcacacgaaaatagccaccgaccttttagatcgccctacacccaactatctcctcccctcgccctctcagatcgccccacacccattctctcctcccatctccctctcagcccccacacccactcctccctccctatccgcctcctcctcccactccttcctccccctatccgcctcctcctcccacttctcccatctccggcgacggcggcggtggtctcggctagggcggcggaggcgaccattggctatggtggtggcggcggagcggatccatcaccggccgccacggggaggcctgatccgttgccggccaccgggagggggggggggatccgtcgccggcgaccgtagggggggggatccgtcgccggccaccgcggggaggccgaatccgtcgctggcgactgcgcggacgacgacgacggtgacggtgtttttgattttttttttgtttccatttgttatttttccttgcgggcggcttaagcgcccgcacatggaaatcacgattttcgcgtgcggaaaatcagtattttctcagacacctcattctagacgggtggaacatccgcacgcaaaacccgattctaaccacacggaaaaatcgttattgtactagtgagtggagaagccaatcaattaattggagatttacaaggcaggcaaaataatgccgttccatttggtcatatgtcaaagaaagctgcaaactagtactagtacaagagaacaactcatcactgaacgaggtgtctgcgaaaatcattcactactctaatctgttcagttccgcaccattcactatactaaacgtacacgcgatcatatggtaaaaagagtactacaaactttttgtgtaattagtagagagaatataggagtacaccttgttagctgaacacttcttaaatttctttgctggcgacctgaatgcatgcatatggccggtcattaattaaaaggtgatcgatcgatcgattcatacacaatcacactgttggcttgattgagatcgattggttgcttggcttgattgcgattggtcattaatttggttgctactatatataactgattgggggcaaagcattccatgttcttgctcactgtacaacgacagaagaaagacaacctctgcatgttcatcaaatatgggttcagaaatttcagaatctacaaattaaaatgtccaactccaccgtaccggctggtcgcttggtcagtcctagatatgcatggacatatcatgaatctcacgatgtatatgcataataatttgaacaccaaaaacgtcgtacgtgcacaaccatcaaatcacgacaagctttcttataatcgttatcgtaatcacctcatcctgctagctttgatattgtcgtcgttatcctcctcctcctcctcctcgtcatcattctcaaccataaagcatcctcaatatatatgtttattaagtagtaaaagtgagacttacaaaactagatagtagttattttaattctcataatatatagtcagtaagctagacctcatatttataagagaaatagatgggtgaagaagagagaaggaatgagagagnnnnnnnnnnnnnnnnnnnnnnnnnnnnnnnnnnnnnnnnnnnnnnnnnnnnnnnnn

SEQ ID NO: 14516 - DNA, 5545 bp, Oryza sativa
atccccctcctcctcctcctcgtcatcattctcaaccataaagcatcctcaatatatatgtttattaagtagtaaaagtgagacttacaaaactagatagtagttattttaattctcataatatatagtcagtaagctagacctcatatttataagagaaatagatgggtgaagaagagagaaggaatgagagagaagagagttttagtatttgtttattgcttattgcctggtagtagtgctactatcgaatgatactactacccactttactacatggtgacttataatcgtatggccacacctgccttgagccaaatttggatattaacacatgcccctcctacctttttggtaaacttgtgaaccaaaaagcactaagcacggggttatctaaggatgatatatatcctctaatatcggcaagacatgcctctaagaaatatgtgttcatgatgatacaagaatactacgagaggccccgtcttgttcagattgtgttttgttttgatttggcctccactctttcctcggcacttttttgtgttgattcctttgtaacctattcttttctctcaaccacctatgagaagaacacgattgattattaaaaatcggtctttgtggcaatgcccataatggataataatacaatatataagtgggcatcatccatgtaccattgaagctccatggtgcataccaaggctaataccatgaagaaggagaagtaggttgtcgtcggtggtacgctctcgcttgtctcctaccttgcttggtaaataacttgatttccttggttgctcatcttttggaatcttcgacttgtcatattgccccccctgagttttgaagtcttcaatgtggtcttgtcctttagcaatccaatggtgcgtataggaaaaggtagctcatccacttgcatttttgtaaaagtcaatcatccttcatcaatggccaattgaatttgtctacggaatacattgcaatgatttgtggcatgagaataagagttgcgccacatacaatatactcaccgcttcaattcctcaagtgttggtatgacacggccttgtgacaatttaatttgattcttttctaataagtagtaaaaaatcctatcgcatttggccatataaaatgtgaactttacctcctcttgccaattcttgcgaccaccgacttaagagaggaccaaacgaatggtttagatttggagttccaagcccatttggttgtggatacaacaattgtctcatcatccgaagatttttgttgatcaactatattaacatgagggtgatcagacctgacattctatgcgattttggcttctctaacgcggctttctttagctagagcttttcgaagtaattggcttatatctaagaaactatgaccatataacttttcttttaaatattcaagtaaaccagaataagacaaatctatcagaaagtgttaaactataacatcgttttcttctgtttctaaatcttctaatgtattcaggctcattatatttttgtttaaccgattttaagtgcgtcaaatttaattcgaactcaccattaaagtagtcatgaaaattttgttctagctgagaacaatcatgaatagagttgggtgcaagtgaaataaaccaagtaaatgcagcacgagataaaggcaatgaaaaaaaggcaaagtttcaaaatactactagcactagttttaatatttgtttattgcttattgcctagtagtagtgctactatcaaatgatgctactacccactttactacatgttgacatagaatctagttgccacactttgagcacgttatgtgcaaccctcggcggctcccaaagatgcgctgccgtagggagtgggtagatgcttccgaacgaacacccgggaggtacctcatcagggttgtcggtgacatggagccgggagtatcatgactagagacttgggcaggagcaatcacccacgaggcctgaccccctcgggggggtcgggcccgagggtgaagtgcccgcccccctctttgtctccccgaggggtcggaccgcttccgtttcggccccgagggctgaggcgccccgaccccttgtgggtttggcgccgcgtgtataggttaggtgaacgcagcggggctcacctaaccacatttattgcggtttggacgagtccgtcatgccgcatgtaacgcagtgcagcacgctcgtttatccggtctgtgaccagtcacggaccgatcagatcgtgggttaggtggcgacaagcggtctgacacacgcctcgccccatcccgtcaggatgagcgcctccaagcactcgtccttagccggagccagcgtgttatctcctgaagatggcacgttgatcccggtcagatatatgccaggcttcatcctaaccattacaatcaagatattgtatgaagaagggcgaacatgcagattgctaaactgacgcgtggtggacaagaatgaccgatttatgaccggtctgacactggtcatgtcgtcagcagacagccatgatcccacgtcgcgcctgcttccggcggaagtggaggtaggtatgggccgtcccatcagaaggtgattcggacggcaaccatgcaaatctccgtccattcatgaagagaaggcaagtcaagttggtaaaaagagagataagtccccacacaaaaaagagagatggtgcatgtggtatccccttgagatataaaaggaggaccttgcccacttagaaaaaaaggaagaaaaaaacggacgaaaggagagaggaaggagggagtttgagttcttgagctctccagctctttgtagcttcttcatacacagatccaccaaatcacaggagtagggtattacgcttctcagcggcccgaacctgtatacatcacccgtgtcttgtgtatttccactctcgcgaaccttccacaaagaaggagcttagaatctcacccagggtccccggccgaaccggcaaaggggggcctgcgcggtctcccggtgaggagcccccaagctccgtcaagggtgaacgcgcgccgatttgtcctaggctcggcaagctagctaggatgtcctttggcgccatagagacgagagacgacaagcaattggggatttaaggagaatagacttaggataggtagcaagaaggagggaaatgtagaatataaagggtttggatactaaattgatttggacgattgtttggtggttgtctcaatcaactttagcccccttatatttttaaggagaggtggacttgctttcgaggtctttttgacgtccaattaggtgtagaaaccaattagaactctaaaatcttaggctttagcaaggaaactcgaaaaccgacaaatcgaacttagagttggactctgccgctctgaacagccacaagctgctggtcagaccgacctcacgtgacgtgacaagtctgaggtctttccaagtttgtctatgatttcctatttcttaccttagaaggtaaatttggatattaacatttaacactacgacctacttccacaatggtgaatcaggcgataggacttcttactacttactgtctccatcccaaaatataagggattataccgttcaaatttgtcctggaatatgaaggattttgtaatcccaaaacgatactttatttctcacatactagctaccacttttatactatcttatttttcacccatcacattttttactggttatttctctcatcccctttgctattttattctcccaaccattaccatttgaacctttgttttctatcattttttaaatttgtttcattaaaaaatatattcccttatattcaccgagggagagagtactttttaacacattgcggataccttattgctatagctagcggccaggagttaagtgggcctatctttctctcctggtagtgcttaggcagcacgagtagctcacaaataacgtgaagccattggacatggaactcgcagtgattgctccagcagcagcagcatgcagcagcggcggataagagcaggtacaatagcaggctataagctagctgtaaatatattttaaacagataaataagaaaagagaaagtcagcgggctatagatttatagccagctgtatcacggactccaagatatagtgtgtgtatgacaggtgggaccagatattaatagtgtagtatgtaactattgtatgaataagctattagattgactatagatgaattggaggtagtggttggctatactattaaacttgctctaatagattcagctgtagctagcgctgcatgatctgcatgcagtagtagtagtagtggtctgcactctgcacaacgaacgcgtacgcggcgcacgcattgatcgcgcatcacatgatcgatctgtcgctagctgtagatcgagtgcagaatcatgatctcctcttgcccctcattccctctcccaattattggctgtgtttagttcacgctaaaattgaaagtttgattgaaattggaacgatgtaacgaaaaattgcaagtttatgtgtgtaggaaaaaaattgaaatgtgatgaaaaagttggaagtttgaagaatcattttagaactaaacatggctattatcttcccccattgtcaataaaacaaatcctctacggattccggctagctagctcgagcatttcattttcactttttcatacagacctgccaactgtgagtttgctaatagtcccactgttgatccaatggtcttctacattcaactgaagagagagcgagaacaccaaggctgggatgactcaccatggatggcggcgttgatggcgacttccctaatgagcccttgaaactccgttaggtttcggctgtgtttagttcaacatcaaaattgtaagtttgattaaaattgaaagttaaaagaaaaaagttgaaagtttatgtatatagaaaggttttaatgtgatagaaaagttgaaagtttaaagaaaaagttaggaactaaaccaaacattcactcgattagattttcagattggaggcggtgggaagaggtagaatttgagagcggcttaatttaaagaaatggctagggtggtgccatttacacgtgtatgatggaaatgggtagaatgagatggagacggcgcctctggagccattggaatggaggatgatagtggacagggtaaagtgttagataatttattgaatatatatatatatatatatatatatatatatatattatcgataataaattaggacatggagttgataggtcttaggataaaaatatagtcagactcttatcttagtggtaattgcatgatggcagtaggcgagagaacgacttgttggtaggggtaaaaatcggtcgggtacggttcggatcttacccttcccatatcctaacccacattttataatcggaatcgggtcgggcatggatagtgccaaatacagatacaaactcggataatgtcgggcaaaaatacggaacgaatgcttaccaaaatggattagtacactatcgattacggat

SEQ ID NO: 14517 - DNA, 7279 bp, Oryza sativa
tatgaatatggtcaatgctagaaagtcttacattataaaacggaggaagtagacaagaaccatttaacaatcccatatatctataatataattatattgggccattaagactttagaaaataaatagggtgcaatacatcatagtagaaccaatacataatacaatacatcattgtgcagaaggctaatttacctttcctgcacccgaacaatttgggcacgtctctgttcttggcgtagataaaggctgatcaccatcgctgaatgttgaaaccggttcagtaagcaccagagttccggtacttgaacagcgagcacacaggccaggtatcctacaagccacaactgtcagtaccctaacaaagctgtagtttaaacaattaaacctacagctattgagcaactataagaaaattttgtacgaggggatatatttttaagtaacaggtgcataaaaacaagcttaataattaggcactaccaaattagaggcattatacagcattacaagctatcagacctttgaattcattctgagatttttttgcctcacagaaacgtaatacgggtaatatccgaatatttatccgggtaatacccggattttttgccggataatccgtatccgtcagatattatgttcccgaacccgatctcgtatccacaaaagacccgtattcggacccaatatccgtaaaaagtcctaggtacccgaatttttgacccgaatttgtcccgaaataatgtggccgggtgggtggacggaaaatacccgccctattttcacccctatctgttggcggcctaactagtcgaggatcactgatatcctaatactctgtaattacgctggatcgagaaagagcatctataatcagtgtatcggggatacaagtgtaggctaaacctcgttaaaaaattttcataccttggcatcgtcattaagattggatcttctacgtcagctattgaggtctacatatatcagagctagtttttataacacaaaggaggtcatgtagtttaggaggcctggtgtggataatcttgctggacttgatgacacctggaaaatacgatgtcattggtagatccggtaaaggtgggggaggagaagggagggtgacgcatgtaggcgaagtggtggggatcgagagagtggcggcggataattcaggaagggtgtggactcactgaggagaggggtgtggattgggataatgagagaatatgtcctacggagtatgtcattgatttaatttactctagtttaacgatttacgatcgactttatcttcctttacaatacaatatgccagtgaagtaaatacttttttaaaaaaaagcttaaaatgtccttgaatacttggcaattaattgacccattagaatttttgaaaaaatatatgaaagtttttgcgtagtctccttaaataatacttcctccgttcttgttgatcatcatataacccttgcgtttttatttgacgtgaagcattattgtttttatacatgcaaattgagtctacatgcatgcatgcatgcatgcaagcattaggggaagtaaaacactggtttcttgtgcatgcgggggagttatattttatatgtttcttgatttttttcccactacatacttacattaaatgaaatacaaaaaaaaagttaagctgtttttgtcttgataaaaaaagacttatatggatgatcaatatggaatagagggtgtatactgtatagaagtttgtgtgtgtattttaagattttgtatatgcttttctttaaaaaaaactatttttatgtagcatatggaaaaaggaatcacatacacaaaagatagccgtagtggaaaaatatttttatagcatatgaaagattatttagataaaagaacatcaacataaaaaaagtattccattagcatataaaacataaaatatattttcagaaaaaaataatatatgtaaattaaaaatcttgaaatatacatacacttatatattgtgtaaggagtctacataaagttttcatattttctttaaacttctgtaaatcaattgctctattaaaggatattttacttttttttttaaaaaaaactatccactccgacagtatattgtaaaaaaaatcgataaaatcaatggtgtattttagaggggataaagtcgatgataaatcattggattaaagtaaactcaatggtataaaataaaatgaattcttattattagtgccggttttaattcctactagccatactattattagtactggtataaatcattgtattcctattattgggtaagaagttatacctgctttttctaggcctgcttgagaggttgggagggtggacgacgtctcataggtgccggttttagataaatctgcacctacgaggctggtccctatttgatgttttgcagtagtgctacgatttagtttaaaatggataaataaacttacgagtaaattgcacccacgatgcaacaaccttggcatgtgggtgtaatttggtgccataaattgagaaatgagcgttctagtataacaacttggtaggaaggtgcaatttagtataaaactattataagtgatcgtataaatgcaacaacttgtaaggtaggtacgattttgatacaataaattaagaagttacgtgacaacttaattatttagagcatttttttatataaattcaattttttaagtacttattttgacaatatactagcgtggatttgtataagcatgtttatatttttatcctaataactaataacttaaagtcaattaaactggatgtagaaattattatattttggttgatatttgagaaggtgaagaaaataaaaaaaatcttaaaggtaattggatgtaaattgtatgtgcagtataattcttaaagattaaattcaatattataaggtaatatccgtaggaatattgtgtaatggcatatttacatcgtgaaaaaaactcagctagcatatgcttagccaagttgatgcaccaaaatattaaattgtcaagttcttatagtagaacgcacccacttgtcattatgttgcactcggacgttcaattctcaagttctttcactatatcgcacccacctgccaagttgttgtactgtgggtgcaatttactctaaacttacttaagttcttgttagcagtgagcctatttacatttttttataaacacaatgtaaatgcggccctcataacgcacacacactcatcacgtatccatacatctattagcacctccagaagactgggtcggtttatcttgatattgatgaagtcggcacaagcacctcgctatcagtgggtatgttattgcctaccattggaagaataattaaccataaatgcaagcatccatatcaaatctaaaacttaaccgacaaggtgagttggtttcaccataaagaacctaaccagttgagctacgttcgttatttagcagtgagcctatttatatacttctataggtccaacatttattgcataacatctgatgccaacccaacagaaaaaatattgcaataaggcctacaagtagatgcatgtgttccagctctcagagatatccagttttggtttgtattttctccaacagtagagatgcctagatctgggttttggcctcacagaagttagtgcctatacttacttccagctttaacatttacaggcatggtccagacctccagacagttgggagcgcaatgaatccttcaccgtatgcatgcacgcctttaattagaatgataggcaaaaaatcatattcccctttctattacatgttttactaccctattaaaattttgataccaagtataaggtgtctggtttgagttacaacatcccctattggaagtgacggtaattttcttgaagcgggaattgaaatgtttcatatcgaaattcctactagccagatccctattgggtggatgaaaacggtcgaaaacgatatatattattattattacgaaaacaatatcatcgtgatcaaaattatttatatttataaatttaactgttcattgacgatcaacttcaatgcgacgccaacagaaataaaaaaaaactaaactttatatatgctaaaaaaatttaaactatattatttttacgtaaacggcagtggtacggtcgaaaattaccacaccgttctcacgcatactggttggtcccttctcccttgcatggatagatcgagctgcccaaacaggaatctgttgccaccattcatgtcccatggtatgtactacatgcagtaggtagtacaaatccacaggctacttgttgggctagcagctgaaagaagtatggcaagttagaggttcaagtgggtcacccacgaacctacatataagtcaaaataagtaagttcgtagattagtttagcctataagtgggttttcgcgggtagtcgcttgtacccttatggcaagtggcaagagtcatgaagtggccattctagggtatgtcatcttagagctatagaagtacgagtagccaattaactagccaccttagccagaggtacagaaacacaaccatgatcataaatcgacacccaccaaaagtgaaagggaccaactattcatcagttaactgtattgagaaaattcctatgtatccctaaaacttttatctaattctttatatatatcatggagttatttggtcatttctttatgtaatttcgaattttagttaggatccctttcatactctttagttgaccgtgagttaaacattaaattcctataaaaagtctaaaagtctattttgctcttgggtatgaaaaaacatatatatatttatggaatatagtattcgttagaaacatatatatttatgaagtatattattggatggtagaaatttgttatatgagactattgtatttatgagcttgttatgcaggatattatttatgaaaatttatttataaatatgccataaaattaatatttgtttattatttattaaaaattgtttatgtagcatataaatagatttgtcttatacaccaaatatgttgtgctataatcaacaaaaaaatacttcttatataattttttaataattaaacaataaatgctagtactttatgtcatatctaaaaataaattttgttgtaaatagtatctcacataataaaatcataatataaaattcttatacaataaatttttatactccgccaatttatatgtttcttcgtaccaaagggtaaaatggaaattttactaagaatttaatggtcaactaatgaaaaggatatggaaggggcccaaactaatatttgggaggtacgcaaggggatgagcaaaacttagggacatattagggattttgtaaagttttaggggtacacaagaaattttctcaacaatataagtgtcaatttttaataagccggcacctatacttgagataaaagtgccagttttagaaaagccggcacttttaccgggagccgagcaaagccgatgacggctagtgctcatggagcgttttccctccgtctctccatccccttcgttcaccatctcccgtcttctatcactcctctccccatcatggcacggcatggcgacaaccccctcttctattcactggcctggagtggtggccactggatccaaccagaacgacggtaaggtgcagattactccacaacaggggacttctaattgaagtctaaattgagtgatggaactattcatttgtgccgagatttgtgaatcaatttctgttatttgtgtttgtgtgtgttggtggtggtagtggggtaaaagggggggggggggttgaggggatgttgttgctagatggatctattgtaatttgtgcggggaatgttgttgttagatggatcaatggtgatttgtgcaggggatgttgttgttggatggatcgatggtggtatgtggctgaatcatgaaggtgttcttgagtatgggatggtctgggggtgatagggagctgcttgatgcataggctttgaattgagctgatggattgagttgtcttcttttttttttattcctagaaccttaaagatgttggttcttaaatctacttggccctttgaaccaaagggttagtttccacaaaaatccttgaatattcactcatttcatggaaactttgcatgaaaactgacaggaggtctatcatttctttgctcttctttaagtcctaaagaggttatttctatggttttccttagatgctaccaaacgaggtctatcgatttcccttaaagttattcaaccaagcatgacaaccaaactacatttctatgtttttttaatcctgcgtttcaaagtagttgttaataattatgtaaaaccgctgtagtatggatctgtactgctaattcactcgatccaacattaatgaaaccttacaagttacaaccacctgaattccctacatactctctcttctctactacttaaaaagtaagaggtgcttccatcgtccgttaaaaaaaccgggcgaaaaaaaccgaatctatccgatccaaaaaaaccgggcgaaaaaaaccagaaaaagaaaagaaaaaccaaacgtcaataaaaccgggcgaaaaaaatgtccgatccaaaaaaacccaggcgaataaaaaccgaaaaaagaaaagaaaaccgaatcggtccgatccaaaaaaagggcgaaaataagttaaaagaaaaacgaatccgactctgtcaacgcggtaaaaagaggatgaaaaaaaatatgtccgattccaaactctacattggtgaaaaaaattgatgtgccggattgaaaatctgtttgcaaaaacggaacctacgtgtcgagagcattccatttttatatgtattttatttttggtttgtacttttgcattagagtccctgtaatttttatatttgcatttgagtccctataatcttgcaataaggtacttaaggtcgtttttgttaaaaaaataataaaagagagagaacaaaggcagaaatgtgcataaaaagaaaaagaaaagccgcacaaaaaagaaaataaagaaaaacaacaacaacaacaaaagtctttttcccctaagtggcgaaaaaaactgtagatccgaacggaaaaaatctgatttatataaaaggcaaaaaaagtggtgaaaaaaatgctagatccgattcctttataaactgaaaaaaagtcttattcctataaaggccaaaaaaaaatctaaaaaatatctaaaagagttcgtccgattccct

SEQ ID NO: 14518 - DNA, 2635 bp, Oryza sativa
  unsure (1)..(2635): unsure at all n locations
aaaaaaaattcttgacccctataaatagtgcaactactctcactacccctttcctggtagtgcaacacacacctctagctggtagctagcttgcaatctccgagcatggacgccaccaccaccaccatgtgctcatccatggcggcgtcgctggtgacgtagatgcgctccctctcggcacacgccctagtgccactcgtcgcgtcggcgctcctcttcgtggtggccgtcgtgctgcggcggcggcggcgaccggtgtacctgctgaactacagctgccacctcccggacgtggaccggaaggtgaacctggaggtgtgcgagtacttcggccagcgctgccgccactactccgacgacaccgccgacttcatgcggctcatctaccgcaagtccggcctcggacaggagacgtacgcgccggccttcatcttctccggcgagttccaaaagacgcaggcgttcgcggtgcaggaggcggaggaggggctgtttgccacggtggcgcacctgctggcgaagtccgacgtgcgcccgcgcgacgtcgggttcgtcgtcgtcgcctgctccatgttctcgccggcgccgtcgctggcgtcgatgatcgtgcggcggttcgggatgccgccggggacgaggacgtacagcctcgccgggatggggtgcagcgccggcacggtggggatcgacatggcggcgagggcgctgcgggtgtcgcggcggggcgggtacgcgctggtggtggtgacggagaacatgagcctgaactggtacttcggcgagaacaagcacatgctggtgacaaactgcatcttccgggtgggcagcgcggcggcgctggtgaccgacgtggcggcgcggcgcggcgacgccaagtacgagctggtgcgcacgctgcggacgcaccacggcggcgacgacgcggcgtacaacgccgccgtgcagatggaggacgaggaggggaacgtcggcgtcgcgctcaccaaggacctcgtccgcgtcgccggcgcgggcctccgccagcacatcgccacgctcgcgccgcacgtcctccccgtctccgagctcctcaggtcaggtctctctctctctctctctctctctctctctctctcctttgctcttcgccgccataatggctagctgaacgaagcatgcagcctttgattgcgttcaggctttcacagatttcagacgccttaaatggacatgaaaatttgctctttttgctgcaacatatcaaatatctgagctgaaaaacagagcttatgtggtactacactcttaaaatgagtaatccctctctcaagaaaaaaacttaacctagagaagaaactcaacctagagaagatgtgatgtccaaattctcctagaatgctgttctaggagagatcacaggttgagttttttttgacgaagagagtagtattcaaatgatataacgcataataaattcataaatataatagttccatccaacaaatttctatatttatttatttgtttcttcatagcaaaggacaaaacgttcaactaacgaaaagatcatggcagaatccaaactaaaatttaagagtttgtaagagaatgagcaaaactcgaaaacatagaagagcaattaggtgaactctcagtgatgcacatgaaattttctcatgcttgtaacattgctataacgacgacatacgaaaattttgatttgaagaagctttaattttgtaagaaaagtacatgtataattttgagataaaaatatatataataaaccaagctttacgtatatactaattaaagtaactccatttatgatggaggcagtatattatttttcaattccctgaggtgtgtagatctaagatgcgaacgagtttacgaaataatcaaggagaacaatattctatgtttatgatattgcccgtgaagatgtgctatagctaagggaatatatcctatgcacataattttttcgtgcgcactccatgtacatcaactagcaaatgtcacaaaatattctagaaaaaaatggcaattttttaatagtattatacatatctgcaaagtctcgtaattcattatattttacccataaaaataaaaaatctaccaattgttagggtaaaaatatgtcagaattttatcttctttttacagttaaaatataataaatttgaagataagatttaacatgttggtgtaatactcttggaagtatgtgtctaattttttctagaattttctgtgacatttgctagttggtttgtatggagtgtgcacgggaatcttgtgtgcataggatatgttctcatagctaatcaagttatatttgcaaatataaataattattctacaacttagacaaaccaacttataaatgtgtacaaaatcacttcagtacatgattaagcatcgactaaaatatacaattcgatcactattcttccaacaatgcatttataaatacttggggctctccaacgtatatacaagttttaacatataaacaaaataaaacaaaaactattattgattaaagtttggatagaacagtcatcactgtcagttattgaacagtacaggagnnnnnnnnnnnnnnnnnnnnnnnnnnnnnnnnnnnnnnnnnnnnnnnnnnnnnnnn

SEQ ID NO: 14519 - DNA, 3413 bp, Oryza sativa
tatgtaactttcaaaaatctctctgtaacatgttatttcggtaaaatggaggtcgtgggaacaaattctttcatatatgtgtgtgctatgattttttttcttccttaccaaaacaaatcttgtaatagatctacgtgaaacttacatataagttacactgtagttacatgcaagttacagtgtaattacactacgattgtactgtaattacatctatcaaattttgggggaaaaatttgtcgacaaatgtataggtagtcccaattatagaaactgagccatggtctttaattagttctcgcctagcaccaatcgtttttttcacattaactacatcagattttacccatttttacacagtgttattctattttgctgttaaagccagatcacttttcatggttgtgatatatcgtagatttggtatgatcttgatttaaaatagacaactccacggacttctcctgtggatagttagatctatccttaaatggctagtcactccctagacagatcgtcaatcttttcccccttaataagtgaattttatttttttttgctatgttaccttactcccccgttccaaaatataagggattttaggtggatgagcatatttttaagtactatgaatctggacagcttcgtttaaattcgtagtactagaatatatctcatgcatctacctaaaaattcttatattttaggatagagcaagtatattttttcactagtttatcaggacgaattaattgatgcactgtagtacaaatttaggtacaatctcaaacttttaattggtatacagtgctacgtggtatgccatttctgtgcacatttaataccacacgccccacatgtacagcattggttttttttgtcttcgagaatcatactccttccatcccacagactttatcctgtaaaatttgtcccacagaaactttatgctaagagagtactccctctatatcaaaatataaaaaatataacacataaccacttataacacaagatcaagaaaacatttaatcaccttcttgattggatcaccttaatacatacaagtaatatgattgtgaggcttaatgatataagatttaaaacaaattaattttataggaccaagagatgctagttaatgtatacatgcatgcacgttttatattaggccattcccaactcaatggctaggatagtgtccatagcattaaataaggtgccacctaggatgaaaaatgatgtggcaagtgaataaatgaggaaagagaaggaaactatgtcttgcataagacatagtttctacacaacatacaagacatcatgtgtaataaggagcattaaatttaagtatggaatggtagtgtttgcattggaagagtagtgtctagtactagtttcttgatgatgtggagtttatggaaatcatatctagtgttttgggttgggaatggcataagacgtgatagaaaagtggttgtgtcttatattttggaataaagggagtagtaccgattaggctacggggttatagcttcaagcagatgccgaatttagccactgtgttaaaaaaaccaatcagattaagacatttcacatttgtatttatttcgagcctctagaaaatgtggttaagtgtactgacgaggggcacattagtcttttctcaccacggttcatttgagcgggaattgctatgaatgaactcttttctgtgggatagagtaggtagctgccgagccagcaaacacataattaatgattaatttaatttattggttaacttatagttattttgctactaattcagtgatgaattggggtgcatgacgcaggtacgtgtggcgggtggcgcgcgcatatgtcgccgggaacccaaaggccgtggcggcgattgtgccagatttccaacgcgcgttcgagcacatgtgcatccactccggcgggaaggcggtgattgacgcggtggtgaagctgatggcgtttgggccacaggtcgtagagccggcgcgcgccacactgcataggttcggcaacacgtcgagcagcctcgtcttctacgagctcgcctactttgaggccaagcgtcgcgtccgtgccggtgaccgcctctggatgcttgccttcggcaccggcttcaaggcttgcagtaacgtctggcgtgcgctccgtgactctgcacccgatgccgacaacccctggaatgcatgcgcccaccgctaccctgctgcgctgccaccgccttcaacgcgtaggtcgagtggcggtgcgcccgcaatggattttacacacttgaaaaatgataagttgccttaagttaccattttgaaaataaaaaatgaaaataaactttagtattctaaaaagttgggttgagtttttatattccatcaagtaacatgtattttttttctattttcttcgtacttcctcaatttttttaaaaaaagttaaatgatatatatttgtgatcgaacggattaatccactagtgttattgttctttatctacatgtatgtatctatttattatgtaaagttatatattcgttctggtcattctcaaatgttactcgttttgtttcgcttaatttgccatatttgacccagcagatatgtctactctatacttggattgagtggcagagcttgaaagcttgaagtataacaacgatcttttttataaaaataaaacaactatacatatcttatctcactaaatttatgttaaaaacccacttatgtgtgtaatacttctagacactgggatttaaacctggtggagtgaaattatacacccataactctaccgccacatgacttccccactaattaagaactattttgcttgttggattaatacttaagtggtaaaattaaatgacttcattgtaatttttctaaaattaaatgtgtcattgtaaaactccatctctgaattctattcgaaccacaaataaaaattcagtaaagtgacatttacatagttcccaaaaaaggagagaaatattatttccttggctcgaaaaaaaaaacagaattgctatttagtgggtatataagatataattcttggattccaaatgtaatgtttccagctccagtacagagggggctcgtgcacccattattactgactattaatccaacacatgatttttataatatttctacatgtctatccatcatttttaatactttattcatatatattcatatattgcatagtaaaacgcaaagtatgatccaattattgaatagttatacctagacgcctggacccaatgcatagccctttaattatctatcactaattatacatatatatgagttatccctatatatgagttatccctacgtgtcttgaccaaatacatctaataggtgtgttcgctgtcattttctcagctgcg

SEQ ID NO: 14520 - DNA, 7340 bp, Oryza sativa
agccacagctgcagtagcaatagctgtcgaatatggccaatatatatgaagtagtttttaagccgtttttacgataagttataaaaagccgtcgacaatcggtcaaaaaatatctaccagagcaaagtgcaactctcagcgacagagggagcagtgcatcgctgtcggcatgaacactcaattctgaccatgcatgtcgatgccatatcaccattgatgatgatcatggcaaacgcagcaatggccggccagcattcattgacgccttccagcgttatcttcagtgttctacaacagccaacacagttactactatacatgccaagacacttaggcatcgttcgtttaggggtgataggggagattggctctcgttttccgcgcgcacgcttttcaaactactaaacggtgcgtttttttgcaaaaaatttctataggaaagttgctttaaaaaatcatattaatccatttttaaaatttaaaatagttaatactcaattaatcatgagctaatggctcacctcgttttgcgtatcttcccaatctcctcaatccccttctcctcaaacactccctgtcttcaatgaggccctgccagatagcctagcaactgaaaattttcaagtagcaagtcgctgtagacgcgcagggttttttccagggcaatacccatatgcgttaggccatgttacgtgttattctattcatcccaaaataaattattagcgccgtcccaaaataaatcattagcgtggctgtaatcgataggcatattctatattcgaaaggttgagtttcgggtcacgatttcagctaccatggtaaataggtttatcacagggatacgagaacaataaggctttctaaatggtaaccctacgtccctactaccaaaaaaaaatttttttggtaaatttttgttcaatcctttacattttaccatgggaatcaacttacggccgctcatcagaaggtaagggaaacctgctttggatgcggtagaagtggtaggagttggtatgaatgtataaacatgcttcctatgtcgcttcattccgaaatgatttaaagataccctatataatggggcttttaactatttgccacggttagttttggcaaataactatttgccacccctatctcaatgacatgtgggtccacatatgtctatgacatatgggtccaatgacaaaaagttaattgtcacatctaaatgtggcaaatggttaaatatctcctatataatagtgcacacaagatgcactagaatgtaggggtaggagttgttgctataaattaatcatgtcatagtctaaagtattcttgactcaattcttggaatggaaaattttaaagattttaggggaacatactaaaacctgtgaaatcctgtaaaatttctacttcaaagaacactgaatatgagtgtgataatccctttaatagttgtttatagtgatgtgtgccctctacaaccctcctaagacttgccattatgatgtgaggattttcttcggtttagtatactacttggataaaataaagtttactgttgatttttatgtgaaaatcctgcattccaaatatccttgtctatccagggtatggacttgttgtctactagtgcttaatttcacaccacctacccacggtatacagatgcacactgttggtgatatggactgaagaatcagcagtcagaagtaatggcggctgtgaatctgaaagtctgaatcctctgtttctctgcattttgattttttgagggcctatttcagctgaaatgtactgtactggtgaagtgggatttaacatccagagtcctgactcatttctgaaggagtataaactgccctgcctaccccaaggcctatcaagaacagttgaactagccaatccaaaaaataaagaagagaacagttgaaccagtctgattcagtaatgcactgatacagtgcccctaaactgcccaaagtacgcaagcaggagccatgagccactcccaacagtcaaaaagaattactgacataactttctgtgtttttgaagtaaggcttgactaattatttcttagaataaataattaaatagtatgttcatgaaaatactctttaagatagatatcaaatataaaaatgctagctcaaggtgtgttgaaacatattgtttatcaaagttttaaaattttacaggaaaaaaaaaattcaaacatcagtacacaatcccgctaatcacgtaaacaaaaaaaaacacttcacatcaagccaaaagagaatactatagctcaattcaacgcttttatgccaacgcttttatgaccgtatacgcaccaaaaattactgtggagcagcagcatacacagcagacatgtgatgatgtgatcacactcgcactgtttttggtcttgggaataaatttaaaatatactgcctccatcctatattacttgtcactttaagtttttatttataacatattacttgtcactttaattttttatttataatatttgatcattcgtcttattaaaaaaattaaaattattatttattttgttcgtgactttctttatcaacaaaagtacacttcaaaagtactttaagtgtgatttatcttttttatatttacactattttttcaaataaaacaaatagtcaacgttagtatatctataagaatgacagaacaaaacgacagcttgataacaacttcagaaatggttagcgtaggagtctaggagagggaacaacagtacaatactgtttattcttctcaattttgctttgccacctacattttcaccacataccaactgtagtagtatgcacaggtaaaccgagtacagttttactctggacataaatacatgcaagttacaatatcttagcaatgtaatcggtactagtaactggtgattggcagcaacagaatacaagcttagcatcattggaggctaggggaggggggttaaattgaatagtcctacatgagctgtggtagcaaaggcacacattctgttccactggaagtgttgctcttccagctccacagagggggcaaacaactcagtaagagtcatgagctgggctgtctgaatgcatgtccatggatgaatcgttcgaagccgtcgagttttgatcgcggttaacgccgtttgcgaagtaccccgcatcgccaccctgctccaggtggaatggttgcaggctccggcgaacggggctagatagtgcatttgaaaagaccgctgagttcttggactgcaccaatcctgtatttcctagcgcaaataagtttggtgatggctgctggctcattgtgttgggaataggcactgtagcttgagtgctttggcttgcatgctgtgatcttggagaggctgatgcattgtcacctccatactggatctcgtgctacaaacacagatgattattaggcacatgtagttgtgctaggtctaggatggtgcttaaggagaagatacggcataagtacaaactatattttgaaaagttgtagctggagcctggaggcatgaattggcaaagaaaacaatcaaagcataggattcatcttattcatttccttatttgccatcaaatataaaccttatcccttacaggataaaaaaatgatgttcccttatttgcaactagttcattttgtcttcccatttgccccttctgtcatcttgctgttaaactaaacaagaaaagataatttgcccttcctcattcttcctaattcctcgtttctccttctcttccttatccatggtaaatttaaaaaaaatgccagcaacagaacagtaaactcatccaacccagcggcttcgttcttcctgaacacatgacagagcactcaccctctaccaaaggtaggcatccttaccagcaatggctagtgaatatgggttgtgtgcctaatgcctgcatccattccaatgaggcagattcatgggcatctagcatggtcatccttggtggcatgtaagagatgtgccgccacattggtggtatccaccaaatccaggaagtactttcgcaaattttacaaacttataagaaaatgaagtcatgctatgcaacaaaaaaaataacaatctgcacaatcctatagtcccattccaaaacaataagaccagacacttaatacttgtgtctagcatggcactaggtctagaggattcaagcttgctggggagtggcactagaagtattatactcacctaatgcccaatcaaaccatgtcttgtagcataaaattgctattcccatataacctgaaaaacatggtcaatcatacgacaccgatccaagctcaccggatttccaagccatatctatccctgcatccattccccaaaagaacagcagcgtacaaatgcaagctcaccggattctcaagccagatcatggtgctgagcatttggtggagccacagaggctgactagccaaagcttctgccaacaaacagtggcaccagttcaggtccatctagaattctagatggcaacggatggacttaggtgctgtgggtatggccagaagaaaaagatggcacccattttgtgagggtacaaatggaatatttccaaaaaaaaaaaaggtggatccacggttaatggtgtttcatcctaacagagttgacggacgtggcaaataatgaaaggcaatagtgaactagtggcagtaagggaatgccgcgtttccattgagttagcattaaatggcaaataaggagttttatctagttcattagggttttgcagtcaggtgtattcacaaaaaaaaacaatgagcatgaaaggaaaatctaaacaagttcttcaaggccatgttataaatttagaggataattaaatagttcttggaggatgataactgcaaacctggatgtgcgaggctatatcagcaactgtcagcctcaagccattttcatgctgcctcaagatccattcatagagcttttcctgcatcagttagaaaaagattgagaaacactagtgaaagggggaaatacaaaacaatgaaacagatgtcgagtagtcaaagaaaaaaatgttgaaaaagaagagaaatgtgtttttctgtacaaaatatgtctaggttttaggtatgcgtgacccaaccgtcattactctcgatggcagccaatactccctccagtcacgataacatgtgaagtgcttcaactttcaactcaaactttataaactttgcacaaggtatatttttaaatttttagattggccgcatgaaaatcatatctgtggattgtcttgtctcaaaaaacaagcatagtaatcttttttggggtttccaaatatttcacaatagaaattagtgaccaaaactgtatcttgtagatcatgtccatgtccaaaacaacatgtttccatgaccggagggaatcgtccagtacttcaccacaagcaacagagtcagaaaactatgtgattaatgaatgtttgtatagaacccagaaaataggctcctggctttaaacagcaagaattgtccacatggaagaacaaaaaactcattttgtggaggaaaacaagacagtttggcatgaacagttctccagccattaagaaggttggagtttctctagaagtagggatggaacccatcttttatttgggatacttaacaatgaaacagaaagctttgcaaagaactaaatgtgtacaccctgcaacgaccatctgtcttcaaagtacaaaattcaagaatccattgaagtaactgttctatatgctaactctgtttgtaaggcatatgtcaaatgagcaggaacttctttgatcctagttgacattgcattgggctactagaaaacataaacctctctaaatgccaacacaaagcattactctgtgatgtacaaacaatgccaatatccaatgcattggctagtgtattgtttgatgagagtctagtaatattgtcatctgatgagtaaagcagacaatgctcaatggtagttagctagagtgtttccctgtcctgtgaaaacaaagaccaggaacacagctgagccacatcttgagttctgatcaaaccatagcttcaggatgtttccaagcattaataccaagatatgccgtccaaagcttttgcaagaacatgcaaaagtcttgcacatcacattaagtctttaagaggaaacgaaaacagacagttttgatgcttgacgaagtcaaacagcaccagaataggccaggactggatccacagagccacagcaaaaccaaaatcagcaaacataactaagtatcaacatcctcgtaaaccgcaactgcataagctaacaatgccatccaagtctgaaagaagcatcccacaccaactggcgatactttacatttaacagtacacaagttgaagcaaagctgaaaaggatgcatccatagtactagtgcagaagtaacctgttccacaagctaagcctcctctcatctgctttccattcccctccccctctgagagcaacctaatcctgagtcttgtaaagcacaagggtgggatgtctacaaccatttcaacccagaggtggaaaaagccatattggcacagaacctattggagaaaaagatcaccgacaattgaagcaaatgagtttggctgcatcgccgttaaaaggcaactgatgatataacaactacgagaatcgcactactagtgcgagagcacttgtgaagctatcaattgtattggcgcatcgcatcacgaagaatataatattcggtgaggtcaagggacgcactacgaactaaaattgcatacagaattagttggtctttacccactattcgaaatttatatgtgcatggtaggtaccagattcaggcagaaaacatacaggaatcaaaatttcacctaaatttcagaaagcataatcaaaatttcaccaaaatttcagaaaatttccacatcactagaggggtcaatcgaacacacaaatttcttagggaatctgaatttcactaacaagaaggcgcatcggaacaaaaatccctcatcaaatcgagccgaaaaacaagcctttccccacaacacaaacaccacagaaaggccaaattcaccggggaaaccgaatcctcccgctgcaaaaccgagaaatccccaaacatccccagaacaacacgcccacaccacatcacatcacatcagaccgaacccccaaacacccacaacccatcacaggaagaagggaagacgggagggtcggggagggccgtaccatggcgtggcgctcgccggcctggaaggagagcttctggccgcccatggcgagcgtgtagagctgggacagcgagttggccgcgccccgg

SEQ ID NO: 14521 - DNA, 2217 bp, Oryza sativa
gtgggccccacccccgcggaggagaggggagaggggaggaaaaggagcacgtgggggtggggtttggcgcacgttgggtttgatttgtagggggtgggggtcgctgacgggtggggtccggtggtggcatgtgggggagggggtgtcctttctggcagtggcaggtattccgtgctggtagttgtgacttgtgaccagtagagtgaggtcgtactcgagttgaccgactgggaacctcctcttgccgacctcaatggtttttacagcaacagaaattttagaaaatcttacttccttcccctcataatataaataattttgtatttttttctttttgttttattaaaaaaaattgtgcaaatataaaaaacgaaaaattatgcttaaagtattttggataacaaagtaagtcacaaataaaataaataataattctaaaatttttttgaataagacgaatggttaaacagtgtaagaaaaagtcaatatcccttatgttatggggcggagggagtattatttgaagtcaaagttatacacaaccacgagtattacaacgcgtgacatataaacacggtttttcatggtctatgcgattcataaaattatgcatttattaaaatcttgaaagtagtgaagaggtaaactatcaacattagccaataacataataaattaaaaattttaaatacactcttatgttttagattttaaagtacaaacaaaggtgggattctgtgaaactttacaatcatggtattactatctaggattatatcctacaagccataacacttgtggttttctacagttttgacataaaacattaggttttctaaagcttactatatgattttttagagatgtatcggtgaaaagttggtttcaatctatcaaaaattagaatcctcttgctcttcttcttggtttctactggtggggttgagcactgccaactctcagtcgagagagatcccgcacgaaaggaggggataacgatggggtggtctacccttttttattttagggagtattatctcctgtataaaaagtacatcttttaatacttaaatcctcgataggggtttccaaaacaagatttacaatagagtttttggttggtgtgttttaaaggcattctcaatgtatgatgcttatatcacctttaagttgggcctctcgtaggtagttgctctgtccataaaaacaagttctaatgtttattaccagttgtcgacggggataaccgtagaccggatatagagggtattggggtacgctggtacgaggatctacgtaatacgacatcaagcaggcagaaaacaaagattatactggttcaggccccttgataggtaatagccctaatccagttgatatgggattatatgatgtaagccacagattacaaagggaaaagcggaactcgatgatatcgacgagatcgtagtcgagttgattcgactagatcacccggcgacttggctcctgtaggctccggcttcgtaggctgtggtggttgtcttggctatgagattcaatgccttaggtcctcccggggggtcccttttatatcgcaagtcgactggtctccaagtaggactcggagacatcggacccggcacggtacaatgatgacccagttctgtctaagtatgactccttccatccgtgaactccatgatgaattcctttaacgtatgccaaaaacgtccgtatacgcgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaagataacaaaggatggcataatagggtttcatttgcaaaagcagcatttagcaaacatttgagaatttaataaaacagttaagtaattaaacaatattaatccaacgctatacaacataccctgttgtataggccc

SEQ ID NO: 14522 - DNA, 917 bp, Oryza sativa
  unsure (1)..(917): unsure at all n locations
accctgacaatggcccccgacttctgcttaaatgaactcatgtagccgatcatgacttctgatgtcgaggctgtcgttgttctcagtgtaaggaccgagagacaaggagtgatcgacagcgcccgatgaagctcaacggtcacgagtgaatttaaaccgaagtccaaaaaactgccgcgcgtaacggatccagaaatttccggcggcaatctctctcctttccttggaattcgcaccgtcggaagtacagctacttaaatgagttttggggatcccttttgaagtccgcctattgtgaaaaaactctccagcctccaagcgttcctcatcttctccgctcccgcaaaaaccctagctagcgcatctcggtcccttctccggtgatcttcggcggcaatggatctcgacaagtctacctccaccagcgcgtcgctgaagaaactgcaggaggatggcgcccttcccggtcgcgggaccatggagagagaagtaggaggtactgaaccccagcctgtcctgggtcgcatagttgcgatcgaggactttattctctgtggttttcttcctccgccttctgaatttcttctcttggtcttgaatttctacggcctttccttgctccatttgaactccaattctatcgccttcctaagtatcttttcgtatctttgtgaggcctatattggggtagagccgtttcttgacctcttccgcttttactatgagttgcgctggatggagcctaaaaagggtgtccggatgtgttggtttccgacttcgggatggtctgaagtcgcgatacatccccttccagtgcccctcatctcgcagcaaatggcgggggaggtggttctgtcttcannnnnnnnnnnnnnnnnnnnnnnnnnnnnnnnnnnnnnnnnnnnnnnnnnnnnnnn

SEQ ID NO: 14523 - DNA, 6873 bp, Oryza sativa
tcttcgcgggcatggatctcgacaagtctacctccacaagcgggtcgcttaagaaactgcagaaggatggcgcccttcccggtcgcgggaccatgaaaaaaaaagtaggaggtactgaaccccagcctgtcctgggtcgcatagttgcgatcgaggactttattctctgtggttttcttcctccgccttctgaatttcttctcttggtcttgaatttctacggcctttccttgctccatttgaactccaattctatcgccttcctaagtatcttttcgtatctttgtgaggcctatattggggtagagccgtttcttgacctcttccgcttttactatgagttgcgctggatggagcctaaaaagggtgtccggatgtgttggtttccgacttcgggatggtctgaagtcgcgatacatccccttccagtgcccctcatctcgcagcaaatggcgggggaggtggttctgtcttcagatagaagattcggatccggtcttcattattcctgaggagcaaccagacaagatttcatcttggaccgtcaaacccgccttgaccccatccctccaatctttcatcgatatcattgatgacctccgagtacgggggttgtcggggtatgaagtcgttgccgacttcattggtaggcggatcctgccgctccaagctcaagcccacccagcctttgattattctggaccgaaggacgcgacccgggtttctcctcggagtatttttctttgtagttaaattgactcccttatgtgtgtgttcctcccgacttatcgaattctggtctcgatttacaggcttggacagcgcaaccgtgaggcgccgcgttggccaaaatatgatcagtggctcgacaacggcgagcaacgtccctgtccccctttgcgagaaaggggtagccgaacgcgaaactgccatcaatgtaagtgtactcagtggcccttttgcatttttcttccgggatcgcattatgacatcatgaagcgtaggctctccctctaactgatatcatcgggccgctcgtggaccatcaggtggcagcgtcgctgaaggagaaagtcgctaaggaggcgtctgacgctgttgccgctgctgccacaatgagtggcggcaacgttccgaaaaaggggaggaaattctcctctgtggtcggacatcgtcggaagacgtccaccccttcggtaagttttcctggtccttcatcgcgtagtcgggaaacttccccctcatatcatgcccgttatactccaggcctcggatgcatctcccctgcctccacgacggcaatggcttgtgacgcttggcgagaagtgggtgaactttgaggttttatcacttcatcgagctcttgcagcatgtctcaattgcagcctttcacagggcggcgcaagcaaaagcggcgcaagatgggtccggagggacttccagcgtgtctcctgctgtggcctcgacacatgtcgtggtcgtacccaggagccgcgaggtgaagccaagcggcccagccagcgatctcgcggctggtcggggtccgccgactgccgtcctcacatgggaagagctccagatcgcgatggggcgcctcctcgaggctggtgctcgcggtgttagccgcgagatcgcggaggcgagagcggcgatggcgtcgtcggcgaatgaacgcgtcgaccggctgacgcgtgatctggcggagtcgcgaggacctccagaaaatgagggaactggtggccggcaacaagcgacaagggcaggggcttgagcaccgcatgtcggagctcgagaacaacttgtcggaaatccgttgctcgttgcgggtcacctacactggtctgcaccagctcgccggggagtgcggtatcaagtccaccatcccggcgaatcccgatgagttctcgctgacaacttcgcttgctgagctggcgacggcgatggaggcgatcccctccaagcacgcggccaggatcgaagaggagacgtccaacgggatctatactagggcgtgccatgtccttgcatatgtgaggctggcgcatcctaaactcgatctgcggaagattttggatcagggggcggctagcaacgcgcgcaaggatgtgatggaagaagtcgacgatctgggggagtctgtcctcccgctttttgaagagtaggattttggctttcttgtactctttagtcatgttttgtaaaactctctgaaagggtcaattaggcctagagagggggtgaataggataatttaaaactttatgcagaagctaaaactgagttaggatcggaaagtctgatccacagtcagactatccgaaaatatcagatagtctgatgttggatcagagtgtctgatccactaaaagaacactacaagaagatctagtgcacaaacaagagtatggcgcaaacagcgactagatctatagcggcacaaaagcaaagctaaataatgggagaagagatatcaccaacaatgaagttcaccaggttgttcccggagttcaaatccttgaggggattctactctccgttgaggagctcactaagagccgggtctttgctaaccctttcctcaagaggttgcactaagcacttctccttccactaaggggtatctctttccttgtggaggcgagatccggccttcacaaacttctcccggccaaccacacgtagatcggtggctcgggagtgacacctagccgtctaggagtcctcaacctccaagagtaacaaacaccacacaactcttggtcaaccctagtgctcaagatcaagtgaaacacacactaggcccacaaaccccaaatccacaaccaccaagatccaccacacaaagaacaaggagagatttgagagagggagaaagagctcaaagatccaaagcaccttagcaccaagcacaacccaaagtgaatgagaatgaaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacgaaattctggagaatttcggacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagatagtgagcaaagttctgtgaaatttcagatagtctgagcatcggatagtctgatcaacatcggatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcactctatgcgaggtgtggttcaactcgtatttgaagagttgctgcacctctatgtgaagagtctgtagagagctctgagtaccccgtggggatcccgaggaatcggcggctggatacatctcatggatgaatggggcctgcgcctagctcgaaggcatcagccagcgtatcgacgaagccctgaagcagtagtgtcgtcgatcgagccgatatgctggggggcatatattggcttgcatacgagatcatcgtccgcagctgcacctcgagttcctccacgaagggttttctcgttctcggagaactcctacggagatagatggcctggcgaagtcgatggtgccgctggcggagaaggtcttccagtccatggactggcgttggccttcctggtagtctccgtgtcctgtgacaaatgtcttagggaaaaagtgtaatataattttggatttttatggaattgtaagaagtacttgtgaaatagaaaagagatctatctaactaagctttcttactctggttgtagcgtgtatgagtgtcttctcacttcgcgacttcgatcaatcgtttgagttatacactctccctagcccccagccttgtcatcggagaattcttcttggaagataaggctcttggacctttgacctgcctcggttgaacaagcactgatcctagcccccagccgtgaagttggaaagttaatttccgatttacacagcttggttaatacgcacggcgagaactcttacacgaccagatcttacatggtctttcgtctctacaggatccgacaaggccttatctgctctgggcgtccccagccgaagttcccttaggttcctcagaggccttgtcaagacggcgtaaagggacatgaggataggtttcaacgctaggtgtcatctgggtaagggatcatcgggaatgaacactttgattgtagtatgtacctgaaaataggctttactgaagctgtaagatgtcttacaagtatggatactattgacttatacatagaatttacgtaattgatcaatgttccaggaattagccaactcacgaccatcgccgtttgcaattttgaatgcgcctggccgcagaacttgtgtgatcgtgtacggtccttcctatttgggtgagagcttgttccgccctgcttgactttgaacccgtcggaggacgtagtcgccgatcgaaagtgtgcgtgctcagatgcgtttctcgtggtagcggcgaagggcctgttggtagctggctgctcgaacggcgactcgttcgcgatgttcctcgagtagattcacatcgtcgtttcgctgctcctcctgattctcattggagtacttctgtgctcgtgcgctttgatatcgtagctcggtggggagcatggcctctgagccgtacacgttgttggtgtggtacgcacggcccatagtactgatggaagttcttcgacccacttcttgtcatgtgacatgagcctgtcgtagacgcgggtcttgattccctgtagtactatgttgtttgccctcttgacttgtccgttgctctgagggtgagaaaccgaggcgaagcagatcttgactcccagcctgatgcagtaatcctggaaatcggcattgatgaactgggagccgttgtccgttataatatggtggggcaatccgaatctgcagaatatccctttgatgaatttgattgcgttgtcggccttgatttcccctgtaggtgtcgcttcaatccacttagtgaatttgtcaatcgccacgaataggaacctgtagccgctctgtcgaatcatgtcgacttcacaccgctgaaccatgtcgcaggcgtctttgagggcggttggctagaagaacccctgtcgaaaagcttttccaactaatgtccgaccggcggtatgtgacctacagatcccttcgtgtatgtcgaggaggagatgtctgccgttgtccgacgagacacattttaggagtaccccgtttggtgcgttcttgtacagatcgttacctattatacagtagacttttgctttacgggatattttctcggcttctgcatcgtcctcgggcaactcttcgctgtgtatgaatttgatgagtggggtgcgccagtcgtctgtggtctcgatatcggcaacggcgcgctctatctatgtagcccccgagctgttgttgagggagatcgggctatcttcgtcgcttgcgtctttcactaatggccttgtcaggacgtccagaaaggtgccaggttcgagtggctctcgtctggatgcacgccgtgctagatcatctggttcgatgttgtccttgcggtatacatgtcggacctcgatcccatcgaaccttttttccagcttcttgacttctgcgagatacttggataactcggggctagagcacttgtaatctttatgcaccttgttcacgactagttcagaatcccctttcatgatcagttgcctgactccgagtgcagctgcagctcttatcccggcgagtagtccttcgtactcggctgtgttattagtcgccctgaagttgaggtgaattgcatgcttgaattgatctcccaaaggtgatgtcaagatgaatgctgcccctactccttggctgttgtgtgcaccgtcgaacgccattgtccacgtttcgttgtcgatttggttgtctgacttattatcaggcatagtccaatcggctacgaagtcggcaagtacctgggacttgatggctgttcgtggcacatagcggacatcaaattggcttagctcgactacccatttcgcaatgcggccgacaacgtctttgtttctcactacttcaccgagagggaaggaggatagaactatgaccctatgggcttaaaagtagtggcgtagctttcttgatgtcattattaccgcgtagagcagtttttggatctgtgaatatcttgtctttgcgtcgtggagagcttcgctgacatagtagactggtcgttgcaccttctctctcttgacaacaatgacagtgctaacggaatatggcgtggtggcaatatatagaaataattcttcattaggttagggggcaacaagtacaggtggatttgataagtagcgcttgagtgcaa

SEQ ID NO: 14524 - DNA, 8505 bp, Oryza sativa
gggttggctagccactctagatggagtacctctctgatgaaaccagctttgagaagcttgtcgagctcttcttgtatggcttgttttcgatctggtgcaaatctccgcagtttttgctttactggcttggcatcaagtcgcaccatgagtttgtgctcaatcacctccctgggtacccccggcatgtcggatggctgccaagcgaacacgtcagcattgtcgcggaggaaggtgatgagcgcgagttcctatttctcacctagtgatgccccgatcttgacggtcttgtcggggttggcactggagagtggaacaatcttgattgcgccgtccgatttcggcgtcttgtttgttttgctcactttcttgggtggctcagctgtggcgggtgggctgggcgtgtgctcgaccatgtcgaggctccgcttgtcgcattgcactgccagcttagcattcccttgaatagtgattgttcccttcagtcccggcatcttaagcacttgatatgcgtagtgagatgcggccatgaacttcgggagtgcagttctcccaatgatagcattgtatgttgtatcgaattcagcgacatcaatggtgatctgctctgttcggaagttatttgcttggccgaaagtcacaggcaacataattttgcccaatggtttggacgatgactgaggagtgattccatgaaagggttgatcggtgggtgtcaactcgcttcttgggatccccaccgcgtccaaggtgctggcgaagagaaggttgattgagctgccgccgtcgatcagaacttgcgcaaccttgatattccgaatagtgggttcgaccacgatcggatatcgccctgggatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagcacattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgggtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaaatccgatatccaagcgacgcttcgtcttccccgccggaactctcgccattttccccactccctgctacagtgtaaagctgcgccggcgaactagggttctcaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggtcaatgggcgccatccgacgtaacggaagagaacttgaaggagatggtggcgcacggcgttctcccagccaaggagatcatcgggtggcggccagcgagcggtgagacttttccgacccctgatacacatgagatcgtagtcttctcgcatttcttctatggcggcttcgctcttccgacctcgaaatttttccgcgggatcctgaatttctacggaatcagcttacatcacctaaacccgaattccatagtgcatatcgccaacttcgtccatgtttgtgaagcctttttggggatcaaacctcactttgccctattccgccggatcttcttcctcaaaccccaaccaaacaagaacaaaccgtgtgtagtcgggggggcaggattccaactaaggggaactctgagtcaaaaatatttctcgatgcccttcaagacttcgaacaaaggatggcatgcaaactggttctatgttcagaatcccgagcctgctcttcccgggtactcttgtcttcctccagtgtaccaagatacttggaattctcttccgatcggagatgaagcagtacaagccttggagttgttggatcgtatgttaaatcttaaagaacaaggcttacagggagagcagatcactcggcacttcattaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcaactgccagtcgtgccatataatgcattcaatccgcctccacaggtatgcatcggaaatcctcaaaccgtgatcagaacatagttttatcttcacgctgagttgactaactatggaagcatcttgtccaggaatatgcattgatgaagtcagatccaccagtctctcagcgccggtctcctcgccaacacaccgctcagggaggcggagggccaacgatcagaccagatccgcaacctcagacctccaaattggctgatcaaacaggtcctcgtaaaagaaagctggtacttgatgatgatgaaggcgacgatgataaatctggggataagggctcgcctaataaacccccaaagcgtaccatgcccaggaaaaaactggctggccgtgcgataccaaagatcagaacatcctccaggtattagacctctcgatatgattccgcttcggcatgtttttctcatgaaaatgatactgaatactgaaagaacactctgcaggaaaccatctgatatagatccatctggaaaagaccctgatccggctatgacagagcaaaatatatccaaggaccccgagccgactaatgaaaaccagccgactgctgaaagccagccgactggcgcccatgcttcaggagatagggccaatccgagtgacctgccgccgactggaaaccagtcggcaacgactgaaacggcaacaactcaagagcccccgactggaaaccagtcggacgcaggccctgatccagagattcccgaagtagaagcgcagacgacgacttcgcaaggaccagaggttggtaacgactcgatagctgggtcttcaggtaaagaacaaagatctcctcacgctcagctaggtacatcttcaggttagttgtcttctcaaacaatggcgatttaaataacctcagtttatccgtctaatatcttggaaacacaccaggaccatcagatgatgacggggaagaaattcctcgcataaaggcgaccgacgactctcgtcctcctatcttgatcaaatggtgggatgagaactcacaagccgccggtatagtcataaaccgtcaaaaagaagatgaagaagtgtgccagctaaagaaagcgcttggagaagccactcgtattgtaaatgtaagtcttccgggtgacagccttcgataactttgttctctttttagcagaaactaaaccatgatccatcatgcagagaatccatcttcgcaatgaggccaagactacaactttggaaaagctggttcctcatttgggaactctagaagcagtcagggaccagctgcatgaggccaaggagtgcgccaaaaagacagaaaaagagttaagggaccgaatcgcccagctccaggatgcaaacttcgaactaagtggttcttcaaaaggtaatcatcccgatctgttccattgatttatgctgtcataattgcatcctcaaccatctggatttcaaacagcgcaagccgccaggatggaacagatggcgaggcaaattgaagccctggagagagacaagacagaactggctgcgcaaagggactcagccttgaaggaagtcgaaggtagcgccagctaacagtctgagcttctctccttataatgcaacagatgctcatcatgaatgtgttttgtagatcgcaagatcaaatctcaagctcagtttgacgtcctggttggtaagatcaagaggcttgaaggagcaagggatgacgtcgccaacgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggccgacaaaattgcgagcgatgttgtagagcaatttcgcaacaacgacctccagccgagtaatgaagactctgatgatgaaagaactgattctgactgatcatgaatgtaatgtatggaggctcaatttgtacaatactggtgtatttatgctgtgcttgatgattcttgcaaagtttttgatttcttaaaagtttttgctaagctttgttgagcctaaaacccaaagaagctattaaaaaccttcagtcctcgcaaactaagtagaaaaaccaaacaaggcaatgataaaccaagtaagcaaactgaattgataaaaaatcacactccattattatgatgatagcccccgactgacaacttcaaggagaaaacttgacgtttgacagtcaaaatagggaaatacaatgataaggttaagcgtagatggatccggggatgaatccgccgagtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacacacatcgatcgacaatttcgaataatctccgagtagtcgtgatacgcctcgttgccaactcctgggtagtatagcaatctctcacaccggacttgaaggcgcggattacagaagcgtcggtgatttcggggattgtatttctgcactcattaaagcgccgaacataatccctcaaggattcattcgggttctgtgtcaacgcatgtaagttgtcttcgatcgcgtggcgcttgtaagttccttggaagttggcgacgaacttctaccacaggtctgcccacgaagaaatcgagtagggagagatgcatcagccatgaacgcgtggagcctttcaatgcggttggcaagtaattcgccaacacgttgtcgtcctctccggcagcgtagagtaccgtggagtaaacctgaaggaattcttgtgggtcagtactcccatcgtacttctctattgctcctggtcagaatctctcaggccatcggacatcacgtagcgaacggctgaaagctctacacccagcgctgggggtggtgggttgtcggtgatcgtacgtccttcgtggatgtctatctgatgatgaggatgaggaagatgacgacgatgatgatgggtcacttgattccggtgtacgattacgaggacatcggccgggttatcgagaatcctgttgtcgtctcccgttgttgtctcagcgccgatctccatcgtcgtcgtcattatggcgacgtcctcgaccagtatcgcccagcacccgcggttcgcgatcgtcgtgatcgtggcggttgtggcggttatcacgatctcggtcttcgctcgaacggcctcctcgttcttcgttatcgtgacgccgtgaagagacgcgatgtcgggaacggttcttgttgtctcatgcgcgtcgcgcctctcggcggccatttaggtgatcgcggagatcgccggtgccacgaggtggaggggtggctcgatgaggcgattcccgctgttcagggttttcaccattagcaccgccagttggtggctgttctaggtgcgctgcagcagcagcctcttcgaacgcgttgctgaggttggtcactgattcccgtaaccgttctgtccatcgtgcgagatcgtcgttcagaacgggatcgtaaggggtttccctcagtattgcgttgacggccctgatgtgctgggctggtgtagtcacttgattctccgcttccgcattagtgcgcgctgatgtgccggtctcatcgatagccaatacctcgcgcggcgtacttgttgatgatgagccatagtcttcgagcaggtgcaagactgatggttcgtggggatcgatgtcgattaccccaaggaatcgatctgaaatcaacgtcgctccttgttccttgtcctcatccttgagggggatctgtgactgctggaccttaggaggtgacgtcttcatggcgctgagaaagaccttgcaggttgagaggtcgtgattctttatcttgtgaataggacaatagacatcacgggttgaagaagtacgctgaattccacgctctttgtaggcacgaatttcagtgtggacgttgagaaaaacccagcaggcttgcaaggtgtgttttctggttttgtggataggacaccaggaccttgacctcggaagtcatcctcgtcggctcgtgattcttgtcggaaagacaaggtttggccgcactaggatccttctcgggctcggatgtcgtcgacgttccgttctccgcttcagcgggaggatccttcgacatggagtcatcctgggttgtagctattgtgttctcgcttccgatcattgatggaccagccgagatcggcaccgtggtgtaaaccgggaagacgatttcgttgacttgaatccacaccagcattgttgaagtaggaactccttggttgaggttggtgttgacgctgttgtcgacgaagctggttgtcatagtagtagaatcttgaacaccaagtccccctacctggcacgccactgtcgacgggggatacccgtagactggatatagagggtattggggtacgctagtacgaagatctacgtaatacgacatc

SEQ ID NO: 14525 - DNA, 3289 bp, Oryza sativa
  unsure (1)..(3289): unsure at all n locations
taataaagtacaaatattactctaattaataagcgaataaaatgtcattacagaggtagatagttcctctcaatcaataaagatctaagcaccggaaaataaataaacggcgcagacggctccactccacaggcagcttgaccaaggctacacctattcctccactccatcagcctcattgtagaactcttcctctgatgaatgattgcaaggtgagtatatgacatactcagcaagccacgcagcaaatatgcaagtgcacaagataacaaaggatggcataatagggtttcatttgcaaaagcagcatttagcaaacatttgagaatttaataaaacagttaagtaattaaacaatattaatccaacgctatacaacataccctgttgtataggcccaaccattctgaacaaccaccccgtctgcacagttctatctccaaaccaggaatattccattccaaaccaggagctaatcaaattattaccaatttaatcatcatttactatggtgagaagtgtgaaactaatcacgaaagacattgttagacccgcccataaccgctggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaaacagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaatcttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagagggtttattgcgtcagcgggctagggtttggtgaaccgggcgcacgggcggcggttcacacgaacggacggccgagatcgaaccaatccaaaacggacggccgagatcgatcgggtccacggcggctcacggcggacgaccccgatgacgtcagcggtgacgtcaccgacagcggcggctcggcggaggagacggctcgaacggcgcacgctcgccggcgaacggcggcgcgaggacgcaaacggagggcaccaagacgaagcgggcggcacggcgaactcaccggcgaccaaaacgacggcggaaggtcaacggacggcgacggcgacgaggaggaagcggcgaagctcttcggcttgacgacggcgacgaagctccgacgatctccggcgacggcgaaggggcagacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccggggatccttttaaaggggctaggaggcgacgacgaaggcccatggcggcggcaacggcgaaggaaagctcggcttggagagagggaaaccgatccgaaacgaactcgattccacgaacttccaaaacgatttagccaaagattccaaaggagaaaaggtagaggagatcccggagattgtttcccctctatcaattcggccggagaaggaaaggagcggccggattggaaagcggcggcggcgacgcgaaactagggtttcggccggaggaggacgacgaacccgacaggtgggccccacctgtcagcgggcggacgcgcgcgcgcgcggtggcggactgggccggctgggccgaagagagagaagagaggttttgggccgacgccaaaagaagacttttaaaacctttttcaatttaaattatttcttaaatgcaattccatttattaaaatacttccttagctcaaataaatcccagaaaaatctaggaattatagaattaagcaaagtatttaatgaaattttatctggccactttttatattggcatttattaattaaaactagatcttctcttcaagacttttaaaattatttctaaaaattccaattaaacaacaatttatatattttgaattttcagggtgtgacagcgcgcaagtataccatatcgatatgtgacgtatgtcgaagggtaaagggtataccttacccgtaaccttgacaccagctctgagtaaggtcagaatcatgacaaaattttgaggacagaggctgtgtttagttccttccaaagttggaagtttgggttaaaattggtacgatgtgactgaaaagttgtgtgtgtatgacaggttgatgtgatagaaaaagttggaagtttggatctaaacacagccagaggtgagcgtggtgcgaggagtgagaatttgaaggatttttttatattccttattggtggtcataaagtaaaagatagccttnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14526 - DNA, 480 bp, Oryza sativa
cgcttttgttttcttccgatgatgaagccgatgcgggatctccctcctccggggtgcttggagcaggaggagggcctcgccgacgtcttaggggtgagccccggcggctggcgcggcggccggcgtttccggtgttaggggtggagacgcctctttcttccagtgttggggatttctcccgcgtgtatcacgcattcacgtgttgacgaggagaaggcacataggcaaatatgtactttcatagcttccttaattttcacaagcctgttagaaacgacaaacattacaggacagacggagtataatgcacaactattttttttaacgtttcataatataaggcatggataaatgcatgacattaactagcacctcttttctattaaattattattatttaaatccttcattctcaagatttttaattctattgggtacatgctttatatttatttgggtgatccaaacaataaggtaata

SEQ ID NO: 14527 - DNA, 738 bp, Oryza sativa
ccattcaaaaggagggttttgacccttcaacaattccgggcaccagtgattaaactaaagtgttatgcccctaaaaccaaacaacagcttggtaactaattggcccttaggatatggtaacaacatggacatatttgacaaaaaaacatcacatcccaattatatgatcaatcgtactgactacatttttttcttacttttcctagtagtgctgatctaatcccaacagcgaactcactttcagctcctccaaaccaaccaacaggtccagcatacattccacggtcaaaaatttctgatggacataacaatagaacattcactgatcaccataaataaaccttactttcatcaaaaaatcttttatcgtcaattttatttgtaattatgaaaataacaatatagttgcaatagattatagaggcacataccataatcttgtatgaattggcgtgcctcttcagtgggcagaccacaaacggctgggctcggatgaagagtatttaggatgtcaaactgcaatggccaggccaacacaaagaatcagatcgggtgtggtcatttttttgacaatatggtaaattaaaatccaaaattcttcttgcaagtaaacccccaaaaattctgaaaattccaatataaaagactgaagaaagccctgaatcatagactacctcatcggcttcattcctcattcttgcagctaactgagctgacaggtgttgtactcttggaagt

SEQ ID NO: 14528 - DNA, 592 bp, Oryza sativa
tgaatatttaaaagaaaagttatatggtcatagtttcttagatataagccaattacttcgaaaagctctagctaaagaaagccgcgttagagaagccaaaatcgcatagaatgtcaggtctgatcaccctcatgttaatatagttgatcaacaaaaatcttcggatgatgagacaattgttgtatccacaaccaaatgggcttggaactccaaatctaaaccattcgtttggtcctctcttaagtcggtggtcgcaagaattggcaagaggaggtaaagttcacattttatatggccaaatgcgataggattttttactacttattagaaaagaatcaaattaaattgtcacaaggccgtgtcataccaacacttgaggaattgaagcggtgagtatattgtatgtggcgcaactcttattctcatgccacaaatcattgcaatgtattccgtagacaaattcaattggcccttgatgaaggatgattgacttttacaaaaatgcaagtggatgagctaccttttcctatacgcaccattggattgcttaaggacaagaacacattgaagactttaaaacttagggggggca

SEQ ID NO: 14529 - DNA, 619 bp, Oryza sativa
atgcctggaataagaacaagtatatagtaaccaaatactactgtactgacaagtgcatatgcttcccatgttttcttccgtttttgatccaggtcatatgctggttggatcacaggggagaggcatggatccgttgctgctccttggcagcttcttgctcatcgctatctggccacagcagatggtaccagttgctttcacatgctgttcatgtggtcagtggtgacaggttacacgggcggcatgaatccaagcgaaatctgattatattttggtgtgaagatcatcattggccgcaatgctggcaagtgctagagatggtctatttaccacaggttctgacaacatccccaaccggtaagaaagaaaagaatctgagcattttatagccttattaacttggctagttaaatttcaatatttgatattgattgttcttgtctcctcacaaattatgggtttgtatattccttgtactgcacgagtatctgctccttccatcttaaattttgcatatgttaatcacaagcaccaaagaagcccccaagaaggccctccgttcgttgacgctgctggtcgtctgggagagatttggaatgaaagaaaccgtagaaccttc

SEQ ID NO: 14530 - DNA, 678 bp, Oryza sativa
tagattgatttgcaaacttatcagaatattcaacagataaattggcaactaaaatattttttttctaaagaaaatcataacagtatacattttttttcttgaaaacgcataacagcatacttactgatgttaatgctctcacttttcctcctagcccaccgctcatttatgctgtcctccagcttgcttagctggctgataccatactgtttgacaaaaaaaaaagtgcttctggttcaaaactaatgaaaatggacacaattcaaagggaagagaaaagtcaaaagatgccatgaggacactgatgtagatcatgaaaaaaaaaactagcaatagctaaattcaaaggaagccaggctggaaggtgaagatattcacctataggttatagcagcataattatcaacacacttgaagcctagaaaataattttaatgagatacatacactgatccccaaatgtcatagttttaaattaaattttttattaagattggcatataaagaagatatatcgttttatatctcacagaaattgctcgggaacttgacaagtcattctagtcaaagcaacaaatccatatagcagtgctctgttgtaaagactcacatataggctgttaagccgtacacaaagctttggcatagtaagttgtattatttcacttgctttcctct

SEQ ID NO: 14531 - DNA, 593 bp, Oryza sativa
taatttagtcttggtattttacagttttcatgtccctcggccttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctga

SEQ ID NO: 14532 - DNA, 679 bp, Oryza sativa
  unsure (1)..(679): unsure at all n locations
nnnnnnnnnnnnnnnnnnnnnnnnnnnnnnnnnnnnnnnnnnnnnnnnnnnnnnnntctcctcttcctgtttagtaaataagaccaaggaaactaaatctgcatttcctccatttctccccaatgcagttctagcaaattgtggtacaatcttgaattttagtcatgtcattgctacgagaagtaatgcaccgcttgaatcaaaacttgaaattcttcttcaggtaaatcaccacctcttgctgaaacaagtacagtatgagggttaatgctatatttctctttttgataatctcatttactttaaggaagctgggaggggaaatatacttacaatcaagcaaagaattatgcagcctgcagctccaggaaaaagggcataccagagttgcaagtggtgaaactttggaccatcaataaacaagagaggcaagcttgcagctgcaatcatcatggaaatggcgagctttgctatgatgcatttaagtagagtacaaaaacagatgtcaatcagaaatatttttttaaaatctgctgagcacatctaaagcaccacatccctgttgaaagaaagattatatacctggagggtgtgaggcgccttgaattgtcatgaatgctatggatgcagaaagagcagcacctcttgccaaccatccaagcccaaataaagaaagggc

SEQ ID NO: 14533 - DNA, 8327 bp, Oryza sativa
aaatgagataagagacaaggaatttttcaccgaggttcgaaaactctccggtttcctaatccctgttgaggcgagcccaactccaccgctcaaccacgaagccaccgcacgcccccttcgtcaaggggtgggcaaggcgggagccggcccacggagaggactacccaagcctcgatcactcggggtagttcttctttcactccgaaggtggtgaactctaaaccactcacaaacggtgctgggcctcctccacaatctcctcggagaggtcactgggcaacacctccacgagccgtctaggaggcggaaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggaatgccaaaaccttacccttgctgctggggagtgggtatatatacccccaaccaccaaaactagccgttggaaccgaaatccccaactttgtgctctgccggtcagaccgccgttgtgaggccggtcagaccggactactttgtaacggctagaaaactagccgtaacggctagaaaactagccgttacagggcaatcattgagcccagtcaacctggccggtctgaccgcagtgtagtggccggtcagaccgtccacggctcggtcagaccgccgtcggctcggtctgaccggttgcggctctggcggctctgtatcactaccaaaaaccagaccagtgcaacagaccagtggggccggtcagaccggccttaccacgccggtcagactggctaacagacccggtcagaccgtcctaaggcccacggtcagaccgcaggtaacttttcagctcaaccgaccgttagtaaaacggcgatatctcttgactcgggtctcggaatttggcgttcttggactctatggaaagcttattcaaagggccatccaacccatgaaaaatacatacaagaaacacaacttaagtcggggataaagggctcacactccagaggatattcaccggacatacccacaagatgttactcactcctattggacatgcccacttatatctcggttaggacttgagaaaactgatcacacttggttagacaagcccacaaaatgcacctacatgcatatgaactaatatggcacaagatcatccacaagctcgcttcatagacccctcttgatagtacggtgcctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcatttgtcaagactttattctcatcacaagcttgacttcattcttgccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatggatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaagacatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattatttaatccaagatctttcaatcttttctctctttggtgatggataataacccgatataaacaatatagagagatgagatgaaaactgatttcaaatcaagatagaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttacagccgctctcatgttaccgccgcccacggtatcctctatcccgtcgccacgtcctccgccgcctcctctcccctctcccctacacgaagatgagcagcggcggcggtgatgactggaggggaggccgatctgcatctgtgtcgccgctgtcgccactccagcccccgctcgccatcgccgctgatccgactcccgctcccgaggtgcatccaaagggggagagaaaagaggaagaagggagagagagggaggaggaagaagggaaggagaaaggatgacatgtggatcccacaatatattttgtgtgtgattgacagatgggtcccatagatattttttaattctaatgccacacaagcgccacgtgggacgaagactgggtcaatgccgccatgtcaacaaaaccgccctcgaaaaccgctggaggagtcgatttgtactggttctagtaattgggggagtcatcctacctgattttctagttaagagtcacgaactagattcggtgaacaattaagggagtctaagtggactttttccatgccgctagcatagctagctgcatgtgggctggctgtcggcacccggggagggggggtgggggtgtgattaaggtcatctttgggggttaagggattttggagtttttaaccttaaatttggagctgattttaaggtttttttcatcgaagtttatttttcagcatttgcttttagatcgttaagaacatgcatataaaagttttattcacaaattacttttcgtttggatatatgtcgtttcgcttattccgcgaacactcccattttgctctgtatcttactttagacttcatattttagcaaggtcattttcataaaatttaatggatttacatgtgaaaatggagagaaaaaagttacactaggcttgttggttgctttcaaaacctttcgacatgttcagcttgttgttttgtactaactgataacaataaagaagtattcttttcgaaaaaaaaaagtatataaatagaagtataaaaactgtaccctaaacttattttctttgtttcgatcacatgtgttcaactttacgcagttaaaaaaaaaagtcaatcagctgtacgttcccagatcctcattgatgggacgattatattgtttttattcttcactaccataattcggctgatctccggtgtactaaagaagttaggaatctgattcggatactcgtatgttattgtgccctagtacattctgggaaaaaaacatggtaaagactgatgagattcgagtttgcatgttaacctgttgtcattcttaaaagaacaaaaacattattgttcacgtactcacgttggatcgggtcagaccatcagggtagcacaaaccatgtaatcacattattcttagattagatgaagattcatctcatattacatctctggagatccttttttttaaaaaaataaaagaatggccaataacaatggtagataggactttaactagatgtttcaactcgtatcttagttttagtcaactatttgaatacggaacaattttgacaggcatgaacttctttcggtacctaaatttgcaccaccatgagcataataaaaaggctactagcccatccttcgatagttgtttattggttagctcagtggttgcctctttgatcagtcccaagagccgcctcctgtagtcctctgctggattctgtccttatttttctttcctaggaggctggattacaatgtcgacactcgacagccaggctatgggcacccggcattgcacatgcaaaataatttcaacaaattaagcaaattgcgcatgtcagaccccagtttgttggtggtcagaagttgtaaccatcttctaatgtaaggtgctgtaacgaaatatctattggagacttacagttggaacaacagaaaataaattctaagtagggctgaagacaatttgtttgttagtttttcaatcttcttccttcaaagattagaataagtggaaatgacgcccttgatcagcaagtaagcgagcggtagttcagtctccgacaagtgaggccgaactagcccctagatcggctctcatggtgggggaatcagagtcaagttaggtgcaaaagaggtaagtttggaactgatccaatgcaaacatatgcaatttttttaacgaatcggcgagccgctaaacaaggaaggagtaaactgcacagtataaaagaaaaaacaggaccaaagctttggtcctaacaaactaagttataagccaatttcccagatgttttgctcctgctaagatccatgctctggcctcctctttgattttcgtcagcaagctattcgacaagagctccttttgctggaaggttctacggtttctttcattccaaatctctcccagacgaccagcagcgtcaacgaacggagggccttcttgggggcttctttggtgcttgtgattaacatatgcaaaatttaagatggaaggagcagatactcgtgcagtacaaggaatatacaaacccataatttgtgaggagacaagaacaatcaatatcaaatattgaaatttaactagccaagttaataaggctataaaatgctcagattcttttctttcttaccggttggggatgttgtcagaacctgtggtaaatagaccatctctagcacttgccagcattgcggccaatgatgatcttcacaccaaaatataatcagatttcgcttggattcatgccgcccgtgtaacctgtcaccactgaccacatgaacagcatgtgaaagcaactggtaccatctgctgtggccagatagcgatgagcaagaagctgccaaggagcagcaacggatccatgcctctcccctgtgatccaaccagcatatgacctggatcaaaaacggaagaaaacatgggaagcatatgcacttgtcagtacagtagtatttggttactatatacttgttcttattccaggcatcaacatctgcgactctccacggcgctgaagagctaagccgccttctcttgccctcacgtccacccaagaggccatccatctctctctctctctctcttgaccctatctcctcttcgccgctttatcctgcccatttaaatacccatactgtgcttcttggggagagagaaggggagagagagagagagagagaatggcattgcagcaacgaccggggatgctcggcattggctgcagcaacgtcttggcacgagcaagggtgcagcaatgtctagcagcggcgtcccactccaatatgccatgtctacccgtcctcctgcatgtcaatggcagcaagaagcagggtagcagcttcctttcttctcagaggatcggcttaagtaggaggaggaggaggagggacctgagcggcgtcgttgtcgcggaagtgagcgccgccgccggtgtcacgccggcgtcgtcgtcgtcgtcgcctggcggcatcagcgtcagcgatgttctttggccctccgccggtgagtctgaaacttgaaacttgtcttcttcgtcggccttcgttggctgggtctctgaatctccgtgctttttcgccaagtgaattcagcgagggcttggtttcctctctgtgatatatttttgttgaatggttgtgcagagaaaaaaaaagactatttcttgcatatagtagtggcaaaaccacaaaagccgtcgagagtttgatggttttgccaataaattttatagaaaagcccgctcacctgacatatttttcctcaaataatgataacgtgcaggtgcattcctagcaatggccgtgctgggaaggatggatcagatgatggcgtacaagggagtatcattgacaattgcccctctcggagcagtctgcgatgtgcttttcaccgctccaggctcacctgctgccaaggtatgaatagcttaacagttaaatattttagttacaacatcgacagtgactcttcaatactacaagaaaaattttctatgcataatgctaccttttattttttttatgggaaacaaatgttctattatccttttctaagatttttgggcaagtcggaaaccctaagatgcacagatgaattaatcgctgccacttactgtactgactgaatctaatggacacccagattatgttgatttgcaaactagtttctcaaattagaaaaaagatctactaaaaaatctgcagcatgtagtagcaatataatgcttctaaatttcagggtgtccatgttgtcgtcgactgaaaaactatggctcatagaactcagttgaaggcttggaaccatacctctgttttcctttctgtagtcatgactgaaccacaaaagtagttatgtacgatttttcggtgtagtaaaaatcattaggtgtttccatttgggttaattttttgagattggatgaacacattccagttggagtcctacaacaaatctaaaaacattcttagatcatacgtgaaatcaatactaatactagcaggtgacaaaatcttgcagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccaggtatataatctttctttcaacagggatgtggtgctttagatgtgctcagcaggatttaaaaaaatatttctgattgacatctgtttttgtactctacttaaatgcatcatagcaaagctcaccatttccatgatgattgcagctgcaagcttgcctctcttgtttattgatggtccaaagtttcaccacttgcaactctggtatgccctttttcctggagctgcaggctgcataattctttgcttgattgtaagtatatttcccctcccagcttccttaaagtaaatgagattatcaaaaagagaaatatagcattaaccctcatactgtacttgtttcagcaagaggtggtgatttacctgaagaagaatttcaagttttgattcaagcggtgcattacttctcgtagcaatgacatgactaaaattcaagattgtaccacaatttgctagaactgcattggggagaaatggaggaaatgcagatttagtttccttggtcttatttactaaacaggaagaggagaaaaagcagattgatcgatacctgattgtgaatttgtgatcacagtgcagaacatgcaaatatgaagtacataccaatatctcatttaatgaaatctgataagtgtacaaataaaattccttcttttgtgattcataattgctttcttcatgtaatatacaattttgcacaaaaagaaaaaagggaggaaggaagttcacctctgttaatctgagggagattgaactatttatcctggctcctggggcacgattgcaattgcatgtacagttgcaataattacagattgcacatgtgaggcaactagaattcaaaaggaattaaaattatgaaatataagtggaagcgcaggaacaccaaaaaccatctatggaaaacctacagcaggggcacgctaaactaatactccctccgtcccataatataagggattttgagtttttgtttgtattgtttgaccactcgtcttattc

SEQ ID NO: 14534 - DNA, 2373 bp, Oryza sativa
aatttgtgcaaatataaaaaacgaaaagttgtgcttaaagtactttggatagtaaagtaagtcacaaaaaaataaataataattccaaatttttttgaataagacgagtggtcaaacagttcaagcaaaaactcaaaatcccttatattatggaacggagggagtagaaccacaacaggatacattgctgaataacttaattacataattcctcctgcactagtcctccccctgcttccccaccttatatacttggctaatcagtctatttgagtctcaggaataaagctatccactaatatgtgtcactatacatcccagccatcacctcggctgttaaagaacctcttagcagttaaatttccatatatttctgaaaatttagccaggcatttgctcctaacatgatagtgtgcttgtgtgtttcggctgatggcaactcctgagaacttggacatatcaattgcccaagctggctttacatactccactgtgcttgtcaagcttgcatttgcaaacaagaaatttagaaggatatcctcacaattgaagaaactgtctacaatctgtcttcctacctcagcttccttgctccaatatttcttgaaggccaaaccatggtccataaatgctgcgcctgtgagtaccatgttataacctccttgttgccgagcatacctctcattgcggtattccagtgggctgccttcagaaaggcgtggatagtacccaatgatcctgtcagggtgctccctccacaccttgaacccacgctctaagtcatcgcatgtcatcataatatcatcatcaagctccataacagcttttgtcttaatttcactgtctatgttgaatctgttgttcagagagttcctatcctcaactctgatcctaacaggaacgactgacttcaattcaccttgagctgggggctgccctttgttccagaccactacaatatccctcaccgatgcacaattggaataatgctccacaaacatcttcagattccaaagccgggcatcgtaggtcatagtcaacaatgtgaactgtgagtacttgcccttgattggatacggttcttctgcaccgttgcccccatagatgtagtgagttccaacacaagttagaaccactaaaattaacattactacaactacataaactcgccctttacaggttctgtagttaatccttccacaaataagagatcccagtttgttcaaattggagatcagagagcttagcttatggtatagaaagaacctctgctctacattgaagagcccactccttttctcagtatgcgggagagaccatctgagtggtaaggaacagttaattgtaccaataagcccaccagtgacaagaactagtataagaccaactccataaatcatgtaacctatggtcagacggtgaactgagtcacctgaaggtactctgtcaccatccattacaccaatccaaggtttacctgatggaagctgctggacatcaaggtgatgtgagcgtgccccattccatgcattccggcccttgagttgcttgttgatcacaaatgggacttcaacttctttgtattcatttgacttcaggatttcaactttgaacacttggataccatggccagatccacccccttggcctttaccaacacgataaagattgccattgtaaatgaatggcctgcccccatttctagtgcttaacattttacctgtgttatgaatcagattctgcttgtgtggaatccaaggactaagtggagaattactgtaccaaatactgatctctctatttcgttttgcaccataagaacttaaatctgttccaaggagccaataggaaccctggaaatttatgataaccgaatctaccaatggcttctccaaaaggaccttttccaattcccacttgagcggaaaatctaatgcacgatacaaacgaatatctccattcttgctgctttcaggcatcatatagacctgtgcagttagtcaagtaaaagcatatgtgactatgtgagaatgattgcaatagcagttttctccaacctgtgagtgaaatatttcaccttgtttttgtaggtaaacacatatgggtacgaaagatgccattcctcatctaacactactcccagctgctgccatgtcactccggcgtcctcgctcacagcagcagcaatgtcgccttgcgacgtaatgggattctttgtctcaaaaaacatgtagatggcatccccctgaaaacaattcagttgcacatccatcagggctggatacagaccaccatgatcgtgagcgaggacgcagtaaatacacataaaagtgacatgaaaaccaataaatttacatcctcagatatcagata

SEQ ID NO: 14535 - DNA, 972 bp, Oryza sativa
ccatcatcggtccctaaacttgtaccgttgtgttatcccggtccctaaactcgcaaatcgatcgttcaggtcctcaaacttgttcgactgtgttatcccggtccctaaacttgcagatcactcgtttagattctccaacttgttcagttgtgtcaccctggtccttaaatttggatttgaatatcatctaggtcaaatagaacggtctaaagactttatatttaaatataactcataacttttttatgtaaactctaatgaagacaaccttcacatcatttccgaacgcgcagactataacagcaatatttttgaaacagtttagcaaatacaaacttatagccgaccgctcattgcaggaaatagcaagaactgcatgtcagtcatacagtacattttgggttatacctgatataattgggtttttggctgtgtgaaaattagtctgtttttattacatgtgtgaatggaaggacatgcacgtcagcacatgcacctgttccgtttggaattctgttgcttagaccaagttcaatttcaaaatataatatgatcatgtggacttcacaatatttgagtcttcaagttctatgtttacgagttctatgttttatggttccaacttaaatattttaaattcctttttagcatcacttgtaaaggaaaagtttgtttcagtattcatgttacctgattaaattcgttagcattaaacaagctcagccaagatggtgaaatgagatcaccgagtcctctgtaaaatgcatttgcaaaaggcagtatctgcaagagattatggtattatcaaaaaggctgcttattgataaagaacaacagtttttagaacatacaagaaagcaaaccaagtaacaaacctgacgattgagcttgtagtctgctatagcatgaacatagtgcaatttattttcatttgtaactgaaatgtttttaccaccaggcctcagttcatgg

SEQ ID NO: 14536 - DNA, 1224 bp, Oryza sativa
  unsure (1)..(1224): unsure at all n locations
ctgaaaagtaaccactctcactgaaatactactaagcaagtctaccggaatactgttacgctgacgtagacatgagtaagcgcccagattacatacacacacctatccaaaccccatcatccagttacgccgactttggggattattcgcgtcttcaccgacctaatataagcgtggttacaaatctcaaacccaccaaaacgaaccatcttcacctaaaccggtccacacgccgggtggccgccagttcagcgagtgacgacgacgaccccccacgcgcgggggccgcgccaatttccgtcgcctccccgccggccatgtcggtgccgcccgccagccaccgccaggttccccctcttctccacgccatggtagattcctctccctccgcatcgctctaccgtggctgattttttttttgtttttttctggttgctgtaggtgtccctgaggggatcgagcgcgagggagatcacccgcgacgcgctgctgcagaaggtctccgaggagcgccagctccgcagccacctccgccgcgccgccgccgcggcgctctccatccaggtacctctccactcctctcctctccgcggcctacctaccagcctcccgatcttatctgggaatctcgtcgttcttcatgagatatacttttacttttacgttttattcttttgcgaacttcgattagatcgtgctgtgccttgttggtgtgttagaagcaatgcttttctggagattgtgtggagatggatttgatttgtttgaattaagtgcgaggtcatatgaagattttttttgggaggttgatgtaattattggtccacaatgattacgaatttaggatgcgcatatcaatctgaatgaaagtgttgctggtgctaaattttgagagttggtttaagcatgggtgagaggtctgacaggtagagaatattgagaaacccataattgctcagtgcctttctagatatttcattaacaaagtcctgcaaagatactgagaagcttataattagtttttgcataaataatatcagcagctaaccaagtctgcgaaccaccttatgtggccatttcaaaaagaagtccacagagtcattaggcatgtggctgttgttcatatgtgggtatgagaaacacaaaaatgatggatggttaaaacataaannnnnnnnnnnnnnnnnnnnnnnnnnnnnnnnnnnnnnnnnnnnnnnnnnnnnn

SEQ ID NO: 14537 - DNA, 8194 bp, Oryza sativa
agatgccattcaaacaaatttgatgacatggcaatatcattatgaagagagattaaaagagtttcatatatatggaactggatgtacactgtttctaagactataaaactatttgaaactggcattgaggagctcgagtattccatttcatccaactgcattcaatcccatgcattattattaaatgttatgactaacctaaaaagccacaaaatgaaattgtacactgaaggttttatttcatttatcgattcaaaactcttttgacgacataacaatattggtaaccgtgaaatgaaactttttgctaagaatggacttatacgatttgttattaatactttttgtaatttgtaaaagatgtgcccattgttgtattaagaagatgttagtacaaattttaagtgttgtctactattttatggaacatgtaggttttatccacaatgataatgttttaaacctaatacgtaaaagatgtgtatattattttactaagatgtctctacaaactttaagtaatgtctattatttatcgaacatgtaaaatttacccgtaaagatggtgttttacacctgaaatttcatatgtcacattatcatagacgaagttagatcacaagatgcattcgctatacctctaagaatcagagacattgtttcctttttctcattgcatcctcgggtaaatctgttgagttatttcttttcttcacacctaattatgtatgtggcaggtgttttttttctctcgattatcacacacaccttaccttactaaaatcctcctgttgaaaaccaacttatatgtgtataatatttgtgaacaccagaatttaaagaatgatggatagaatcatgaacctatggctctaccatcaccccactggtgctctctctacataaatggtaggttattttcaattacatggaaatgcacacaccaccacatgtacccacctaccaatacacttgtcggagtacggaactcctctagcggggaagctaggcactccctctatgtgagtttggctgggggagcaagttttgagcttgggtcctgattatgcaaagggaatggacacaaagcgagtatacatgttcgaaccgcacatatacgtaataccctactcttgtatggtggacatggatgatgaagataattataagtaagatgtgaaaagttcggctgtgttcgggagtaagggttgggaaccctcactccccggcacggaaaacggagcagcgattagcacgtgattaattaagtatttgctaattttttttcaaaaatagattaatatgatttttttaagcaactttcctatagaaactttttataaaaaacgcaccgtttagcagtttgaaaaacgtgcgcgcggaaaacgaggagaaggagttgggaaaatgttctaccgaacgcagcctaagtgaggaggagaagatcctttctcacccaatgtttggctaacctagattagatgagtgtacgagcccttttatcggtggcatggatcctccttttatacgtgagggggggggggtcgtcaatgccgatgcatgcatgtaggagtggcgcccactccactaaacttgatatgtttagccttgtcgctatccctccaagctagttggccagatgtgacaatcacacctatagactaacaagtggattagataggcaaaagtcttcgctccaattgtccctatgtctatctatgctcacttctacaccttgaagatgtagatctcatagggctgtatactcttattgataccttgaaactatagatcttttgagtctcatactcttcttgacactttgaagatgtagatcttgtaggtcttagtatgagccacaacgccccgaggggaacccctgttcccacttctccgataacactcaatagggatgtcacttgcaaaacttcatagtggaaatacactgcatttctaacatcacaggcaccttcttatatccttattcagtcccgaaattagtgaatcactgatatcccgggaaactttagtgtgtgtgaggaaaaaagaccaaaaccccttattaatagaaaactagtacattaaaaaggggtgatttgtggagaacctaggtaagaaagtagaaataaacttatcttgagacaaagtttcaactctaaaaattaacttattttatgacggaggaaggttcaatcacgatgagccaaatcttaattacacgtggaactgacacaggcagcctgtatgaaaagtgaaagcacaaggggaaatccatgcgcatgtcaacgcgggacaaagttggatccaggcaaatattttcaaagataatcagtaacattgatcaatctagagttacactgttcagcactctcacccagtgcagtcatgaaaaccgccacggctttatgtaagagatgcgaaatactatggtcttggtgctaggctgctagcttcatcaggcgtgcagcgaacgcttggtccaaagttcagaaccgacgcccacgacagcattcgtgggagcatcaaagcaatctcatatgaatctgtacgtgcctccatcaatagctttcaaaatgagatcaaaaccgaattatttacattcctaggagtaccgaatgctacagagttttacaatatcttgctagtctttaggtatgagtacatgatgaaaaatccagccacttctccaactactattccaccagttgtcgcccaaaatgcccactgctccaaaataaactcgtcatcaactcatgctatatcaagtagtgccagtacgtggcagaaagcagaattgaactcaagagtgcaatgctataccgcgtttgtctcgaggtacgatttaaggttcatgccaaatattcctacaggaaacaaatacaacggttcaattatagcattacttcaagaataaagagtgatagaaaggaactgaaatttgaaaatcactagatacaaaagcgctgacagatttttgtacctgcaattaatgctcctatggcgacgcagaatgttccaacctgaagaagcaactcaactctgcttacttcaagtctccgggagctgtaaggatgcccaatgtggtaagaattaagaaaacccataatttatgaaatgtttgtgatgttgagctagttcacataaatttcacatccgccaaaaagaacaagatcccacaattctcaaatagtttattgtgattgtatgctacacaaacagaggtgcaggaacacaccaccttataccaagacccactctcataatttcatcttaaatcagttctaaaaaaataaaattatgggaatgcaatttgaagcactcaagcagtccccctttcttttatctggttatgctttgataattgaaacctgaaacataatgctggcattttatgttgcaaagtacacaccgccatggcctgtggacacccgcacaccacagagagtaaaggatggaggataatgaagtcatgcccccaaggccccaacccacaaaagaacatttgcaaaattttgagactagtactatgtacgtatccggtacataattggtgcgtcctccatttccaagtaattcttgcatttgctttcttaatttcatctatgttggagacttggagtgtattgtttgctcttaattggtattttctcgctagtcgccacaatatagctataaaatttaagaatctgaaatgtccatttgtagtgatgctaattgtagtttggttgtactgcaaatatgtgaaagatcattttacagttatctgatggatataaattctatttccatattggagaacgtgtttctctttctttttgctgaaaagctaccatgctacatgatcttctagatgcacgcagcctagctttatgataagtacagttggactcagtcgcttggatgaagggttcacaaagaaatagtagctgctagaaacagtttagaggcagcaaataaaatgcgatgtctgtttagatgcagggcttgcaaatcaaagaccattttagtccaagttggagtgacttcagggtgttaaacaaattatggaccatgcacatgatttggaatataaatgtagagagaagagtagaaaacaatggttgattgtctggttgaactagtaatttatgttcggttgtcaccttagatcgtttattaaattcaaaatatagtttttattaaaattcatacatttacacatatatttttactgtccaattatattcaagagcaaaaaaatcacaaaagtgagcattgttataaattataagaacacatgcattgatgaagctaaactttgtgagatcatgtggtctgtgagagtagacagaccttaagttgaccgcaattgaatcttccatttctcttgcagaatcaagaagtctctctgcttgaccatggattgattcacatctgacagtaagaatacacaatgaaggtctgcaagaaagaaacaagacatctgaaaagattgtattgcagatgaatacctttgaagataattttccaacaacatttcaatttcttcctcttcttctgttaaaacaaaaaaaatacagatgaaacaagtaaaacagaatcaaacagttaactactgacaaataagtgattgcaacactccttgtgaattccgcacatgccatgcttggaaacaaaaaaaaatccatgaaggcagtaatatgtctccaaaatataaaaagtccaatgatgctctcaatccataccttcagcaatctgcttctctaaaggaacggagcactccatgttatcacttaatttgtcgagcgtgcaatttcttcccattatgcatattcgacggatttcatgaggatcatctaggagatcaataagcatttgtttgagatcacctgctcgtgaacccagctcaaccttgacacatgaatagagacaaaattaaacttgacaaacaagtccaggaaatgattctaaagcgcagctttaataccaatgcttgtttgcttagacgaagctgctccaacacatcagctgtcaaccgatttggtagaacttcaagcaaagcacccacctgagatataagcccagatacccaaattattattttttccattataaatagagtcaatttgaacactggcatgttcttgatccatacatgactgaaacacaaacacaagaatacgacaacacctaaaataccacatgaaaatgcagggtcagcttggtagggctctttccgactgtttcccattttttttaaaaaagaaggaattctgcagtgatcatgtggcacggacacatggtactggtctatgtcttgtctgtgatttacaagggacttcaagaagatccttactccctagtgttaaacttagtaagtgctcagcaaaaagctaggtattgacagtagcttatgatttgtgcagttgacttgtgtgaagatcaggtgcttcaattagtccatttggtaaagatgtataaaaatatagaggaaggcgtgcaaatctgcagtcagggacttctaaatgccaaaggaaagagttagggtgcaggatatggaaataacatgcattattattggttcagttctgtatatatgtgctttgaatgaagttttcaaggttgaaatcaagaaaatagaggacaggaacaggaattcgtaagtgtcttaagtcacctattgacaatatatcagattgctccataaattgaatatgcaccagaaagtagaactaacaacatcaggatatacaatcttgtacaagatgtagagctagcagggacttttctggcactcacacgaggctcgatacgcattagccttcgctccaacctttgtattctagaaagcagggcagcttcgacaacctgaatataagagaaggcaataaataaccagatcatcttggcccagtatttggcaggaggatggtactctcaataatcgggtgaaaatgcaagcatagcatgacatgttggcaaatgcatgatggcgataaaaatgttttttgtcagcaatatatgttaaatgatttaatataataactaatgagaccaaaaaagatattgtacaatcaaaaagaacttttaaaatcaaagatgataatcctattcttgttcaagattccattcgaccgttaagagaaactaggaaaactcatggatgacaatcttattcctatgtgagttgaaaacaaagtaaaccttccatggaggcaaatataaatgaaacaattgacaaggaaaatatcatcatattaagactgttccagaccacaaatatggattaatataagaatatccatatgcctgatacctcaagttgaaatggcattgctggtccaccattgatatttcttggatttaaccgtggcagtaatgaatctaagaaggcctttcctcctgggctactcaagtcagataaaataattgataagtttcataacaatagtgatgttcaccaagtaaaatacaatttatattaaaatgactagtgtacaaactgacctgttgtaattgaatataagaacgcgttcatgcatagcaattgctcgcaaggaaccaagatttactaatatggcttgttcacggacctatatgaaatggtacatagaagcaatatgttgaactgtgaagcaggttgataaggcaaaaaattaacttctacataaatctagaatctagtaaccatgcaaacatagagttcaaatatattgatatggaagtttacatgaaaagctatacacaaatattctatgtatgttatcagttcatagtaatgaacagtggttgtcaagattacaatcacaatgcaggttactgaaaaagacagctaaacgaaatgtgagctggaaaatattgcagaattaaaacctttttctttacttctatctttgaataaaaaaaattgaactctgactctgtgattgactataataacataggtaattttgacaggcaacctgagatacttgtaacagagcaattgtactatcttcagactcttgtacatacacaattattagcatcactcattccattgtttgtgtaactgaaaattgtaggaaaagatgggaaacatatacagagtaaagtctacatgattaattattgaaagtatcttattaccagcaaggatggcattgaattcattagccatagcgatgggtcaacgcttctggtatctcgtaggcggaggcctataagaaaaggtcggtgatcaacataaatactgtcaatgagcttgacattcacaagaatgaacaaaaccacaagaaatggcagcattttcaaattctaaaactgttaccagtaaattatcaagcactatatgagagtttggtacagactacataatcatgttttttacagtccttgagaaacatattctttctacctaccacttgatttcaatagctgcctccggcttatttttttggtagacatcctcccattagattttacttctatcacctgagtaaaatttgatatccgggaaagttaatttgcatcttgcaatttgcagaagtcccagaatatgtaacaggcatttcattccaaagcaaacctacccttacagaaacatgcatcaaattagcatgacaattgcagatttattttagataagggagatgattacatccccagcctctgcatctaggatgcacacggccatttgagtttgcaaagaaaatgatctcaacgagggacataactccccatgacttgaaaaaaagagagagcaaaatctgaacctagagaaagatttattatgcatgaagcctactggtagccctccatccaaagttacacgtttggattaacggcatataatgtattgtttatttacgtttggacactcacaatgatcatattgcaatatttccatttggcttgttgagtggacttaagaccttgagaacatgagctattgcaatccataattctgactaggaacagaagttagctgatgcacgaccttgcaaccttatccgaatcgcttattagcaaataaaaaatcatttgtgagtaaagcttttatatacgtatccttagtgactaaaaaaacaaatgcggcgaataatctacaatgaaaaaaaatcaaattcaaaattaagttctaaaatttaaattttgacttatatgatcataagaatgagtcccttgctgtctccaatttaccattaaccattacaaggcgttcgatcgccgatcg

SEQ ID NO: 14538 - DNA, 4650 bp, Oryza sativa
cccgtgctggtgcggcggctggtggaggaggaggaggacggcggcctgcgacgagtacgacggggacgacgaaacggacgccatgggcgcgggctccgcgggggcatccacgcgcggcggcggcggcgacgccggcggcaaggtccacgtggcagctagctgccgcggcgcttctcctgttcctcgcttgttttttttttctattttttctttttttttttttgggatctcgcgcttctcgcctcgaagttgaaggcgacgacggcgaggcgagaaggaagaagcggcaagggaaaatgctatccagtagatgagctggtggctgagcgggctcgcgcgggcgggggcgatctgggccgtccgatcgcggatcggacgggggcggatgctccggtgggatgacgtttgtccgttacttctggctggtggggcccagttctattcatggtggggtgggctgccagctgttcctctgtttcgtcgtcttctccagcccggaatatgaaggtactggagatcagaggacccatgtgggtcccactggcagtgtccaccggcatggattagatatgatctggctactactataccgtcgtttgagttattgagtactccgtagcgtcgacgtcgtatagcgacggcggagggtcgctatatttagccccgtcccgtctcggcttgtttgtttggttcatgctattttcagccttgccggatttttttgggaaggacaaaaattggtttttgctaaaattttcgagaatgattgccatcgggtgatcgggcgggggagcagaactcgggcacccccccccaccccatgcacgcgcgctcttccctggtccaccacgtgtccacacacacaaccctattacaacaaattacccacatattttaaaaaccctttgttaagagaatttggtttatttgttgttccaccgaaaatgtttcatctactacactcataatgattcactatctatagatctaatgttgcagtgaattgaaatactccattgcaacaaatcatccatatattttggaaaccctcggaattcgtttcttttttttccaccaaaaaaatgtttcacttagtgtacttataatgtttcactatgtacggttctaatgttgcagtgaattgaaacttttttttcgttatttgctgaaacattgtttttatataaggtgaaacaacacccgattctaacgattgaaatatttccgttctacttagtgaaacaattccgatataactggtggaacatcgtgcaacattttaaaaaaagtcaataataagctaaaaaaatttcgtcgaaatatatccatgtgtggtcttgttttgaatatttaattacaacgaatttaatggtgcaatcggatcatgatttggataaataatttaagagaaaaaaaattttagaagagaaaaaaattagtttaaagtggttttacacatatgggtagcactgacgtcagcgcccgatttttggagatttggatcggacgaccgatccctagtcacctcctcaaatttttggcgaaaaatagctatgatttgtctggtctgcttaccaactttaagaagttatactccctctggatataattaattgacatttaggacaaccaaatatccaaattacaaagaaaatgaaaatgctcccgatgccgagtagttcaactcaatgagcggtaatttctggaaaatccctttgaactgaaattacaaagaaaataagccaggacttttctctaaaaccatgaatataactggccggaggtagtattttgatattcaagtaagccaaataatttggcaatgccaattttgttggctacaaagcaaccaggtgagacaaatgctaaagcgaaccctacttactattcaggtatacgccataaaaaagtttgcagatttctttcatgttatcaatggcacaaaaaggatttctgagtgcatctgagaattcattctcttttaccaacatgaaaggttagtattactctggacaagtttctttgggataaaagtttacgtctcccaaataaacccatccacgacatgaacgaccacaatgtgagatgctcgaaggagtacatattagccctaacaaaaactacccgttaaaaataggcactggacaagtgttaggaagggctacagcctacaggcctacagccaaacgaagcatctgagcactggagagaacaagaggtcagggacactagcgcttcatcagtgggctagcagccgagaactgcaagtaaaagaagttgaaggcctcaactacttccatgtaccacattgattcacggtcgggctgcgcggaaagatcgactagcttatgcacctgcaacaatcaagttcaaagtcgttaaaagcaagatgctgataagagtcctcaggaaaactaatgcagtgggtaatgtttaagtgcttgtacgtcttaaggctgaagcccaacaacagaacttagtttctagttcttttttgagaattgaaagtgacaactacagtaatctgcctagatatgttttgccaatgcctaaatctaacccaagcaaaagtgtactagattaaaagtatgaacaacaaaaatgagccaccatcttatccttgtcttttcatgtcaccaaaatagaagagagcgtggttgatacttaatacatgcaagaacaagccttccacatgatttcagtagctattgcaagcctgtcacataatcaggaaatacatggttcagcaaagatgaccattgcaaggggattacagattgcaacttgtcagtaacccgtcactctgctgcaaccctgcaactgttgttaccaccatgctgattggtcaatgtcaaagttactagttgtttctactatggtcatttccctcaaatttaggttggctcaagaataatgttatgtaaaattgacagctgagtagaaagttcttcaaatctccagatctaacacccacttttgcagactaatgttggccaaaattcagaaaaattatctcgaatgtaatcaaccaataaagctccaaatgcagtacatagtagtattagtaatcccttgttctttcaacaaatgtgttcagaatgtcaggttatgtttcatatcactaactaaaccgaatggagctttctaaaagaaatcatgtattcatggtttcaagcttttcagctacggttatcacttgaacacaaacagcaaccagaaaggcatgaaccaaagatttgcattaagactcctttacctattaaattgtctcttcaattataatgaatacatcatgaagatggcaattgcctacaaattgaacacagggtgttgggaacaaaatagaactgttggatacgcgaagttgagcaaactaacaatcgaaagagatatgataattgcatttgcttatagagaactgacagagtaatagataatggaaaaattacacttcaaataagattttgatatataaatggctcctacaatctgatatggacagataacaagcacaatgatacaatatgtaaccactttgtttctgtaatagtaatacgaagttgaagtaatatgatcccggatgaatcaagggtcttcttctcatcagtatcaccaaatttaggttaattaactctaatttggcactaattatcaatatgctcgtgtgattagacacggatcttgctcttcaactcgttcttactcctaacgctatagaatctagagattgaaggctccagaaagtgagatcactaggatggattagtatttattttacaagctaaatctaggagtctagttctcttttcctttcttttaaatcatttgaccaagcaaggtttaaactgcaaatgttggcgatgttcaaactttgaaataactatatggacagaaaaaacaaaataaatatactgtatagaaagaaatatgcatgtgaaaaccgagaaggtagggacacacaaagaatgagggaagtaaccttaatcactggccgattggcccgactctagagattcctttccactatatgacccaagaaccatcacatacatgcctacagaataaaatagggcatcaactagagcaaatgaatcaggatccaggaaaagtaccaaaatggctataggtctacagcacaaacagagtaaaaggctaaaagctgcgcaaaagattaagtagcactccactccactttgccagcaaattcggcatgccaattggatggtaccatagcaccacatggcagatgagaaatcaagcatgaagcgcaaaactattttgaacaatatgcttgtaaaccaatagcattctcgtaaataacacatgttaccatctaaggacaaacatgccctgacaataagttaggttttgatagccaccctaatggcgaactagtgattattaggatagtgtatggttccagagttgatggaaatctcaatccgtcccgccatgaatcacatgatacaactaatatgattaatccacaactgcacaactatatgtgcattttgacgattttccaacaaaaaaaaaggggacgccacgagcaaagaaacaaaccttctcgccatggctgcccctcggcctccttcggtgtgagcgtgatctcggcgacgcatgagccgtcatccacaataatgtgcccgg

SEQ ID NO: 14539 - DNA, 8635 bp, Oryza sativa
cgaggtgccgtccgactccgagggaggggcctcggtggcgccggccagctggcaaccgaagagcttcagcgccgcgagggtgtagtccatgttgttccgcttcggcgccgccaccttcgtcgccgcgccgtcgacaggttgagcaccggaaccctccattgcggcgccctctctctccggtgctctctcgggtctcaactctcaacaaacagttcaactacactgatcgcagatgggccgtgtacctgggcctaattaggcgagggccactacatgatgctatacctttcgaagacaataaacacaagtgtatatcatagcatacaggtagaccaatcgtcttgtttaagagggcagctacaaaatagcatcccgttacaacgggatagacatgctaactattctcttacacgagtattacatgtatcaggttctaggtattataggtatatcataggtatcgggtaccatatagctggtaccacagcatgcatcaagtatcaggtaccgtctcatagaaaggtatcccgtttcaacgggataccgttgtctaggttttctacttatttaaaaaaacaactaagcgagatattgaggtgtgattttattagaatgctaaatttggtagtaaaatgagcatataaacaatagacaattggataatggttttaccgttgtagttagacttgtccaggcttcacaaaatttctagctccactattgctcatatataccatacacgatactataggtaccatgttgatgtcataaattgtaccgacatgatacacatgtccgatactagatctggtatcttacgatatcatgctactatcattttagcattaactgttacgttagaacggtataccgttttgtaatatgtagatgtagtacatacataattaactgttacatttgtatgggcctaattagacccagtgtgatctatcagaaggcccggcccggttacaagcccgagcatttcttgcttgcgagtggagttgaacggaccgcaccggcgtcagctcacgaggcaggaaagaaaccccaaacccgcgtcgccgacgccgtcgccggcacactcgccttcgcctcgcccaccaccaaaccacctccgatggcgcccggctcctcctccacctcctccccgggaggaaaagccgccgcggtgggcggcgaggcggggaaggagggcggagccgtgccctcgcccgcggcagctgcctccgaccacgctccggtggcgcccgacggctcgccgggaggtggcgcgctgccggcgggcggcgaagcggggaaggaggacgagggcgtcgcctcgaccggctcccgcactccgctggcccctggctcctcctcgggagaaggcgcgctcggggaatgcggcgaggcgaggaacgacgacgaagcgccagcgccagcgccacggctcatcgcctcgcccaccgccgccgccgccgccgccgccaccactgactacccacatgaaggcggcgaggcggagcaggagggcggcaacgcgtcatcaccatgtgaagagcaggaagaggatgacgacgacgacgaggaggaggaggccccgacgcatctccccttcgcaccctcgtcggaatcggaggtacgtgcgtttgccccctcagttcttgcggttcatcccctttgtctctcttacccgtctctccaacccattttgcgctgcattgctttcacactctcgccctcgtgggcatttcgtcaagcacctggtggcgggtggtgcttcgttactgtcatttaactcgtgggcatttcgtcaagcacttggtgtgcttccttactgtcctttaactcgtgggcattactgtcatctaagtgtccccaatgtcattcaagtgctttcacggagcgtatgtaccatttacagttgaaaacttatatatcatctttgcatgctcaaaattctcgtaatcaagtgttccatgcgaatgtgaaggtttaatccacaattccgcatggttctagataatttttagtgagatttctgtgtgttgcgagcttctgctttagctgacagttgacttattagaaatgacttctggatattttcaatcggtgttccattgctttattgatgttttctctcctgcttgtaattatatgcagttacctgatgataagtcaacagttgatcccagcttcaccatctctctcataaggaagctggtacctcagggaccagatgtggataaagagttaaggtgcaatttacttccagagattttattttcagttagagttctctaaaagtgaaagccgtgtgctagattttcatgctgattttgttatcagctgctaacctctgataccatgtaaacagtgtgaagcagggacgaacagaagaaaaggatgctagttctgatgttggggaaccaaaacagcctcatgacaaagatctgtgggacaatgaaggttgcaaactgtgggacctttcagttattgaacctcaggcagaacttatggtacttatctctatacttgatagttgatatcatgtcatagttgataactgtgcattgaatttaagttctacgatgagatattctgcataattattgattatgattgtgaaattttcggcatgcctctatcccaatagcatgccagcatcaatcaacatttgaacaggaagattagtatcttctactaggagtcgattcttatctattaaaatatattatttacaagaaagcttttcatgatctgcgggcatgtactatttgtaaaagattgtgctactgcaatagaaggtgaatcatcaattgagttctaagattcactgaaactactgcttgcaccatcatcgaatttttgtactgttgtattgtaagtctttaagtgcattgactgcttgcgggaagcgctaactgtgcggatctttaattcttgtaggttaacaaccttgtacttgaagtacttttggcaaaccttcatgtgagacaatttcttcgagcaaaggtgaagtggaatatccttctactactgcctccacgtttttgctagcaaatattttaataagtcttgcttctctgaattttgttctccacaggaaatctgtattgggatcataggaaacttagcttgtcataaatctctggccaatgcaatcacttctcataatggattaattgctactgtcgtggatcagttatttcttgatgaccctggttgccttactgaaacattcaggttggtattcatggaatatggtgaatgtgcgcgtaattatgtagtggaaacctggaaaccaccacataaaagtttccaaaagttttttaaaaaaatctcaccaacgaagtttgatattaaaattgtgtgtggttttctaatatcatctttactatatgtaacatttttcttgaaattttttggaaacttttacggggtggtttccactacatatttacctatgatgcacggcttgtgctaattaagactatctacatagcactttcttgtttgctctgacaagattaaaaacaataagcacgctattgtccctttgactcctttagcaaattgtaaattattgaacctgtaacaatatgtttttagcaatacaagttcttttatcacctgaaattaagcatttatcatgtggaaatgaatcaggcatcttactataatttatgcttacaacatatgttacatgcagacagatagtcatacattacacatatacagcatcactatttagtggattgtggattaaaatgcttgaatatacagctgttcttaagaaaaaaaagtaaaatgtaacttcttttagcacttgtaagtactccttattatgattccttattatgcatctccttttcttcatacacattcatgttatctttctactttttttttccttttctatttttgtatatagactatcatgacaacccgagttctgttctgaagtttactagttgtgcagtcatagtcacacagtctatttgtatacaggttattgagcaccatttttcagagcaacgcatctatgtcatgggctgaagctctcttacctgatgagattctttcacgtattatgtggataattggaaacacagtgcatgctaccttacttcagaaggtgaagtacttgtctatccagtcaactagatcctaataggttgataacttgtattgaccttagcttgatgttgaacattttaggatgatttatctatttgacattctatgtaataattgctacttttattcttttacaaatgatagttagttagatgtgtttgcataatttgttctttttcagttgatcttattatgattcagtgttagaagggcgttatgtaaatcatttctgttgattgttacatgtatggccactatcaatgtaatgaccagacctcttaatccattgtaatgtgtccaggacatccaaacaacttcttgattgcccttctgttaggagttcttatttatttcatcattattggcaactttgatcttacctgcagttgtttctcatgtttcccatgaggccatgagtctgcagacactgaagatataattgcaaactagttttgaccatttatggcctatgaactattttggaattcatccaaaaagctgtgcacttagatatttgatttagtataacttaatatatttgatttagatatttaatatagttatatggtgaaattgtggtacggctgaaatcatctggccaactgacttatggcattatcttttgaatcctgtacatgttcaaaatttgtgactatttcctttgtaaattattgggtgcagatactggagtttctatcagctcttgttgatgatcaagatgtcattaccattcttatcgagcccttgataaaagtgggtttagttgactgtgctattggtttgctattaaatgagcttgaaaaatcaatggatgggaacaatctagacaggtatgatttctgtgaattgaagtctgaactaacttcaaaattgcaaaagtgtacagttcatgtaaaattatctaagaaataagaacagatgactgtcaaatctagtgaactatactctatttacagttcataaagcatacaacatatcctcttgctataaatctaatgcatggataggtccataaatgccatctgaaatgcgggcacttgatgttcaccgataatttagtctttgtattttacagttttcatgttccttctgcttagtctgtttgcattaaccaggaattatggcatagtcatatttccttctaatcacttttttttgggttttcaaactttgagtgaatagtctagcacaggaatggaattttagtaccttgacttttttttaacacatttcaggtcagattctcttgattcaatccttcgacttattgaagaactgtccgccatagacaactgttcaaaagtaatgtcatcaaatgaccaattgattaaagcactaagtaatatagtcaagttaccagataaatttgaggtgagcatgatgctactaacagttcatttatttgattgcatgtcccatttaacgtcgtgtgcagttgaccctgcttactaaatagttttagtctgctgtactaattgatacaaattttaaggtatgccattctggattaaaagcatgaaatatatatttcaagaatatttttttttcttattgaatatatttcgggatcgtagttaggttgataagtgctattacttgtgagtcctcaatagcctcagttcttacctggattttagcacctgaaaatttatgcagattagatataattatgttccagatgagcatgctgatcatgttatatattcacaaactatgcttcaggttgagggctattgtgcttctgtggtaatcataatagcaaatgttttgtctgatggagaacatctcacacctattctgtcccatggtatgccacattttgctgagcaatatctcataattcttagccattgtttgcgagttgaaaacatgactatttagatacagtgtcacagtgtggtgttatattcattgtttcagatttacccttactggagggcctatttgacattcttccattgatctctgatgataatgaagctcgaaatgcattttggtgtatcttgacacgtttactgcaacaagtagaagaaggagaaaccatcacgaactcttcaaaactcgagcagtttgtgtctatcttcttggctaagttcaccctcatgaaagatgacattgaaagacatgggattcaaacagaagctgattcctcagttgagggtgtttctttgaagaatgggctacgcacatctgtatcctttataagaaaattcaatcctgataccatcatgcccttcatggagatacatagatcttagttttcattcccatgataaatgcatctaaacttaatatatcattgcttttcctatgctacatttttttaaaaacagctcaaggcgatctgcagtatcacggagagatggattgcggacaagtcctccttgggcaaagaagatgcttcactgaccgaaaacaccattgaaaatgctaaagagctgctgactttctgccggcgtgcaatgggtattgctgacctgtgagtttggaatacggaggttttgacgtagagggcaaccacgtacgtgaaaaattactaggagttttgctgtatagcacgagatcatccggaagtctgttaaaaccaactaggagttttgctgtagaggatcacagtgatgcatagatcatcagttgctaaagtagatcactactcacatagctctgccaatttacattgatgtggttacattattggtgctagcgatgtaatgaacgcgcataaaaatgatacggtgctagaggtttctgatcaacttgtgctcatggcttaacgagatgctggcaaacctattttgttgcgaccgttaccaaattgcttcttgttgtttcgtgtggtaacacaccaccacgattctattgatgcaaaatgagttcatgcaactccgtgatggtatgggctatgtaggttgaactggaaaggttactttaagttgggtatgaaaatttgggaatatttgatactaaatttgataatttgcaaagcactgtaaaacgtatatgcatcttcacgaaccttgtctcgctttagggagcttctagcaagtataattactcttacaatctccaactctttgaatagttcaaattcctattccagattgtatgacggagggttgttaatggaaccttaacagtgatggtgtttttgggacaaagttgcttgtacgatggtatttcataaaactcgttcttgtcgatgacatttcttgaaattgtgcgcatgtcaatggtattttttggattttctcaaaaatgaaatagacacccccattaatgaatgatggcgtaggatgtggattggggtccccagtattagaatacaaaatgcagaggtgctatagaaattacagcaggaaaaacctgcaccatctagcacaattctagacctatgattaacatccacaggatgaatgtgatagtactagctataagataaaatcctgatgctacaatacatgactgatttaaactattagtttttattgtgactgctcaagtgctttgtaaaggcaattgagtagcaactttgtattagcaattcaaactgcagaggatccggatcccgtaggaatctgctagtatatatacacatgcgtgaattgttcagtattgtcgtgtgccatctttgaaaaataccttttcttttaaggattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaccacatatttcgatggttttaactgaaaaaaagaggtgacctcgttttctttcctcaatgagagcagaggcaagagaaaaaaaaaagagtaaagtccatcaccggtccctaaactttaccgctgtgtcatcccagtccctaaactcgcaaatcgatcgttcaagttctcaaacttattcgactgcgtcatcctggtccctaaacttgcagatcacttatttaggtcctccaacttgttcggttgtgtcaccccggtccctaaacaggacggtctaaaaactttatatcaaaaaataattcataactttttcatgtaaactctaatgaagacaaactttatatcaaaattggagccctggacacgacctacaacttt

SEQ ID NO: 14540 - DNA, 8204 bp, Oryza sativa
gttatatttaaatataaagtctttagaccgttctatttgacctagatgatattcaaatccaaatttaaggaccagggtgacacaactgaacaagttggagaatctaaacgagtgatctgcaagtttagggaccgggataacacagtcgaacaagtttgaggacctgaacgatcgatttgcgagtttagggaccgggataacacaacggtacaagtttagggaccgatgatggactttacttaaaaaaaaaaaacaaaacaagtgaagtgacctcagctgctgcggtgctgcctgtccctccgcatcaccacacagcacgttccccgagctcggccacacccagtaccaagtgcacagccgcagcgccgcatcaccgccttccatttccacatctagggtttcagttgagtcgagttgagtccccctccccccacggccccacctcgccaccgccggccatgcccgacgcggcggccgccgccgccgccgcccaggacgccgacgccgtgatgcgcgacgcacccgccgacgcagcagcaggcggcggcgacaacgacgacgacgacggggatgacggcacagaagaggacgaggaggaggatgacgacgaggagggcgatgaagaggagctgccgccggccgaggatccggcggccccggagccggtctcggcgttgttgccggggagcccgaaccagctgacgctgctgttccagggcgaggtctacgtgttcgaatccgtgacgcctgagaaggtcggtctctttactccgctcatcacctcgtgtcgctttccttccgcaatcgtcctggaaatgtttagctcaaaaaaatttcgtgggatacgatgaggaatttgacgtgttagtgttcgtgcgccgcaatcggatatatgattggtatattgtggtttcttgtttgtttcgagtcattctgtgggtaggattcttacagttcaggaattctggattagtgctgctactcccacgaaatgtccctctgttttttttttaacttgaatctcctttgctactgtcacttcagctagtttacaatgttgattgttggatactgttacaccaaaaaacgcaacactagaaatgtactaatttattctatttggataatatggttgatttggtttgaagtataccgtcatgttcatgtagacttgaatattggatatacctatcttagactgttagtaacttagcgcagagcggtccagcctctgaattagtgtaagctcgcagttgcaatacaacaagtagccactattatcctctggctcatagttttagtaacggttaatatgattctctctccatcccaaaatatagcaacttgatactacgattagacaccacctatattacaaatctggacaagatgtctatccaaattcatagtactaggtggtatctatcgtattacttgattgctatattatgggacggagggagtatgtcagttcttatcactcacgtagattactagtaacacatggtgatgacttgctatttcctacaagttagtccttggaacttttcagttgtgcagtttgtgacccgagttttctgttgtttttgttcttggctggaatcctgattcatgtaaacaatatgatggcttgtataactgcttgctataatcccaagttaaatttattccagagttgagttttctgaatattcatttaggtataggtatttcttttgttcccttttatggtcctgtcttttcataagatgaagttttttttcccaggttcaagctgttctgttattgttaggaagaagtgaaatgccaccaggtttagctaacatggttttaccaaatcaacgtgagaacagagtatgtggaaataaatagttccatagtcgcttggcaatctgtattgttttcttcgtttatagttcatgttagaattatctgcagggttatgatgatttacttcagagaacagacattcctgccaaaagggttgcttcactcattaggttccgtgaaaagcggaaggaaagaaatttcgataaaaaaatacgttacgccgtacgcaaagaagtggcactcaggtttgtatctagtctgattgagtattcaccgatcttttgcaaattctaccacagaagaaggcatagatgaaccatgtggatttgctacagtcttctaaatttgtttagatcaatcatcattctttttcattcttctagttgatggaactgctttagtgtccatggggagcacatgaacattttcattaggggttctcaatttgattagcaatcaatgtgtctactgcttgattggttccatgatcataccatgaacatctaccaatataatttgcaagaaaaaaatgcaagctcaattttttgttgtccctggatgctagttgctcaatatgttccaacaattaattgcatggctccattagaataaaaatgtaacaaattaactgacttaagactggaggtctggagctgtacttctgtgtagctttaactaagagcaagatgtaccatatccattgtatcaatgagcaatggatggatgttatgagtcttttttgtggtaaaaaaaatctaatgatttatgctgctacctattactttctgtgtccgattgttttagccatcaccattgttgtcacctcaatctttccagctccatctcctttgtgaattttgtgtttgttgaatactgacagacaagaatgattggggccctggccagcagtgatggtacaaatagttcgcatacatgctaggcacagcatcaatggatagaagctaggctggagatagattaggcataggtaggaggtaaaggatgggatgatagatcccgtggattacattgtttgcagacccaggcgcataaaattctgcacatcaagctatggaatcaactagcaactaaattgtatgactagataaacattacttggcttgaaaaaattgatgttgcttctacttactctcaggatgcaacgtaggaagggtcaatttgccggaagagcaaatatggagggagagtccctatctccaggctgtgaacttgcttcccagggttcaggccaagattttctatctcgagaatcaaagtatttcttatcttttgatagtctatatactcgttctgtctaattattgtttagtagaagacttatcttctttctgtaaaatacttgttgcaggtgtcagaattgtggcactagtgaaaaaatgacaccggcaatgcgccgtggtccagctggtccaaggactctgtgcaacgcctgcggactgatgtgggctaacaaggtattgttgcatgtattaatgagctagtttattgtttatctttctttctgataactaatgggcttctcttcatctttgttttgaggacacctatcccatttcataaattgatagcattagaatacagtaatattctcgtggaggtggattgcataattacattgcttggttcaactggcaaaaacattcttcatggcatgcatgcctcttgttatggcgttacagtacagggcatgttaaggcagtggccctgttttgctatcttatgcggttgataatgcacttgcagcaatggtgtatatgcagtaccaactagggtaaaaagagtcatggtttttgaaccatattatgaagacatggacacatggttatatctgtcatattgtaccttttcttttatttttcgttggctttctaggtacgccgttgacttcaatagctatatgtcagaattgcgggtatggtcattttggaaattagggggtatacgaaaaaaataaaagtaaagagagcctaccattgttgttaattaagccgcttgtttcatgttattgttgactgattctctgtgcaaggaacatatctcaaacatcactatgtgacttcttattctgatgtttgcaatttgcctttgctggcactagtccctgtgtctggtaattgcctaattggtatctgcagggtaccctgagaaattgccccaaggcaaaagttgaatcttctgtggttgcaactgagcaggttcatttttttaataattattatcaagagtttgaaaatgaaatcattgctgaactgtcaatatttccatacccgcagagcaatgcagctgtctctccgagtggaatcgacaacaaggaattggtggtaccaaaccctgaaaacattaccgcaagccatggcgaagtgtaagtgccacatttcccgttccaaattttgttcaggcagatgatttgattgacagtggatcatatcctttccagcatgggcgacagcactccggcaaatgaagccgagataggagcgccaaaggcgcagtcacaataagtttatgtttaacctgtcatgattgaaaccaaaagattctggattctttgcctacaggctatacagctaaacatcacaatagaaggtctttttcctgaccaaagtatactgattctcctcaagtgtacaattcttgcttgccagcacatgtaaatgtaattgtaattaacataaagagcctgattggtgcctgttgtgtaaacccctcattctcatgacatctaagatagcacatcaagcagactgtcatgtacttccggctttggagctgcttctgaaggggagttgtctgatggtgcttagtgtcccttcctaactactacgcctgtaaagttgtaccaactgatccttgtacagtttgtattaatgtgtcgtctctgtctttcgttttccgttttgctttgtgtatgcctctctaaaattggcatttcgctgtcaagatgggaatatgggatgatgccatcgcaaaagggaaggagcccctgtgatgatgcgacggtgcctgctgggttacgaaatccctggggaaagaaaaagcatccactcacagggagctcgtgctacggttgatgaattatgatgatggctggctggttggctgctgtgtgtagagcaccccccctgacccaaacgtccagggtgcatcctcctatttcgtttgtatccaacgacgttttctttctgaagctaaacacgttacacggacaaatattgtaatggtacatatgatcttaacagaacaatcgatcactttaaaaaaaagaacaatcaattttagtactctctttatctcatattatataaaacttttgtattataaggctgcattctttcaaaggagattggggagagattggggagattgtcactcgttttccgcgcacacgcttcccaaactactcaacggtgtattttttgcaaaaaaatttttatatgaaagttgctttaaaaattcatattagtctattttgaaatttaaaatagttaatacttaattaatcatgcgctaatggctcacctcgttttgcgtattttcccaatcttctcaatcccctcaccctcaaacacagcctaagttgctttgattttttaaagactttttttacctttaaccaagtttatagaaaaaaattagtagtatttacaacaacgtataagtttcattaaatttaaccaaacaaatatattttgataatatatttgtttggttgaaaatattgctatattttttatacatttaattagacttagaaaatttagctaaaaaaaagtcaaaacaccattgaaaataccaaaagtaaactcgaaatagagcagtaacaagaaactgaaaagtaaccactctcactgaaatactactaagcaagtctaccggaatactgttacgctgacgtagacatgagtaagcgcccagattacatacacacacctatccaaaccccatcatccagttacgccgactttggggattattcgcgtcttcaccgacctaatataagcgtggttacaaatctcaaaaccaacaaaacgaaccatcttcacctaaacccgtccacacgccgggtggccgccagttcagcgagtgacgacgacgaccccccacgcgcggcggccgcgcccatctccgtcgcctccccgccggccatgtcggtgccgcccgccagccaccgccaggttccccctcttctccacgccatggtagattcctctccctccgcatcgctctaccgtggctgattttttttttgtttttttctggttgctgtaggtgtccctgaggggatcgagcgcgagggagatcacccgcgacgcgctgctgcagaaggtctccgaggagcgccagctccgcagccacctccgccgcgccgccgccgcggcgctctccatccaggtacctctccactcctctcctctccgcggcctacctaccagcctcccgatcttatctgggaatctcgtcgttcttcatgagatatacttttacttttacgttttattcttttgcgaacttcgattagatcgtgctgtgccttgttggtgtgttagaagcaatgcttttctggagattgtgtggagatggatttgatttgtttgaattaagtgcgaggtcatatgaagattttttttgggaggttgatgtaattattggtccacaatgattacgaatttaggatgcgcatatcaatctgaatgaaagtgttgctggtgctaaattttgagagttggtttaagcatgggtgagaggtctgacaggtagagaatattgagaaacccataattgctcagtgcctttctagatatttcattaacaaagtcctgcaaagatactgagaagcttataattagtttttgcataaataatatcagcagctaaccaagtctgcgaaccaccttatgtggccatttcaaaaagaagtccacagagtcattaggcatgtggctgttgttcatatgtgggtatgagaaacacaaaaatgatggatggttaaaacataaaagtaggatagaagtcttcatgatcctcttgttgctcgatgtggttagattggcaggatggttttggtgctacagttgtctgtgaggtggagaaatcatggatggctactagagtactagacaggttgataagttgattagtggcttgatatgtaatatatttaacgattttgtgtttgcacgaatttgctacattagggtaagactttcaatttgatgcaaacttgtgaggagtttgtgataatcctgtctttgtaggtagccttaacacacaatagatgtgcagatggtcaaatcaaatggattaatttattgcaggttcaacatttaaaattaggtttatatgtgattttccctcagtgcaaacagcaccgggagttctctgacaagaaacttgatgcccttgcaagctgctggagtacttaaaatatgtcttgattattaacgtgtttggagatcagttagtcgattgttatctcctttctctttatagacacaacctcagacagtagaatttttttaggatcatgctaatccactatgtttctttttcctgtgtgtgggtcgttcttctgaccattaagcttgatgcagaaatagttatttttatcatgggaaatatacatccaaagtagacataaaggccctctcagtgctcttgtatatgatctagatttctgctgtacttctttcaaactactctactgttgcacttgtacacttatacaattgatgcttttgttttttgctttgttatgccagcgtgtttggagaagatactcagtcataagaattgtttcagaacagctccatgaagagtgggaagcattaataaaccagcctgacattaatctgacaaaacaatggatatcaagcatgatgcttagaccatttcttttcttcgttactcaaccatcaagctggtacaagggacaacaggacaagactctaaactcgatttcggcatgcttcaaaatcatcttgaatagcataaactcaatgggtatgcctttttcataatcaaagtttgactttaccgacttccatcttgacctttttgtactttattttctcctccttaatgaaatgacacgcagctctcctgtgtagtttgaaaaaaaatgttttactttacccattccactagttgtggttaactcctataaaaatttatttatgtaatacttccttttgctggaaggattataatcctttatattattcaatccttgtatggcgatgacctaattgttagttctagaatggaattatgtacttaacagaaaagaaattgcagtcgacgtgagataagcagatactccctccgtccctaaatataagggattttggttggat

SEQ ID NO: 14541 - DNA, 1777 bp, Oryza sativa
ccaaaattccctatatttagggacggaggtagtatttgttttgatatatatatatattagtactgtttggttgagcagtgcaatatggaaggaatattacagtaacttttttcttgaggctcttgatccactgagctggcacaaatgggtagtctcttctcggtgagatttttttttttttttttggggggggggtggaatgtagcctctagatattactgtttcaagaaaaaagaagttctttgaatttgaatgtaaagtgcatgctatgctttgatagacaagaagtatgaagtgggtctacgatatgtaaccttgtttaataatggacagatgcatgctaagctacagagcgaagctcccaaccagctggcctccatgtttaaagataatacaaatattaccacataactagtttagaatgcataggtccataactgtccttcaattatcatttggtagatgaggttaaacacaaaaagcatgaactatcttggagagctagctttcctttaaccattacagtaacaataagaacagcctttagtcccaagcaatttggggtaggctagacaggaaatccaagtcaaaccacatgaaccacaagaaaaaaggaaaaaaaaaactacttaaaccacaaaaagtgattttctaggccatagttctggcacatggatagctactttccacaaactcttatccaatgccaaatctttcgatacattccaagccttcaagtctcttttaattccttcatcccatgtcagttgtggcaggtcatgctttgatttaaccattgcaccttccttttcaactgacatgtatctttcctctgtagatgcaagcaaaaatttatgttcctttgctgtgggcacgccagaagaaaggtctatttggctttatcaggcaaaaaagttgatttcactgtgctcattcattcttgccaggtgtaaccattcttgctgtaaggatggaaacatggttcagattactgacactgctatgaggttggctgtgtctttaactgattgcaaaacatggaaaaaaattacaagtgaggatactagagctgctgatgcatctgtggagagcttgattgaatttattggtgcaagccagagtggtacatatagttgtcttaggagatatatagtaaatcttggttctcatgccttggagaagaaaatttcttcaatctcaacagatgatcagttcctgattactgctagtgcagtcaccattgcgctacgacctttccattctatgagagcagggaggggtgctgatctaaatggtgcttcaaaggaatactttacacttatactcacaattccggatctttgcaaacgcttgccacctctgttgttgcctgctataaagcacatatctatactacaaccatccctagatattttactggtaagagtttcaagattttgatatggacaagtcactctattgcattttgtatagtatagcatttagctgccgtggaagccttgactctcctagaagtcataggttcaacagttcttttgctgctaacatgataattgcacactatagttgatctactgattttcaaatgactctcctagaagtcataggttcaacagttcttttgctgctaacatgataattgcacactatagttgatctactgattttcaaataataattaatttgttaatagcaggtatttattaggtttattgatgtacaatcataggagattgattttaaaatattgacatattgtgagtgcgaaactgatcaa

SEQ ID NO: 14542 - DNA, 1182 bp, Oryza sativa
gttgatgcaattaactgtgtttcccaaagcttactgaaattttttgaggagaacaaggaaatgcttcttagttttggtgatagtgttgatacatctttcatcaaggaaaatgataccagtgacagctgcagcagaacactgtttatggatcttctgaagccaatttaccagcagtggcacctcaggaaacttttggtgttggcaaaggaggatgctgtgtgcaagaggcaaaataatcatgacccagatacacagacccattcgcgtagcctaaaattgctggacattgtatgcttttactatcacatgctccgaattttctctttactgagtccatctattggttcattacctattctcaacatgctctcattcacccctggatttcttgttgatttatggggggcattagaaatatatatctttggacaagcagtccacaaattacaaggaccaaaacatgaaagagaatcagctacaagtagttcaggtgagcatgtatcctccatgaggcaaagaagaaatttcaaggatacatcaaacaagtggtcgaatgtgttccagaagattacaggaaaatcaaatgacgcagaggatacaaatttggttgacaatcctttaaattctgagcagaatggtgaagcattaattttatgggatattgaagccatgagacaaggatctgagtgtattggaaaggatttaatgcaaatgttgtatctgttttgtgctacgtatggacacctattgcttgtgctagatgatattgagttttacgagaagcaggtaaagattggctcacaaccacaacctacttcaccccacctccttttctgcacatcttggttatgtatttaaacttctctgaatccgcaggttccttttaccctagagcagcagcgaaagattgcatcttcactcaatacgttcgtatacagtactttcattcagaatggtggaagcagcagcaaaccacttatagatgtgactgtgagatgtcttaatctactgtatgaaagggacagcagacacaagttttgtcctatttctctgtggctggcacctgctaggaatggccgaattccaatcgcagcggctgccagagcccatgatgcagcatttgctacattgccaggaaatcagttttttggaattcctatccggagctctgtacttactaca

SEQ ID NO: 14543 - DNA, 1487 bp, Oryza sativa
tcgtatacagtactttcattcagaatggtggaagcagcagcaaaccacttatagatgtgactgtgagatgtcttaatctactgtatgaaagggacagcagacacaagttttgtcctatttctctgtggctggcacctgctaggaatggccgaattccaatcgcagcggctgccagagcccatgatgcagcatttgctacattgccaggaaatcagttttttggaattcctatccggagctctgtacttactacaataccacatgtatatccatttgaggaaaggtatccaactttgtttagctcttgaaaaaaaatctaaacattctaaactcaataagtcattactgtatcatttagatattcgattattgcccctagtggctacttccatacaccatttgtagatctaacagcaatacttgcataacctaattcctgcagcatcagttctctcttgccagttgccatgtaaatctcgtgtttcataccgtgtaaaatatttttttaattattatttttggaaagttcagattgccaagaggcgatgcttcatttgatcaaaaagtttagatttttttaattatcatttttagtcttgctacatttgttggttgaggagagttgattagcccatttattttccactagcgatgcttcatttgaccaaaaagctcatctcaatttcatcacgctatctgaacattttcacttgcataactgtttctaacattttcgtctgggatttcttaaatattagctcaaatgttagcccttagcaggacatgttccatcatcagaacttatctagaggctttatttactaatattacagttaagcactcgatgcaatgctgttctagcttagcagtagtactttaatgcacaacacctaatttattaaatattttcaaagagtcaatccataaggattgattcttgtgtcaaatcatgctattcaagtgaaccaccctattagtgaggcccatatgtgtacaaaacagggaactccattaatattttagcacttttctctgttacagaagtgctatttgctcttaacatatttaatggcttttactcagagtgcagatgtttagagaatttattgagttggacaaagcatcccgaagagttactggagaagtatctgggccaggtccaggatctattgagatagttattcgtcgaggtcacattgttgaagatggatatagacagttgaactgtcttggatcaaaattgaagtcttgcattcatgtgtcgtttgtcagtgagtgtggcctttctgaagctggtttggactatggtggtctatcaaaggagtttttgacggatctgtctaaagctgccttcagtccagagtatgcctactgtggaaattttaacccttcaatattttagttttcacttcagaatgtttatatatgttttcactgactttgtttctgtcccctcacaacagatattggctttttttcacaagcat

SEQ ID NO: 14544 - DNA, 22875 bp, Oryza sativa
atatagacagttgaactgtcttggatcaaaattgaagtcttgcattcatgtgtcgtttgtcagtgagtgtggccttcctgaagctggtttggactatggtggtctatcaaaggagtttttgacggatctgtctaaagctgccttcagtccagagtatgcctactgtggaaattttagcccttcaatattttagttttccacttcagaatgtttatatatgttttcactgacttgttttctgtcccctcacaacagatatgggcttttttcacaagcatcagcatctgatagcagcttaattccaagcaattctgctaaacttttggataatggcatcgatatgattgaatttcttggccgagttgttggcaaagcgctctatgaaggaattctattggactattgtttttcacctgtatttgtgcagaaacttcttgggcgctatagttttttggatgaactatcaactcttgattctgagctttacagaagtctaatgcaactcaaggtactgtttttttctttaagaaaaagattctgctgtaatcttgttctagacccaaaaaaaacatttgaattattatgctactgaaagtagcaatttacatgctcttagtacgttgatgaatatcaattgagctatggccattgctgcattgcctgttttttcaatctcgaaacatcatccattctttatgttcaagacatgtcattagtttcggctgactcaatataaaacatggatctaaacctcaattaagtttttgtggttttctgttgactgatgtttaccaagtatatcacttctaatatagagaccatatatgatatttaattttcactgcttttgtgtatgatgttgtcacgaccggtaattcacaatacagaattccagacaatatgtgtattaaatccccatccaggactagccagggacccagggaacacaagagacaaggttcactgtgcacctccctccagcctcaaactccatggaggaaagttatgcttatgcagactctccaggcagcaacaatttgacatgacaagtctcctcctctcaatgggatctaccttcgtgtacttagggatacacgctggtggaccccattagtttgtgatatgtaagacgtgcattgtataccaactgtctcttttgtaccccagctggtcctggacggggatttaatacacatatagtctggaattctgcatcatgaatttctgggtgcgacaaatgttatggggatgctatttttgtgtcatcttttttacacaaacaatctagtgcctttctgatgttttcatccttatgttttcaaactggcctttccttgaaacagcactatgaaggggacgttgaggacctatgtttggattttactctgactgaagagttgggtggtagaagaattgtccatgaactgaggcctggtggtaaaaacatctcagttacaaatgaaaataaattgcactatgttcatgctatagcagactacaagctcaatcgtcaggtttgttacttggtttgctttcttgtatgttctaaaaactgttgttctttatcaataagcagcctttttgataataccataatctcttgcagatactgccttttgcaaatgcattttacagaggactcggtgatctcatttcaccatcttggctgagcttgtttaatgctaacgaatttaatcaggtaacatgaatactgaaacaaacttttcctttacaagtgatgctaaaaaggaatttaaaatatttaagttggaaccataaaacatagaactcgtaaacatagaacttgaagactcaaatattgtgaagtccacatgatcatattatattttgaaattgaacttggtctaagcaacagaattccaaacggaacaggtgcatgtgctgacgtgcatgtccttccattcacacatgtaataaaaacagactaattttcacacagccaaaaacccaattatatcaggtataacccaaaatgtactgtatgactgacatgcagttcctgctatttcctgctatgtgctatcggctattagtttgtatttgctatactgtttcagaaataaaactatgatagtctgcacttttggaaatactgctaatgtatgactatgattgccacatacagctgctttcaggcggattacaggattttgatgtcgatgatcttcggaacaacaccaagtatactggtggttataccgagtcaagtcgatctgttaaactcttctgggaggtatatattcatctgaattcgttttttttttctcctaatgctatcagaaacatcaagtgcaaagttatgtataggtagaacatacaaactaatatgtggatatcagttggattttcgtttgtgttggagtctaaaaattacataatctcaatgtttagcctatacacggtcacctctgcttaatgcggaatactttgatctactgacctgcttgagaagccatctgggttgaagttactctctgttcttccttccctttctaattcttttcttcctttgactttccttctttttcttgcgtcaatggaaattcccgagatcgccgaatcccttccagcgctcaagccgatcaggcaaattagggttttagggttttggcagagaactcaaagtccctttcctttgcgttaagaattaattttacccatcacaaaactaactctacctctttgttatgaaatggatttcccaattaactaaccggcaaatagctgataaaatcaaccaacaatttggagtagacatatctacccccatgctatttgttgttttacttgtaggtttataataagggaagtttttttttttacttatcatcagcttgactgccaagatcgatgcaaacacatgtcagatttggaaattgcttagttcatctattatattctactgtgtggtgaggactgaagtcagtattttactgctgcgttgcaatctcccctctggttggaggaagttggttgccagatgcccagacacatgttgacaattggtattgtttacttccaaaaaaagagaacaattggtattgttctagatggagaaactaatttagtctgtggtctttgcaatcatttttactactatcctgggctgccgggggcttaaaactgtcacatttttttttccttttgtaaaacagtatctccaggctatttgcttgtggcgtatgcacttgctcgtacatttgttgaatatgatatttttctctcttttctttttgtggccatatggtcttgctctttagtgtctgttggcatgtgatgcacaaaatcaactggtctttagctaaatacaactatttttgtttttttttaaacaagaaacagcatgggagggcccctacagttaaatttttattgataaaatcagaaggtacaaaaaattacaacgacaagatccaatctttcatttaatctaagaagaagagatctcccttgaaaaggtgcctccaagacaaaggatggaagctactcgtattagcttattatcaaagatgaagctatttttactgattgacaataaacaaaagaaattttggtgaaggctgaagtggaatgatcataataaaaatatggtttttggaatgtgcaggttatcaaaggatttaagccaacagaacgttgcatgctactgaagtttgtgacaagctgttcccgagctccattacttggattcaagtatttgcagccttctttcacaattcataaggtttggtttttatagtcctgtgtgtacattgattgttttgtactgctcattgttcaattttttatgttctatcgtttttgtctaggttccatgtgatgttacactttgggctacaattggaggccaggacgtggatcgtcttccatctgcttccacgtgctataacacactcaaggtaaaaactatattgcttttatctatgcaccctgctaatatgataatttttattacatgtttctcatcgcatgttcctaatttcttataggcatcgatgccaaattgctgcattttatttgacctgttctgttcattttattactttccagcttccaacatacaaacggtcaagtacgctgaggagcaaactgctatacgcgattagctcaaatactgggtttgaactctcgtagaggtatgaagattttatgtggatagattaaaaaattgggtttggcacgtgaattgagtgccatagcctagataatgcacttgtaattggtatgtgcatcgctgtaaatttatctgcctattccgatgataacctgcatattcgcattgatttaatatcaaacttgccatcgaaactctattgaaagttgtatgtaaattttggtttaagttctcaggaaccaaacaatttgattttattaatagttcctaaaatcaaaatcagtaattataaaattatgtatagtatcatgagtcatgacacagtgatgccttttgcactagctttaaagttttcttgatataataattctgagattaggtttaaatcgtagtttttttcttaattagtaaatagaaagttcgtttggagtgttaattataattttttttcaggagtcgggatttcaaaattcggaattagtaagcatcgagtcgtacttgtcttaaaattgcaatgtattaagaaattcaaagttaataattacagagttgtttctaacatggtctcttgttttaatctgagccattataatctggtccatggatagccagattttccaattttctcctccttggagcatccaatcagcaattcaagctgttgtaatttggtcccacctaaagggattaatagatttattacttactattttttgagtaactttctgaaatcccctgttttatatggtcaaagttacacaagttacacaaaaccacatgtattatgacgtgtaacacataaacacaggtttgatggtatatatgttttacaaaacctcacctttattaatgttaacatactaccaacattcttctttaaagtagcgaagagttaaactgtcaaccttattcaagaattttatagttaacaattttatatgcacattttgttttagaattataagtaaatttgtgctcaatgtatatcataataccgaggttgtgccatatgttataacgcctgtgttttttctggaactttaaccttaaaccacagggttttataaaatttactcttacttttagattaacgcatgaattttattagattagaatgtctaattagtatatataggtatagaataggtagagcaataatctcattagttagcgtggttgtggagttaagcacatatatgttttcacttatcgtctctcaaatcgtagtgttcgtgattgaactgtcacgacctacgtacgtacacgtgattgcgctttttatgaggctcaaccatctatgtgatcatggatttctcatcgcgtatccatggtaaaacacgccacatatggatcacaaggtaccaaagcacacagctgcaaaacacccattgctagcgggatagtacaatccaagcgcatgtacatgacatattacaccaagcaagcagttcattcatactacagcaaaacaactaagcccaagcccgtgcacatgactgcccgatagagagaaaaacaaaactaaacaagcagggcaaccgaaacagcagcatgcagcacgtacggcggctactcgatcgatcgctagcaggagaaacaaatagcaacttaactaattaagttcacaggagtagagtagagtagttgagaagcagaagcgagagcaagaagctagtagcgctgttggctgtgcatgcgtccgtcattctcaggaaacggatggatggatcaggagatgagctggaggccctggaggaggagggcgtcggcgagcaccttgttggcggcgtccgtggggtggaatccgtcccagaacacgtaccccgtcgcgttggcgcacgtccccaccgcaccctggttgcacagcaccgacgtctcgatcgtccccgtcccgcagcacgctctccgagactcgaagaaacctagttaattggagtagtacccatcatcacataattaattatcagttcaatttctcactctcacaacatcttcttcaaaacaaaaaaaaagagagagaattcgtgcattgctgccaaagaggaggcgtgattaggggctgtaaatagctagcctgcgaacccattcatagatagatcgaaacaaacgggtttgtagtttgttttgatctataagtatgcttcacggttagtcacttacacctaaatagacgtaattacgtgtacgtaccggcggcagtggggttggtgacgaggtcgaggagcgggttgtagatgtcgaagacgacgagcttgaggtccgagtgctgcttcctgatgctgtcggaggccgcctccagcttcgcgttgaacgtccgcgagtcgttgttcagccgctccacgcacccgccgccgcttccgccgccgaacagcgtcaccgacgccgggaggcaccccatcggcggcagcgacgtcacgccgatccgcctcgccccctgtccgtacagcccctgcacacacaccacgcgttcccaaaaaaaaaaaaaaacccaagatcaaaatcgttgaattgattcggtaccacgacgaggccattttcactgcacggtacacatgaatgcatttctacctcaaataatatgaaacgcgggaaaatgtttgtgattttgtacctatttactccccccgttcatctttgtttgtttgacaacagatagtacgtactatgcaagtacagactttgactgctcatcttcttttttttaaaaaaatacgaacatttgaaaacatatcattatctatgtaatttggcaatttgcatgctaaagaactggatatactactacttgtatttatcaaaacatcgtaattcagaaaaaaaatattattgaccaaaattaaaattatactagtcaacagtgtcaaataaaaaaaaacagagtgtacttggtgtactggctgtttcagtaaattcaaagaagtaaaaaaaatgtcctgcgtatgtgagcttggtggatcgactgcgttaagtatgccattacacccaacagtagctgctagctgtggcattgtgtattgagcagtgaaatcggtggcaagcaagatcgacaacaccggccggtgcagtaataaagagagagattcatgcttgtcttgaatctttcatccacccacatccacatggtcaagacagatctgtgaaatggcaggcagcagcaataggttttctgccactgccactgtccaatctttctttctttccttttcagtgaaaccactcactatacatgcatatggacaacacggcctagcttggaactctagcatggaaatgggtcaatttccatggtgcatttactagaggggattggtgtgagggaattgtggatttactagcttggaaactctagcatggaaatgggtcacaatttccatggtgctgaaaatgttacattggcaggggcagatcagatcagtccggaatgtcactagctagagcattgtattatagggggaaagcctctagttgtagctatataattgcaacttttgtagtaatctcgtttagctttctctcgcaaaaccggggtcaatttgggataggactatagtaaaaatgtctcttcaacaagggctaatcaacaggcctctgacccccttaattagtttgcctttgtgccaatgaccagattagcaattttaatgtactaatgtagcgattgctggcaagcaagcattcgcattggatgatctccctacatgtgacaccagcaacagtagtactccatgtaaattagaaaattaaatgtgtatctgcgtgcattaactgatgctagctacaacaacgtatgtactgtggagaatggcaggaacatgcatgttttggaagaaaagaaaaccatgggaggttgaagaattgagatgcaggccattgatagctaccggtcctacccatagaacctgtgaccttttgatccatccatttactcctctaacctcctctgcaaaggctattcaattgcctgtctgtccgctcaagatcgatcgatatgtcactgtgcactacgagcagggactgtcccatgccgttactcctatagaagacttctttagagtgaagtaatttttttttctaaacaggagaagtaattaccatgaaaattctactcgtaaacaggaatactagctacttacgagttctaaacttgttgctaatggccaatgggatgaacaatctgacactacaaatattgctccatgcacattttacaaaacgtttagctatttcagttatcctgggattagcatgcggtttcatgaaaagtctaactgtaatttggtgcagtaaaagataaattgactgtgcctttcttcaaaaaatggaaaaaaagaaaagaaactgattgttaatttagctgggtttttttttgctaccttacatttagattcatttagtatagtacccttgcccattgtgtcatggcaatggcatggaccattgtggaacaaacggagtataatgacttgatgcatgtaagcatttgcatgcatggttgcatcatttaatcaagtgatagattggagaaccaaatgtcaagtgctttgcatgctgtgcttaatcaatcagtgcttagtggtactaatcaattacaataatatatggatttgattacctcgatgaaggtggtgaagggctgcatgaggacgtcggagaactggtcgggggtgtaggtggcgcccagcatcgggttgacgtagtagttctgcacgaagtcgctggtgccggcgctgaccacgtagatggactccgacgtcagcgccgccgccttcttcccgccggccaccgcctccaccttcgtcttgtactccttgaagtaccccagctgccggctcagcgatatcgccccctgcatacgccacaaaacacaccacatctctgatcatcgattaacatatagtgattttggtttacaagctagtattatggcttaattggtcccgtttgaactggctggagataaagattaaatgcgggcaccaaaaaacatcaacatgtaactaattaagttttaattattttaaacttaaaaaacaaatttatctgatttaaaataattttgtaatacaaaattttcattgaaaaccgaggtaaattttgtatcttaattagaaaagaatataacaatttgaaacatatcattgagcacattgtttctgcagaaaatattactccctccgtcccattttaagtgtagccatatttttccgcgtcaactttaaccatccgtcttatttaaaaaaaaattaaaaaaataaaaacataagtcacgagtaaagtactattcatgttttatcatctcataacaacaaaaataataattataaaaaaaatttaaataagacggacgataaagttggacgcgaaaacttatggttgcgattaaaatgggacgagtgagttacttagactgaacaactaacttaataagaaatatattgaagacgaaaatgcattttttttaaaaaaaaagaaaaaagaaaaaaacgtgaagcagataaacaaaccgtacgtaaagggaggcggtggtgtcgaggtagccggaggcgccggaggcgaagttggcgccgtggaggagggagcggttgtcggactgggcgagctggccgaggtagggcggcgggtaagaggtgagccccaggttgtcgacggtgtagtcggtggccagcttcccgttgcagaaccgccccgtgggtgccccgtgcgtctccgggaagtcgcggccgtagggcgggaagtcggcgcgcaccagcgtcgccagccggttgttgttcccggcgtccaccaccgagtccccgaatatcatcacccccggcaccagcgccgcctgctgccccgcagccgccgccaccagcagcaacgacaccaacaccgccgccgccgccgccatcgcggtcatgatgctaataatgctactagctgcgttctctctctggttagtggagtgaggtggtgatgtggtgagcgaagtgaagtgcgtgggtttcaatttgttggcctctgttatttaaattgagacgtgcggtcaagtgaggccgaatttagttccaattttttttttaaaactttcaacttttttatcggattaaaactttcctacacataaacttttaatttttctatcacatcgttccaattttaaccaaacttccgtcacaccgtttcaattttaaccaaacttctaattttaatgtgaactaaacacacctaagttattgctggctggctgcctgctggaactactacagtaactactgcaacaagttacaactattacaggcatgtgcgcattcaatgggctaaccaaaatgtactagtgcgaaacttatcttcctatgcatagtgctccaatacaacgaaataacacgtactggatccaactttccacctacagcgtcatgcatatcgtcttgccttgttttgccttttcttttccccctacgtgcgtgcgtgtgctaatctggagcgagtaaatcgtatctaaccctatactgcttaataaactaccccaacgataaattaacagaattattatgttgagatttgtgaaacggcttttaatttctgtgtgagaccgagagcttcactcgaataaaaccatttttatccgtgaaggcttttctgctactcaaataactagtactttttaaaacttcccctgtgaaacagtgagacctcaagattgatccagtaggccagtaattatcaactaatatccattagaagatcaaacggaagataaacgggcaatatttaagaggttaagattgcttacgacggctcaagaaggctttacagccgcatgaactgttccaactcaatacggttcatagtactagatcgtacggctgacataactccattaccacggctgatactttactacgggtcaagctgggcaaaaccttgaatagctgatttgagtgcggaacaatagcaaacggctgcgaagtaaatcacttcatcgacttaaaaacagaaacatcacaaaaataagctagagatttgtcaaacattcgttctgttcccgacatttctgatcatgatttcacataatcacataccaccaaaggaccgaatgaaacaaaaaaaaaggataatctaaaccttccatggtctaaagcctaaaacagccaattaatcaggccaaatgtaccagaactagtgtataaatgctgtactgcaatcagtgggcatcctagctcctactgttaataatacacaaatgttacatgaacttacaagcaggggagcggatactggacacgatttccaggtcgcaaggccaagacgcattccattggctgtacagtatccgaaaaatccagttggttttgcaaatcaggtggcaggagctgagctgggaatcttgaattgcttcttcacatagtgcgaagcctccgaatcatttctgtggcaaaggaccctaagcagggttttggaatcggttccaaacttacttttagcgccctgagtaacttctcgtaggtcatcgatgagcacacgtgtctggtaaaaacatgcagaagcaaaccgttacagatgatgattatgacttggcacgcactagtcttttttgggaaataagagtttcctacggctaaattttactcccttcatttttaatatactagaaaaattgtacgtgcattgccacgggtgaaggttattttaatcatattattgttagatctttttgtctaaaaagtatatgggatttttattttgataatattgatatctaatttggaactcttattaggcctggcaagaattttgtagcaattaggagtccgactcttgttccaaattaacatgcgagttttttaaggatttcttatacgactccttattatgtattcccaaaagtgaacaaacttaaaaaccgactcaaatacaaatgacgtaccaaagtatcaacagaaacatctttaatttttataataggagagacagagataacgccattgacattttaagattaaccttttaagatacgttgactattcattttattcaaaaactttatgtagttatcattcattttgttatgtcttatttatcgtacaaggttcttttaagcgtgacttataagacaaatggacaaacgtatgtataaaaaaaatcaacgatgttatatattaaaaaacggaggtagtgtgattttgggactgatttctgctctagggcaaagggcatggaacaatgtggcacgattacatgcagcttgggttgtaaccagatctgggcggaccagctacctgaaatcctgaattggtttgtttgctgtgccaacgacttaggctgtgttgaaccccttctccccggcgcgcaaaacgaagctcatattattgcatgatcaattaagtattaactttttttttgaaaaatagattaatatgattttttaaaacaacttttatatagaaagtttttgcataaatcacactgtttagcattttaaaaagcgtgcgcgcggaaaacgagagaggtgggttgggaaaatgggggggaagaacacgtgattaattaagtattaacttttttctttgaaaaatggatcaatatgactttttaaagcaactttcgtatagaaattttttgaaaaaaacgcaccgtttagtaatttgaaaagcgtgcatgcggaaaacgagagaggtgggttgggaagatggagtgccaaactcagcctgggataactagctaatggaacagagaagttccatctaaacgaacaagttatacaggtgcctataatccaaacagtgaagattctactttttttttaccaaaataagaaatgggacataattaggttcgtttgagtttgacatgaagctaatgtgtgttctgtgcctacgacttagagataactagctaatggaacagagaagttccatctaaacgaacaagttatacaggtgcctacaatccaaacagtgaagattctactgtttttttttaccaaaaataggaatgggacatgattaggttcgttgttgacatgaagctaatgtctgttcactaacaactgctagacacctatgtaaccattggagctacgtcattatgttacctccacgatctggagttccacaccctaggttctgttcaccggtttacccagtgtcaaaatgagaaattaaatccaaacttacctcttgcttgatcagatctattacagggcgaacacgtgagaccaaattctcgacagttccacgaggtaggccatctccaccagatataaaaaattcctatgcgaagtgaaaatttacatcaagactaacagttttttgtttggccagcaaagagaagacaacattaaatgttccagaggcataataagcacaaaacaaccaacatccaggtaatactatgttccttataacgcaaaaaacagccaggttgtacttcagataatgatataccttcagaatttcaagatcttcttccaaaagagtggcatcacttggagagaagacacgcgtaggacctccatccaatatcacacggagtaggccatcctgccaagcaaggtaactttaagataacatatagctcacaagctgtcacaacaatcctacagaatttattatccggaaagattaccagagatgcttgtagaagccctgtaaccacacgatcccgtagttgctccacaatgacattacaaagctgattaagcacctaaatattgaggcgtggaatcaaatatctccattagttcaagcgaatcttacaaaccaaatcacaatatatatatttatcaaaaaaacactaataaccagaggtacaggattcaagattgattatcgatttttgtgatatagcaaatggtttgcactttggccacagataattaacttatccatatcttttgaggaaataaactatattcataacagaatacaatatgtgttctgtgaaaagttgatcatctaagtagctaaccagcattagtacatagataaatggtaggtttcatgctagctgtcagatcatagggttttgtttctccaatttaatgttcctgaaaggttgcacgattcatgagcataccgtatcaagtacttccataatagcatccagtcgagcttgagaaacattgtttttgtacaaattatcaataaatggctgctgtaggtcccagaagataacctttagccctaagaaagaaaaggttaacatgttaatagatatctgtcagcttccaagaaagcactggggcatgtatattttcttacctgtaaactcacatatccgatcaattgcagcattgatttcttttctgctgccatcaaattgattcttctgactcgagacagcactctttgatttttcactcattgatcgtcctgacaaagttcaaatattttcaatataacagatttagtctgatgttatctataaggggtagatcaaatagattgatttgcaaacttatcagaatattcaacagataaattggcaactaaaatattttttttctaaagaaaatcataacagtatacattttttttcttgaaaacgcataacagcatacttactgatgttaatgctctcacttttcctcctagcccaccgctcatttatgctgtcctccagcttgcttagctggctgataccatactgtttgacaaaaaaaaaagtgcttctggttcaaaactaatgaaaatggacacaattcaaagggaagagaaaagtcaaaagatgccatgaggacactgatgtagatcatgaaaaaaaaaactagcaatagctaaattcaaaggaagccaggctggaaggtgaagatattcacctataggttatagcagcataattatcaacacacttgaagcctagaaaataattttaatgagatacatacactgatccccaaatgtcatagttttaaattaaattttttattaagattggcatataaagaagatatatcgttttatatctcacagaaattgctcgggaacttgacaagtcattctagtcaaagcaacaaatccatatagcagtgctctgttgtaaagactcacatataggctgttaagccgtacacaaagctttggcatagtaagttgtattatttcacttgctttcctctcgtcaactgttctaacttcatgtatttccttttttacgaaagccttgattccaagctcctttttatatcgagtaagaacagggacaggtggaattaaatcttctctatcaactgcaagcaaacaaaaccaacaattacagaaaagttattctggcgtccacatccacagtaataacttttaagttatgatcttggaagcgatgcaccatctacagcattgattatttgccatatactcatgtaaaagagaatattttcctttgaaatcactcagacaaggaagaaaggaacaaaaatatgatgaccgaaagatatacagaaagtacttcacagaaaaagggtgccatgcaaacctatcggtcctgtaacaagttgtgtgtaaacttgaaatgccttgtcaaaaccacggcagaggctatttagttctccagttctcatggggaccttgaatgcaaaaaattgatctgcagtctgcaatagtttgcaaggggcaaatgattgctctttagagacggatggaaatcaatccataacatattcaactaccaagcaaaaaaaataaatctaaagaaaactaagggcatctttgggttgcaacccaaacgaacactaaaaaaatttggtaatgccaaattttagcacattttggtaatgccaaattttggtagcattggtggatacatttggtttgaaaccttaccaaataaaggtataaatttaagagtggtaagcttccagaattatggaattttgttatggtagcaattgttgggatatgtttgttttattgccttaccaaaatttggtaaggctgaaggtggtaacaaaccaaacaggccctaaggcatgcaaatatctttgaaatgttgtggcataaaaaaatctctacatgaaaacaaaaacagactttatcccgtaagataatattaagcaaaatttattcaaggagataatggagtgagggacaaaaaggagcacctcttctatgattctgtagacttcgacaatagaagccccatggcgttgttgaggggatataggatcccaagtctgttgagcaaaaaaaagtttggcataaaaaagatgacagaatgaataagataatgttgtatccaaataatgtataagaagcgatggcaggctttgagagatgtaacatgacatttatgtttgaaatatatcatgaaaaatagatcactttcgcaatataccacgaaacattctggttcacttcactaaccgaaaagcatgggattgaaaggtaataaaatggatataaataactttaggccattcgtatagcatgtggaatagaccagaaattactttaggtcattcatatcatggtaagaaagaggatgttggatatagataaatcaaacatactgagacagtaagagctttgtaaaaaagtaacttgagtcaaatagtgttacctcttgttcagcagctcttttaacccaagtttcaattctctcaagctgcccatttacccagcgtaatatcaacgtgccagatttactttcaatctgggataaaacaaggactaggatgaacaacatatgaactcttaacacaaaataaactaacagttcattgctgagcatcgtatgctggatgataaaatggcaaatactgacataaattgataaacacatcatgtcaaggtgaacaatcaagcaaatggattggataccattttgcactgttgtgagtgctgctacttgaagaagatacagttaaataagcaaacctgataaggagctagcttttgtctgcatatgctgtccaaaccatcatctcccacaacagaagccatcacagacattatgtactgctccaaagcatcggctgccggaaatacagaaaccacatcctccgtaagatgctccgcgtgctcaagaaacggtttctggcacaaatgtcatgcaagcattaagaatcctatggtggtggatatacagacatttcagataagagtgtctgacatagcttaccaatttgcttccataaagtttatggagaagtgaagcagaaacaactgcagactgtgggtgccactttgacaaaaccgatgaaaacacagttgtatctttcttcagaagcttctttgtctcctcagctagagatgctaaaacatgttcatgtgatgtgtctgctttagcctctactgagtgtgccatctgaataaaaaaagaaataaatgtttctttagtccatattatagatataattcataaggggaaggaactagacaagtctatgacaactccaaattgcagaatcttgacatggatgatgctgtccactttaggtgcacacagtgagtgtccaatccggtaaacaaaacaaacaaaaatattggtttggacagagcatagttacaaggtttagatcccggagtttctatctcttgatatgtaaaggacagccatgtactgagattttgttatatgaatgtggcatagtaatattgcattcaagacatttcataatgacttttcaggaaggtagtggtaaaaaagcggaattcagtttatttaatgctactaaaagatatagacaaaaagtaatttggaaaatataaaaaactgaaattcaatcacataaaccataacatccaccaatatttaggcttggacatctctcatcaaactatggtcatgttataatttctaatacatgaaatagacatttcaataattaaacaccccaactacaaagaaaattgctaacgttgacaataatatggtatgatgatttcctacgagcgaacatggtcagatacgacattactggaacttcaaaattgaagtacatgtacaaaataacggattgagactgaaggtttcacatacatacaagcatgattatgtaagcgattttacatccatctcaattgcgaaaagtgtaggaggcaaagtgtatagctctgctatcaaaagaagccgctaagaaagtcacctttacgaaagcacttttgacagaagaagtgatgtaacggtcaatctgatctcgatcaggcgactccattccctgatgtacaaaacaaataaagcgcgacatcagaattttccacatgtgcagatggtagaagtattgctttctacattccagatggcctgtatttactatttagaacagaatttattatatcctttttttttgtgagagccacccctgaattattatatagcggaaatgacttttgctcatgaaatatctagctacactagtgcacgagccggcaataaacgatctaattttagattaaaaatggtgtaatagatgaaaaatgaagtgaagtataaataccttgttattttcttcaccaagaattctcctaataagcattgccactgttacaatatcagccatcatgctagggccctgtaaatgaaaataaatattaatatgggaaaataatcccttgttgcaaacaaagtccagatataatggttcagtgtgatctatggacttggtttcagtaaacaccaaatgttgaacggctgaagtctgaacagaaacagcagcgtgaaaagaggaaattgattagaaggaaattacagctccaagtcatacacataaaaatgccctaagaagaacaattgaagaaaatgataagcttaacagtgaaagtcaaaaccatgaggcacggaaagtattggtacaatatgaaatcgaggatctaaaaaagacaatatgcatgaatgactaaatagtactcagctgtaatgattgactgccttatgcatatatgagttgcacactaacaaaaaaaaaagaagcaaaagccaataccaggggatataattgatctacactgaatgataaatattttatttataaagtacgaacccaatggaataaaaaagatgactgtgaaagagtaaaggagatcctttccacaactcatgcatgttatgaagcacgtgagcaaaccaggagttggcaaaacaaacctctgagaagtgtaggtgataatcattcaatttcttgtccacccatttctgaacgggagataggaaagattggaaaaatgtgaagtcttgaaagctatcctcagcatcaacagaactacgcaaacttttcaagtgtaatctttcctgtggaccacgctgttccttcaaaggtatcttcctcaaatgctcaatcacaactttcaagagtccttgctcacctgtaaaaacaaactgtattgcagaacatccattaaataccatactattgagaaggttacttagtttataagctaaaaaggtcaattgcacaccatgggatatggtttacaagtatatatgggccatattgttagtgaagcagtctttatgcaagagcacctatggtatcaagagacaaatgatccactggcaacgaacactagtgatggatcatcctacttcatgacatgcttaactggaactacacatcaccatttccacaaaatagtaaaggctaaccaagattttgcaccgatctccttttcagatgaccgtgtctgacattatgaacagaaaaggtttgaaatcatttcataaaaaactgtttatgcttgaggaactcacttgcttttggcttatttgggctattaagagaagaacattagatatcagagtagacctcaatcagtggttatggaaacacatagggttattgcagaatgtagaggtacttagggcctatcataaatccataatgcaaccacaaaatattccagtaagggtaacctcaagtaatagtactgcttggctagagctatacctgtctaaataatacccatgcataacatgtatcatgaatcgtctctgtaatgcctagtatccgccaagttgattttaggagctccaggatttcttccacttcctggtagattgaagcaaaaatgttaagagaaatacctgcaactgatagtgtatctagacagaggaaaattacaaaagatgattttaagtactggcctctgtaagctttccctcatccaagatatcaaaaacactgccgagcattttctcatacagtgccacattcagatggtagccatcagaccaatgacaaacctcaccagtaagatcaccccgtgcaggtctttcagagagagaagtagcaacttctctcagtgatcttaggcattcagtgcgttgaacctccacagcagatggttgcaaggactagcaagtaaaacaccacgatgagcctcagtatactggatagttttacacaattgttctaaaagtcaactataagagtattcactgagtaatctctaaataataaaacctcagattcttcaatctttctgaagaggtttcgtagctcattgacctttcgacctaactctccaaatccaacaacaggatggtttataaggccctcctccagcatgtttagctaagcaaagatacaaatgaaacatataatgttaaggcatgatagggtggccccaaatactgtagaattcaagatcatttaaggcacaataagatggctaacctgtctcttctgccaacgaagatatgctttcatgtctgaaaactcggctcttgagatacagcatagtagttccaatggaatcaagagattgtccatccgttttccaactttgcctaccatagcattgagcaatccttgtctagttctaatatccatggattctgttatctatccaaaaacagcagggaacacggaggtcaatgtatgtaagattagcatgctgagatgctttaaaaaacctggatgcacagaaacataatgaagggactgatggccttaaactcaaagagttgtagtttatggactttcaagcgacaaaagaagcttataagctgctaacactcaaacttgctaatctaatttaagttgtgtgaagcattaatgaacatcagggaacagaaaggtgaacttcttttattcgtttattattcagtcaccagaagcagaaggctaagacaatatacctcaagttgtgctcgcatggtttcaagcaaaccaaccaaacctggttgccgctgagtttgggattgagtactctcactcttactacgtccgagtttcctcattaatttgtttctcttctctttcttcttttctttctgtggaactataagtcccctgtaggtatggaaataaggtaaatgatatggtatacctggaagactttcaatcttctaattggaaaaaaaaatgagcacaaagaaatgcataagcctaccctgaagcaccagcagcagcaacaagaatttcatatgctgtttcacggaggtcatcatctgttatacctggaaaaacagcacagtttccgttgtcaataactttcttgacccaatgtatgtagccataccagcatgaagacttctaaagaaaataagtcatgaaaatttcacttctatctgttattggatatctgaataccataatgacataacagtcatcactattacctgtttcaaatagtggtaaccgcaatgataaatcattggcatcactttgatgtcttctagaagcccttcggctatcgaattcatcttcttcatcctcaaaatcttcaatgtcatctatggttaactccttctcagttggagaatcaaatgattgtgattttgataaatttgtggtagagactggtgagtgcacagcaactggtggtggatccacaattggtgccggtatcacaacaggtgatggtgcaatagcagggacagggggtggttctctcgctggagctggtccagagtactctggttttgtaagtaaaaagaattcctccacagttccactgttattctgacaaaagtataatgtcaaggcattcaaaatcataagaaatgaactttaatgattctgaaatgatgtgcacagcatatcaactaaacatgaaacattctctattaaaataggaaaacacatattaaaatgtccatatatgaacataattgtatccatggagtttagtggaatggttaggtcttttatcctggagctttaaaatgggcaactcaaatagctcctacattgcaaaatggctgacaaacttttcaatgaaacaaaataaatgcagcagctactatagatcagctcaccacgtaagggtagtcaaggctgtcatgaaaaagccggatggcatctccaaggtcaagtgcttcacctacacggtcgaataattttcagaatatacatatgaaaaatacagagtggcatacttgggtaaatctaaaaccacctcacctttcttagcacaattgaggacgtaatcaacactgacttgatctatatccacatcatccaaagagatcgcaccaggaggcattacaactttcttgatcaagttaccagaaagcatgtagttgagcaatacatgacggtcacggcgataacgttgcagcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaaca

SEQ ID NO: 14545 - DNA, 3396 bp, Oryza sativa
  unsure (1)..(3396): unsure at all n locations
agatcgcattggcccgcagctcccagatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatctgggcccgaggcggaggcggaggcgggggtgggtggctcgtcgagctagttacctgcgcgcgcgcggagagggagatctccgccggctaccgacgacgacgatgccgctggtcactcgccgcggcgcttggggagtcgggcaaggtggtagctggcggtggtgggcgcgactcgctttcctggtggtggtggtaagtggaggcgaggagaagacggccgcggccggggatccgtgcgcgcaggctgtggacgcgcacgaggtggcgaggccacgagggcctatttttcttgggctacaagggtttctttggcccatctcacctgccctgggcctttgggcctaattttctacgaccccagtcgccaagctttccttgtcagaataagtccactttgactccttaaagttacccgaatctagtccgtaacccacaagaatgactcctgaactattcaaaccagtgcaatttgactccctcagtggttttggataacggttttgctgacgtggcgatgttgacttggtctgtggtattgacgtggcgcttaggtggcattagaattaaaaactcagtgcgccccattcgccattcacacaaaaaaaaaattgtgggaccatatgttatccctatctatcccttcttcctcctccctctctcccttctctgtctgtttctgcgcaggatctggagcgacggctgcaccggcgccggcaccggcggcaggacgaggatcggagcggcggcggcggcactccttgctgtgtggcagcctctgcttgccggtggcgtcgtcgtcgacgtcgtagagcatgttggggtcggacgacagcgccgcggcaacgaccgcttgctccatgcggcggcggtgacggcggccacctgggtgagcggtctccagaccagcttcttgaacctgtacttcctggtccccgagaggaacacgacgaggccggcaaggatgcccacggcgcagatgtcgtacccccactggcggccgacattgtcctgcacgtacactagcacggtgattgtgagcagcgcgacgaggctgacgaagaagtagaaccagttgaagaatcgcatcattttcttgctctcgtcgtcgtcggactcatcgaactggtcggagccgaagccggagatgctttacttgagcccccccccccccccccccccgtgcccagcgctgtcaggtagagcaccctgagttgtgtcccgttcgtcaccatgcaattcgcgctcggccccttgagtcgctgcacgccggcggccgaagccccaacatgccgtcgagatcgtcagtatcaatgtatcatcagttcatcaccccctgcagcatgagccaagatatacaatcagtatccatccgtcatcgagcacacattagcttggttgaacagaggagtaagaggaagacacgaacagtagcttggacagcttcaaagatggcgatggttaggtagcggccgaggtacgtattggcacagtagcgtgcgggaaatgggccccgactagtgtggcgcgttgctctagcaccgctccggccctcgccccgccgccgccccagatcctgcaccgaagtggggaaagagaaacagagaagagagaaggagggaggaggaagaaggatagatagggatgacatgtgggtcccacaatttttttttgtgtgaatgacaaatggggcccacatagtttttaattctaatgccacctaagagccacatcaacaccacagaccaaatcaacatcgccacgtcagcaaaaccactatccaaaactactgagggagttaaattgcactggtttgaatggttcgaggagtcatcttatccggttttacggttgagggttacggattagattcgggtcatttttaagggagtctaagtggacttattccttccttgtccggtggagggaaaaagtacaccgaaggtccctcaacttatcatcgagtttcaaaatcgtcccccaatcacaaaaccagatatatgacatccctcaacttaacaaaaccgtttattttaggtcctttggtggttttcaccccggttttgtccgatgtggcggctgagtcagcatgggacccacatgtcaggatgccacctcatcacttctcttatttcccctcttctccctttctctctctctctcttctcaggccagcgacgggcgatgctgtggggaagaggccgccgggggggaggggagaggaggaggtccggcggccagcgtcgcgccgatggaggaaacgccgccgtccgcatcctcgttgccaccgtcgtggcacagcgtcgccgaactcatcctggaagctatgcgcgagcacgtagaggccgtagaagtcggtgggctggcgatggcatcgcaccaagtagccgtacagcgtcatttgagcgacggtgaacccctctgccaagtggaagtcctgcgtcatcgtgatcgacccctccgtggggctcgtcctctacctcgcgccgccgtccacagaacctgctgacttcggcgagctgtagtcctagactgacgtcgacggcaaggtgcacacattccgcatcaccaccatcccgacatagcactacttcatatgcgacatcgccgcccgcaccgcctcctacgtccctgacttggagagacgcgtcttcaacaactatctgagcatcatcgtcgcgccaggaggtgggggaaagtacctggccgtcgacttctagttcatcgttggcggcgacgaggccaccctcctatgcttctcgtccgagaccagcctatgggaaaagaagcacgccaacaaccccctgccccgctagatctggagattctttgacgtcgtttcccacgccggcaagctctactgggtggacactgcgacaggcatcctcttctgcaacccgttcgttgacgagctgcacatggagtacgtcccaatccccagggtcgacctcccgctagaacacgacggagactgccacggccgtggctactgcgccgagagagcgctcgcctcccgccactgcgtgcagctgagcgacggcaagttcaggtgcgtggacatgggctctgcaagcgatggtgttactaccaaggtccccannnnnnnnnnnnnnnnnnnnnnnnnnnnnnnnnnnnnnnnnnnnnnnnnnnnnnn

SEQ ID NO: 14546 - DNA, 14232 bp, Oryza sativa
aaagggagaaaaggggaacccagagagaggtggtgaggtggcatcctgagatatgggtcctacgctgactcagccgccacgtcagataaaaccggggtaaaaaccaccgaaggacctaaaataaacggttttgttaagttgagggatgttatatatctagttttgtggttgggggacgattttgtaactcgatgataagttgagggactttcggtgtactttttcctccggtggagtaataaagatgaagtccagtttgactccccaatcataggtcgagtctaatttgtatccctcgaaagaacggttataacggcttgttcaagtattaaaaccaatacgctctctcggcactgttgaacaacgtttttcgctgatgtggcacttaggtgacatgttgacgtagtcttcgtcctaagtaacgcggaatcacacttggcaaagaaaataaaaaaactaaatgggaccacatgtcattgataatttcacaaaaaaataagaagaatctgtggcccccctctctctctctcccttcttcctcctacctagcgaacctcatcgaacccaaccacgctagtctatcactgacctccgtgtcggagctctatggctctcagtgaagagatagaggcagacacggagaaaggaaggtagcggccagcgaaccccatcgagctccctctgtcgttgacctatgcctcaacattagagcagcattgaccgatggatgacgcttcgagcaatgcagtccccatcctagcgctcctcaggctccccgccactactcccacagcccatgggccaatagacgaggagcaacacgatgtggtcaccgtccatggggaagaggaaagcaacacgatgtgttgtggcatggagaagcttagggtcgcccagcactacggtcggcgtggttgaggtcgcgagcactgtggtgaagctccgtcaccggtgcgccactgccattttttcttcccctcctacggctgagttctctctccccgccgccctaggtgccttcttctcgtcacctccccatcatcgctctctctccacagctgcaagtaactctgtatgtttatatttttataatagtagatgtacagaaatagagttatatgcccagttgaactttggttcgcccagtaatgcagtttattttcttcgtgcaacaagcacacaacacatgtacataaccattttgtgcgtgaaggtgttggtttttttttttcattaatgcatgcaatgctgtctaggacatgttacatgtatgtacattccgatcgatcaagttggttgtacagagtgaatcacgaagaattgattcataaattttggatcaccatatatcgagcgcaaattcctaccggaaacacataatgatgatcgatacggagtatgaaacggatgacacacatcacagaaaacggaacagcacatcacatataattaattaagacaccagctaggccgatctcctgctggaagtagcccagaaatgatcacgacggtaacttttgccgcgcgctaacacaacgttgttaacccctgttcttctgagtgacgatgagttaattaactagagatctccatcagagtatcccatcgaacgggggctcaggtcgggcatggtggcgccgcgcagcaggtgatcccggaacgccaccccgatgacggcgagcgcgtcctccgcgctgccgatgttggcgcgctccctcagcacgccggtgaacggccccccccacgcgccgccgccgctccttctccaccgcgtcagctcctcccacatggcgtcccagtgctcgatgtacggcaggtgctcgtcggcgacgcgggcccccagcccgccgaacaggagggtgtccatgaccggccggagccgctgcgcctagacgatcgccaccgtgagcgtcgccagcgcccgcttaagcgccgcctcgccgtcgccgccggcggcggcggtggccgggtcgtaaccggagagcaccgtggcggcgcggttcgtgaagggcatctagatgggcaggccgcgcaggttggcgactccgccgacgaggtcggcgtaggtgttcccgaacgggaggcgggccgcggcgagcccgagggcgtcgaacaggtgcccgttgccccgcagcgcgtgccagtggccgctccggttggcgaagccggcggcgtggatggtgtcgaccctcatggccagcgtccccgcgccgctcccgtactccagcaggtcgaccatgatcagcttgcccctactcgtcgccgccgactccacggcgacttgccctccgccggcgagcaggatgagcgggatcagaaggacgaagaagagcgcggccatggcggcgacggcgaggcgagtgcgcgcggcgcggcgtcgtacgtggtgcaaccgcctctgcattgcaagagaggcgatttttatcgacggtaagatcgaggcggacgggtagtaactagtaagcaggtgccgcgcgcgatcggcgtgagcgagcgaaaatttctggtttatcggatcacccggtacgaatgatttcggtttctcgtgttttgaatttggcagaaaattgtttgaacttgaccaaatttaatttaaaaattcaaattattttggaccaaaattaccgattttcggccatatcggtgaccctgatagaaatagcgaaatcgaaaaattgaaccctgccgggaatcgcttgaccggcgaggtgaagagtagagaggtcctcgtcaacgctccggcgagacggtggggggcagggcggtgccgggagagaaaaaggttgcaaagatttgcaggtggtgacacacacatgatcttttggtgtgtttgctgtgccaggggctaactgaaattcatactgctgtgcctgtgctgatcgtgtttttttaactttacgcagctgaaagtgggacagacttgcaggcggtcaaggatggaacatctccagcagcgggatgccgaaccaagctaaccgtgatcaactcaccacctacagcaatggccgatacagaattacagacattcattcaggctgtgtgttagatcaggggtgaaaagttttgacgtgtcacatcggatatacggatacacatttaaagtattaaacatagactaatgacaaaacaaattacagatttcacatgtaaattgcaagacgaatttattaagcctaattaattcgtcattagcaaatatttattgtagtaacacattgtcaaatcatgacgtgatcgtgattaggcttaaaagattcgtctcgcaatttgcacgtaatctgtgtaattaatttttttttcgtttatatttaatactccatatatatgtccaaacattcgatctaacagggtgaaaaatttagccagaggatctaaacagaccctcggacatgttcccattcctcgggaaactgctttaatcacccattcctctcagaaactttggatgggacacaaagtagtaaagagctttaactggcaggaaaatcccttaagcacctatgtgcagttgggaaatagatcccctgactttatgcagtctacagttgtgtcactggcagggcccacatgtcagtggcacaactgcaaattgcacactagaactagccaccacatgtttgcatgtggattcagatatatccaggtgagaaaaacaatgtcactaggagaaattatagcatgtatcagagcatttccaacaacctctccaaattgaactctccaaatacccatatagcaaactctccatccgatttggctagccaaactagttgttcactccaacaacctctccatctaccctctctactttgactctatgacatcgggacccatatgtcagcctctcccttcttcttcctcctatttcttcccctcttccccaccaaactcctcttttatccctttcttggttcttcctcctctcctctgctcttgtacgcctgagattgggagggggtggccggcgcatggtggtggggggttagcgcagggcggcgcgctggggaggaggagtccagggcgccggtggaaggaggctggggccggacggcgtggtgcgcggcggttcgatggctgagtgcggcggcgcggcagggcatggcgcgcggcggcggtgtaggatcgagatgtcgactagaggggggtgaataggcgatttaaaaactaaatgacacctaaacaaaactaacctaagttgctaggctcggtgagggttaagtctaactaagtaactaagttatgttttgcaaacctagggtgatagtggctcaattaattctctaggaaagtaaatcacactcctatgtcaatgttttgcaatcctagggtgatatgatctcaagtatgtctctagaaatataaattgcacaaatgtaaatgcgacaatcaaatgagataaggagacaagagatttttcaccgaggttcgaaaactcgccggtttcctactccctgttgaggcgagcccaactccaccgctcaaccatgaagccaccgcacgcccccttcgtcaaggggtgggcaaggtggaaagcaggcccacggggaggactacccaagcctcgatcactcgtggtagttcttccttcactccgaaggtggtgaaatccaaaccactcacaaaccggcaccgggcctcctccacaatcttctcggagaggtcaccgggcaactcctccacaagccgtctaggaggcggtaacctccaagagtaacaagcgatggcgcggctcggagatgatcaagtgccacactagctctacaatggaagcaattgcacttaactcttggctagaacaaccctcaaacacactagaaggatgaacacaaagctcaagtgggtgtgtgagagatgaaaggggtgtatgcaattgaagtggtgccaagagagtccccttgctgctggagagggagtatttatactcccaccaaccaaaactagccattgggggagaaatcccctaactctgtgtactgccgctctgaccggaggtgtgtggccggtcagacagtgctactctgcaacggctaaaaaactagccgttgtagccctgttagagggccccattagcctggccggtcagaccgcaattgagtggccggtcagactggcctcggcttggtcagaccgccctcagctcggtctgaccgaatatggcttcatcggctctgtatcggccaccttgagcaacaccatcccagcctccagggggccggtctgaccgcacaagtgtcgtcagtcagaccgaccttgtgcgccggtcggaccgcccgcttggggccggtcagaccggacagggcacgccggtcagaccgtcactaggtggccggtctgaccgcccctggtcaggccaaaacacagtgaaactgcgtgtgttgtgaaaagtgtgtgtgtgtgtgtgatgaaatgtgagcacaagtctaaatgcataatgacctaatgtggcaattaagatcatctctttgctaggtcattacccctcttaatagtacggcaaagctataaataaactagcacaattttgatcgcccaacgcctcgatcaatttaaaaagaaaaacactagttaaccgtcttctattccttttgctttgcgccgttaattttaatccatcgataatcatccatgcgcacacataatatgaatctaacttaaaatatatagctcaaagacaacagttagtccacaattagtgcttgtcattaattaccaaaattaacaacgggggcctagatgcttcaggcagggcgctacgcggtggggcggcgtgtggcggaggcggcgcaaagggcagcgtcggcacagccgtgcccggctgcgcgccggccggcgcagcggccgcctgaaggcagcttgtcggcgtcgaggaagggggcggaggcaggagtgaggggcgccgacggtcgcggcgagcgaaggatggcggctggccggcgagcggaggccggtggctgcagcgccgcctcgctgcaatccgccgccctgccaccgccgctcgcatgggagaggatgcgcgcacggatggcggcctcgtcgttgtcgtcgccgttgtccaccatcacaaggggtggccctctgctcctcgccggccttgcctgctcctccgctgcctcatcgctgtgtctcgtccacgacacctccgcctccaccgatgatgactacttcttgtcggacgacgtccacgatagcgccttcctgatccagtcctcctcctcatcggtggcgcgccaaggaagccgaggcagagagaatgctgagaaagagaggggagagaaaagtatggtcatgggtcccacaatcccaaggttggcgaaccagttttggctggccaagtttggccagctagggagcccatttagccagtcaaatagcttggagagtggaatagctagtctgttggagctcgtttttttttttcaaaattaccaaattttagcttggagagtgagatagctatactgttggagatgctctcatgagacgagaaagacaacggtgtgggggctcctcatcgcggccggatcaagggggcgtgcggtggcgatggaggagagggccacactaaggggaaaaggaaaagagaatgaaggtattattacttgtgattatcaatcaaaaattgaattgtcaatcttaaacttagagttgattttgaggttttttttatcgaagtttattttttaacctttgatttaaatcgttaagaacacatatatagaagttttattcacaagttacatatcagttacatattgttgttacatgcaagtttatattacactatagttatactatatttacatttgattcttttttttaaggaaatctgtcgataaaatatcgcaaaatctatttcgagaggcatctcgatttaggcttaacgagcgacgcggacaattacgtgagaagtactaatagcgctacagacatgcatgcaagtagtttttgctattaggttatacattttttttcttcttatgaaattttctcttaaattacttatccgatctatgatccgattacaccgttgtgttcgtaacaattaaatctttacaacaagatctcacatgattatattttgatgaaaaatcacaaattacttttataacatgtctaaattacttttagattccactaagttacttcttagacatacaaaagtaaattcagtaaaggctaaaaataatttacatatattatagaagtaacttagaacaaaacaaatgtaactttggcatgtcatttgaaataaatccgttgtagagataaaaacatgactctatctagaaattaaattaatcagcacaaattataaaattaactaaaaacaataatgaaagtaatcacctcagagcattatgaatgtataggaagtattttaatcaaatctaaaagtaacttatatatgataattatatatatgataatttgttcaatgaaaaaatgtattaattaaatttactttctttttgttataagttaactctataatatatgtgaattacttttaagctttactgaatttacttttgtatgtctaagaagtaacttagtgaaatctaaaagtaattaagacatatcataaaagtaatttgtgatttttcatcaaaatataatcatgtgagatcttgttgtaaagatttaattattacgaacacaacggtgtaattggatcgtagattggatgagtagtttaagagaaaattgtgtttgaagtatagctaccattagctgtgtagtgatgtctatgaaatatgtagtaaaattttaaccggtgcttgccggtaggtgttggcctgttgggtgcgtaacaaaaagtgcgtgactgatcaacgaaccaatcacattcgttcttctccacccagtgctacaacaacctataaaaccttctcctcctccgcacgtacacatccagaatggcgctctttctgccactactagtggcggcgtcgttgttctcgccagcagcagcgctgctcgccggcggcgagcatggcgtcgtcgtcgtcgagccgaggcaagtggagatcatgttcgacctcgccacgcagtcatggtaccacgagctctacaggcccctcaaagccgcgctcaccgacgacggggccggtccggagctcatgggccacgccgtcgtggacctgctcgacgacgaccagccgccgtcgaagcagatcacggtccgcctgttcgccagcggcggcggcggcgacgaggcgaagctcctcgtcgcggaggacgacgcctacgtggccggcttcgccaaccggacgggccactggcacacgttccgcggcgggcgctgccaccacccggtgatcatccccgccggcggcgcggcgccgtgcacggagctcccgttcgggggcacgtaccgcgaactcatcggcggcgtggccaacctgcgcgccgtgccgctggggagggcgtcggcggagagcgccatgcgggtgctgtcccgctacgacccggcgaccaccccggccgccgacgccaagatggtcgtggccaagttcatggtgatggtcaccgagcccatgcggctgaagcccgtgtcgcgcgccgtcggcggccggtgggaggaggagagctacctgagctccgacgaggccaagtacgtgccgtactggggcgagatatcggccatgctggtggagtggaacagcaccggccggtggggtgagctcggcccccggagcaagatggacagggcgcggtgcccgcggcccgccggatgcgaggacgacggcggcgacggcgacgacggcggaggcaagctattcatgatataagatttcatgattgtatatgcacggtctggtctgatcggttcattgtcggcacttccataatctggagtgattaggttgatctgcacctgtgtctctgtgtgctctgctgctaattaataaagtctctgctgtgttttggttgatcaagtttgcttaattactattgttgctctaattttacaagctgtaatggaagaagttaattaaacttggtcttgccaaagatgtagaatgaacaaattaaatgggagggagaggatggatacagtggccgttagatctagtatgctcggtccagattaaggcagcaagcagagatgggatattaactatatactctctgtcccataatataagagattttggagggatgtgacactttatagtattatgaatctggataaagtgcctgtccagatttaaagtatcacatcccttcataatcccttatattttgggatggagagagtattgttaaagtattaaactcgtgagaacaagttaaccttaggacatgtttgacgtataatatttgaataggttttaagtcaggttagcttcaccgaggtatatataacacctcttccacaatgcaaggagggtgtgttaagctaagccgcacccatcttttaccatttcaccttttagtaagatgagataattaaattaagttgcagcacataatagtgattttttttattttttacgagtgatccttagggctaatgggatcatataaaggatcagtataaggatcactctataatatacatgtagccttaatagaggggacttaatacgtccacctattttcacatcatcacaaatttgtgtcggctttccttgtgagttgtgacagtgagactgtgtgaaaagcaagctataaggggtgctttactaactacttggcggaatgtttggctagaaaggaataggaggatttttcaaaacaccccttgctcggcaagtgaagtagctcattttgtaaagcaagacttagcaagatttccgaaagacggcctttagaccaccttgaggttcttttgattgcttgaactcctatcccttcaatgggattgtaaatgcttttggttttttcctcctttcaattaaattccagtagttctcctgccggttctgccaaaaaaaaaaaagacagtgggactgtgcgagtggccacacgaaccagcagaatcacacatacagctcgggagaacatgaagggctatagctagcttaggtttcctcacttcctctggccaatttcactgtgccgctttcattgatgattattagatcatggttgtctcattggtgttcaccgatggatcagcttccattgagtacaaattaatttgcatcatattatctcaaaatttttcaatacgaactgcccttctcaatttatatcagagaatcaagtttttttaaaaaaaaattgaagaagcaggagctcctctactaaattaggacgaataatttggtctagaaacgaagaggagacagcgcggtgaaaagaccggcagctgcctcacgcgcggcgcaccgggatatttaactttttgctacactttcataatagagtaaactatacccacaatacataatttggtagctgtgtgtaatttggtgcaagaacatgagaaatgagctagtgccttttataatagagtaaattgcacccacggtacatagcttggtaggtttgtacaatttggtgaaaaacatgacaatgagcgttttagtgcaacgactcgacagatgggtataatttagtataagaagtttataagtgatcgtataaatacaacaactttcaaggtagatacgattttgatacaataagttaagaatttatatgataacttaattatttggtgtattttttatacatgtttaatttttaagtacttattttgacaatttactagtgtggatttgtttaagcatatttatatttttatcgtaacaactaataactgaaagtcaatataagtggatgtagaaattattatatatatttcggttgagatttaaaaaggtgaaggaaacaaacattattaaaggtaatgggatgtaaattggatgtgcaacgtaatttttaaagactaaaatcaatattatgatgtaatatccgtaggattgctgtgtaatggtatattgatatcgtgaaaaaaaaactcacctaagatatacttaactaatacttaactaagttgatgcaccaaaatactaataacttatcaagttcttgtactagaatacacctgcttttcaagttgttgcacttggacgttcaattctcaagttttgcactatatcacgcacacctgccaagttattgaatcgtatgtgcaatttatactctaataggtcctcatatgtgtgtggatctaatggtaaatttttaatggaagtagctatatttatggcgccatatttttcaccaaaagttagtcggcatgtatttatattgtaaggcactaaattacatatgtaattttagtgtatttacaatgtaagtcccaaaattacatatgtaagtactaaaattacatatgtaagtcacaaaattacatactaattacatatgtaagtagtgtgtaaatagggtgtaactactgtctaaatatactactaatatatactaattacatatttatactttaattacatatgtgtttcgctggtcggtacaaatactcatacttgatcgagtgcatgcagtgaagaaaaaaatagtagcaaagttctccagtagaccgctaattagcaacctgtaacctatgaagcacaactagttacgcgtaattaagtatgcgagcacgaatcctatgaccgatccaatggctcaacaagcgactgtaatcaaccagaaaatgtgtcgccaaaaatttagcaaaaccgtttttaattaccacgttaataaaaagtttaattattcccggcgcgcttgcctccgggctccggcgccgctcacctgccaagccactggaccgcgctataaaaccgccgtcgcactcttgcgaacccgagccactgtgctgcggcttgcacgccttcctcgccatggccaccgcgctctccgtctccctcctcctgccgctcctgcttcttctccatctcgccggcaacctccccgcggtcgtcgtcggcaagccgcacatcgagggtcccccggggcccgagatgatgatggtggatctgcgggactacgggagcggcgtgggtaccttggccgtgaggatggacggcctctccgtcgccggcttcgccaaccggagcggccactggcacgccctgcgaggcaacgagcacctgttccgcgtggcggcggcgacccctctcccgttcggcagcagctacggcgatctcgtcggcggcgtcaagaacctgccggacctccccttggaggaagacccggccaccgtggtgatctccggctacgaccccgccgccgccgccgcggacgacgacgacgaggtggagctcaagcgggcgctggcgacgctgacggtggtgatctgcgagacgcagcggcttcgccccgtcatggacaccgtcctggcgacgggcggcgggcgccgcggggcggctcgcgtcgccgccgagcacctgccgtacatcgagcactgggacgccatgtgggacgagctgaagcggtggcggaggaccggcgagtggggcggcgggccgttcgccggcgagctgcgggagagggccaagatcggcagcgcgaaggaggcgctcgccgtcatcgggtggaccttccgccatattctgctgcgccgcgatggctccatgcctgagaggaggaccgaggacgtgccacgctatgggacattcgtctgacctctaactcgcgagtatgacgttgtagtagcggcaagtttatatcgttgacgtgcgtgctgtttacaagagcagatcaggtggctatagcctatatattgccttgatgaatttttttgagaattaatattatttttatggaaaatcgcaaaagtagtggccaatcggggaaaatcgcaaaagtaggtccctgtcgaacgggtgcaattcgatagggcacctatcgaacgacgggcagtcgacaaagccctgtcgaacggctggcgttcgacacgctcacttgtcgaacggagggaattcgacagggcccaccacccggcgccgcgaggcctgtcgaaccgggggcgttcgacagggccctccaccgaccctgtcgaacaatgggcgttcgacaggccggcttaaagccccgtccacccaggccgcgagttcgatttgtttgaggaccacatcgccagccgccgccgagagtcgccacatcgtcggcgtgagcgccggagggagcgaggggaggggatagcaggccagagaggaggctgaggaggccccggccgggaggaaagggttggtgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgtcttccatgatactagtctgaatgcaccggagcatatgggtttgaacgacgtgttagggtggttgtataatatatttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctagcaatagtggtgtagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaataaggcggtagtggatcagatggaagtggaaaacgaggaataccttgcgcttggtggaaggagaag

SEQ ID NO: 14547 - DNA, 3362 bp, Oryza sativa
cgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatttccttggagagtgcatggttacaagccacaacatgacactttatgggtagcttcgagggttgagcaacatacgtgtttgttggagaatacccgtctggtgcacagaaacctgacagcggcatttgttgcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaatagaccaaatgtgtgtgttctacatgaccgacacgccggtttgctatcagcgatacagaagcttcaagaagatgtcacacagtccgtgccatggccagatttacatagcagacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggctcttcgctgccactggcgttgttcgagtcgcgtgaaccattccttatctccatctgaaggagataggtagaaatatgagaaaaggaagaaaaacagggggctcagaaactaatctttcttatgaatttaagtgcaattatcttaatcttgattaaaacactgaaaaagaggcacacaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaattttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacatttaatagaaatgcaggatgttggtaaattgggtacaatatgatcaaacgtattgcatgacttgccttgctctcgaactgatgagacctcagcaacgtcttcgagaaaccgcggatcaacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccagggggacggtggcgccgacaggcggggcccatgggtcagcttctcaaaggggagaggaagggggcgccggcacgtgggccccacgggtcagcggctccaaaaggagggaggtggcgcctagcaggtgggccccaccgggcggtggctcaaaagggaggcgagggaagcgccggccgggct

SEQ ID NO: 14548 - DNA, 2783 bp, Oryza sativa
  unsure (1)..(2783): unsure at all n locations
ggctccaacgaccggaggtaggggacgaccgacaggtggaccccacctgtcggcgcccgaaagagaaagggagggagggaggacttcggggaggggaaaggaggagcgggccggcccaggaaaggggtgccgagcgcggggagagagatgggccgacggcccatctagagaaaaaggaaggaaaagaaaagaaaaagaggagaaggattttcctgggattaaatattgcactttggtgatttttaattggttaaaattatttccaaggctatgaaaattccactaaaaatcttgttaatgcattggagcatgggaaactcaagaaaaattccaccacgctatttccgattattaattgcatttattaactagggatttagctctaggttaattaagataatttcttcgggcaatttatttaaccaatttttaaagcaagaaaagggggaaacttctgggcgtgatagagtagctgtgctgaatttttctggaggggctttgcaatggttacagtccactagagctcatgaaacgtgtagaaattgggaggagtttgttagggcagtgtgtgcaaaatttggtaaagaggaatttcaaactctgattcggcagttcaaccgcctgcaacaaacgggctctgtggttgaatatgctgagaagtttaatgggatcatgcatagtctccatgcacatcattgttcatggagtcatctcttttttttttactcaatttattgatgggctgcgagcagagatcagagctgctgttattttacatagacctatcgaattggatactgcggtagatttggcttgtttacaggaggaggttttggaatctgttcgaagggaaaatcgtagagccgaggttgtgggaggagcacgcggcagtttcaaatctgggggtttctcttctgtgtcagctcgtgcaattcctggtgttggtggacgagcggatgatcggcgtagtcaggatgatcatcgcacacctgaggacaagattgcagccctacaagcctatcgtcgagcgaagggtttgtgtcacacatgtggggagaaatggagtaaggaatacaagtgtggaccaacagtgcaattgcatatagtggaagaattgttgggtatgttccctagtgaggctgctgatgggtgtgacagtgattgccgggaagatgaagttactgaatctgagggagttctctgtcaaatctccaaagaagctatactcggtacttagtcagctcgttctgtcaagttgcagggattgatacaacatcatgaggtgcttatgttagtcgattcgggcagtacgcacagttttgtttctgcagaatttgctgataagctttctacccagcaatatttctgtccagctattaaggtgaaagtggctgatggaggggtactgagttgttcccgggaattgtggaattgtcagtggtaggtacaagggcagtcctttgttacaactttgaaatttttgccactgggttgttatgaggtaattcttggaatggattggttggaagatcattcccctatgcaagtggattggtgacacaaaacgctatcattccaacacttgggttctcctgttactcttaagggagttcagtctcgggtggatacttgtccggttatttcagcacttcaggtgcaagggttgctacaccggaatgccattgtacaaactgtcgaactgtgtatggtcagcactgattcagctcaggttgccttacctcctgaaattgatgccctgttaaccgaatttcagtctatttttgatgaaccacaagggttgccaccatctcgagtgtttgatcactctattccattgcttccgggtgcaaaacctgtcaatttgcatccttatcgctacaacccagcacaaaaagatgaaatcgaaaagcaagtacgtgagatgctgcaacaaggtgtaattcagcccagtgccaaccctttttcttctcttgtccttttggtactgaaaaaggatgggacatggcggttttgtatcgattaccatcatttgaatgctattattgtcaagaacagatatccccttccaattattgatgagttgttggacgaattgttgggtgcttgtgtgtttactagtttggatcttcgagcaggctttcataaaatccatatgaagctggaagatgaacacaagacagctttcaagactcacaatgggtattacgaattccgggtaatggcttatggtttgactggggcagcggctaccttccaatgactcatgaacaccattctgtcaccattattgtgcaaaggagtgcttgtgttcattgacgatattttgatttacagtaagacaatggctgaacatgtgctgcttctgaagtcagtgttccaactgcttgctcaacatcaattgaaggttaagcgctcgaagtgtacctttgccagttcacaactcacatatttggggcatgtcattagtgatgcgggtgtgtccaccgaccctaagaatattgcagctgttgttcgttgggcagtacctcaaaatgtgaaggaagtgcgcggatttttgggcttagcaggatactaccgcaagtttgtgcgccattttggggtgatcagccgtccccttactgatctcctaaagaagcatgtcgtgtttgtttggactagcgagcatcaagctgcttttgatgcgttaaaggcagctttgacttcggcaccggtgcttgcacttcctgactttactcaaacttnnnnnnnnnnnnnnnnnnnnnnnnnnnnnnnnnnnnnnnnnn

SEQ ID NO: 14549 - DNA, 1790 bp, Oryza sativa
agtattacgttacaaggggcgcatttggttgggccataatgtgggactacagcagaaggttcttggagcattgcacaatgctgctgttggtgaccattctggagtgcaggtaacctatacccgattgcgcagactgtttgcttggcctgttctcaagaagtcggtgcagctctttgtggattcctgttctatgtgtaaacaagctaaggcagaacgggtgcgatacccgggacttcttcagccattacctgtcccagaacatgcctggcaagtggtgtctttggattttatcgaaggattacctctctcattgggattcaactgcattttggtggttgtggataagttttctcgctatgcacactttattgccttggctcatccgttcacagcttttgatgtggctttagcatatatgcaaaatgtgtacaagcttcatggtctgcctcaatctatgatttcagatcgtgactgtatcttcaccagtaatttatggtctgaattgttcaaattgactgatactcagttgcgcatgagttcggcatatcatcctcaaactgatggacaaacggagcgcgtgaatcagtgcttggaaacctttcttcggtgctttgtccatgcttgcccgcgtaaatggtttcggtggttggcgttggcagaattttggtacaatacaactcctcactctgctctcggtaccactccttttgaagctttatatggtcatcctcctcgccacttcggtgtacgttatattgctgaatgtgcggtacctgacttgactgaatggttgcaagagcgtcagatcatcactaatctcttgcgtcagcaccatcttcgtgcacaacaaaggactaaatctcaagcggacaagcatcgttctgatcgggtcttcgctgttggggattgggtttttctgaaggtccagccatatgcgcaaacatctgtggctgcgcgtgttaacaacaaactttctttccgctattttggtcccttttaggtgacggcgcgtgttggtccggtggcttaccgtttgcagccgccttacgactgtgctatccatcctgtcgttcacgtatctcagctccgcaaggcttcacctccacaatcagctgttgcagttcggcctcttcctcttgttgagtctgaagaattgattccagttcagatcatcgctcgtcgtctgtacaagcgtggcgcggctgctgtggagcaagttaaggtgcgttggatggggcaatcgtcttctgatgctacttgggaggatcttgctgtgctgaagcagaagtttccaactgtgccggcttggggacaagccggttgcccagaaggggggcatgttacagctgatgataaccctatcaagactatcagacgctcagctagagagagacggcccaacactcgtgtaactgggccggagtgggtctgaaagtgggtcttgggtatgtgtctataaatacccaggcgtgagtgggaagaggtaacgaatgagaaatctgtacacagaactatccctcaatctaatacaaatcctcttcctgctcatttgcttctctgtctttttcctatctgcttcccttgttcttcccgttcttccacgcaaggtgttcgacgaaattcccttgagaaagatcgtaacactttaatagcaagataaaagagcaaagcttcgatcgatcagctgggatgaaaacagaagcgatgaaactttaattaggagttattaccttcatacttgtaacatagaaataaatgttactcaatctagttcttcgaatctagattat

SEQ ID NO: 14550 - DNA, 722 bp, Oryza sativa
aggtccggcagccgacgtcgcgccggcggaggcaacgccgccgtccgcatcctcgttgtcaccgccgtggtacagcaccgccagactcgtcctggaggctgtgcgcgagcacatagaggccgtagaagtcggtggtgcgcaggctggtgacttctacgaagaagtacaccatgttggggttcttggggtggacgagcgcgagcaccggggccttctccgacatcccagtcgccttgtagctctcgctggcccagatgtcggcgaagctcacggcgtactcaagagtccacaccttggtccctggatcaatctgcgtgtgcatggggaccttggtagtaacaccatcgcttgcagagcccatgtccacgcacctgaacttgccgtcgctcagctgcacgcagtggcgggaggcgagcgctctctcggcgcagtagccacggccgtggcagtctccgtcgtgttctagcgggaggtcgaccctggggattgggacgtactccatgtgcagctcgtcaacgaacgggttgcagaagaggatgcctgtcgcagtgtccacccagtagagcttgccggcgtgggaaacgacgtcaaagaatctccagatctagcggggcagggggttgttggcgtgcttcttttcccataggctggtctcggacgagaagcataggagggtggcctcgtcgccgccaacgatgaactagaagtcgacggccaggtac

SEQ ID NO: 14551 - DNA, 557 bp, Oryza sativa
tactcttggaggttaccgcctcctagacggcttgtggaggagttgcccggtgacctctccgagaagattgtggaggaggcccggtgccggtttgtgagtggtttggatttcaccaccttcggagtgaaggaagaactaccacgagtgatcgaggcttgggtagtcctccccgtgggcctgctttccaccttgcccaccccttgacgaagggggcgtgcggtggcttcatggttgagcggtggagttgggctcgcctcaacagggagtaggaaaccggcgagttttcgaacctcggtgaaaaatctcttgtctccttatctcatttgattgtcgcatttacatttgtgcaatttatatttctagagacatacttgagatcatatcaccctaggattgcaaaacattgacataggagtgtgatttactttcctagagaattaattgagccactatcaccctaggtttgcaaaacataacttagttacttagttagacttaaccctcaccgagcctagcaacttaggttagttttgtttaggtgtcatttagtttttaaa

SEQ ID NO: 14552 - DNA, 134 bp, Oryza sativa
cgcgcggcggcgggggcggtgtgtgagctccagcgcgcgagtaggcagttggttggtttgggccgcggggatgcgcgcggttgggtgagtcggcggcccatcccatggaacatgtcagcctgtcgacggcgccg

SEQ ID NO: 14553 - DNA, 387 bp, Oryza sativa
aaacaaagcataaattgctgaattgtcagatggttctgtaatacaccgaaattactcaggacgaagttatgaaaaggaaaacatactgcattcaccaatcgtggaactcgtaatgctgcgataaatgaatatgcagtggttatcattataagtagagttgtaccaaacatttatattgaggtcatatcctgtcgtgttcaagaagtcataacctgcagagaacaattaaactatacagcacacatcattgcaaataacccccaccatttatacgaaaaactacatttgttatgttttaaagcaattattttgagatggggccatgaaattatctgtactatgtgtggcattcaaaagcagtctgttggaaggtattcaaattcaaaa

SEQ ID NO: 14554 - DNA, 946 bp, Oryza sativa
  unsure (1)..(946): unsure at all n locations
nnnnnnnnnnnnnnnnnnnnnnnnnnnnnnnnnnnnnnnnnnnnnnnnnnnnnnntgtaaaataaactacgacaaaatacaaacaaattcaacttcaaaattaagttttgaaattttaattttagctttcaagcataagagagactaagctgatattgtttttttattagtgttattatataattgcaccgtagcgttagcacgggtatattactagttttaattaggtaaagaagagctactgcactagtgcaccacaaatgtgaagttgtaaactaactagctgcctgtataaaagtctgatgactttgtgctgctatttccatgaagcatggagatacctttgcagtgagagtctggcagttgttcctggtgcgctcaaagatatagttgtggttccggtccagagagtcacgaacggagatgagaccaaacacatctattggccagcgtagaatacctttaagctccgtcacctcaaaagaaaaaacctctagtaaatctaggagcattgcgaaccagggcggttcctccgtgtaccgcatgggaccaatctcagttgcatccatccaataaaccatatcaatcagtcaagcattattgtttctttttcctttgcaacacaccaaagagacgagccattagatcacattgatgcatatccatgtgaaaaatgtcaatcccaacattttccattttcatgtttccatcctcactattgtgcgcccaggctcccgcctaccataatcagcgagtgaacatgtcgatttgagatgaaaactaaaaacctaacaagaggatgagcgaattcgtatttaccataaaatcatctctaaaacaagaaaaaagaagcttcctcacttcttttggcgatgtcgccggaatcgtcggaccacagattcgtccagtagcggcgatagtgggagagctcgttgagcagctcttc

SEQ ID NO: 14555 - DNA, 683 bp, Oryza sativa
acgttccggctcctgagtgacaatgtattcaacagagaagtcagacgagggaggggaatgcataccatcagtggcatcccaatcccagctggcgccctcgtcgaacaccacgtcgcgcgtcacttgaacacgacccgacttcgggtcgaacaacttgtaggctttggatccctcaacgtagcgaggaagaccgtgggcttgttgcggtcctggagcttggtgacatgcggccgaacatccttgacgtacgcgagacacccgaacgtgcgcaggtgcccaacggccggcttccgcccaaaccaagcttcatacggagtcttgttgtccaagcatttggtcggcgcgcgattgagcaagaacacagccgtagtgactgcctccccccagtagcacgccggcactgacttggccttgagaagactctgcgccatccccagaatcgtctggttgcggcgctcgaccaccctgttttgctggggggaatacggcgcggtgagctgtcgcttgacgccgctctcggcgcaatgcgcggcgaactcggcggaggtgaactcgcccccattgtcggtgcgaaggagcttgagacggcagccagactcagcttcgctgcgggcttggaagcgtttgatcgccactgccgcctccctcttgttctgaagcagtgcgagccacatgtagcggct

SEQ ID NO: 14556 - DNA, 655 bp, Oryza sativa
  unsure (1)..(655): unsure at all n locations
gttccgattctggtggtcttatgtcagtagatgaattactctatgcgtagacataacttatagcccgcctcctatcagtaaattaattactcacaagttagatttaaaaaattttgatcgagtaaattaatttcggtattacatcaatgatgtgatcacacatgcaatgtggtacatcggtagaataaacagaactaattaaagatcacaacagctccagtaaaaaaatcacaacagcaacaccactgaaggatacggtgatgaagattgatgccaagactaatacgacaatatagatcaaggccaatgatccatctacgcatgcacgaatccaacaagcaagacaacgccaataaaacaaatcaacgttgagccgacgaagtgctgcagattctcaagtcctccctgtcgacagatatctgtcaccacggctctggagaggcattctcatagccatctggataaaaaaaaaaatgaaggttacttctaagtatcacaaatcagcaaaataaatatgatttcacttaaacctagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14557 - DNA, 775 bp, Oryza sativa
  unsure (1)..(775): unsure at all n locations
tgttttctgttgcctcgctagcttgcagtctctcgttggccgttagctttataaacgctaagttgtcgatgagaattatactttagttaaatctgcactattatcagcatatcctcactacaataattggtaatgaacatgctaacattctaaggatttcttcattcaaaagcaggtcggtaaaatggctctctcggtaataaggtgtgccagtatccagggttagaatagttgctacttctacacacagattattagtgcacagttggactgtaatgaaggtgtaatttcccatacataagaaacataaatcatcacgggtgattgaatccttgtcatctagtgtaaggcatctttcttttatttttgttagcaaaagtatacagtaatataacttttaagacatgatagagtagagtagctagttaggataatggacttaaaatgcacagcttgttgattcaggagttctcacatttgagaaaaatattatgctatatgccgatgcccatgcttcatttctcaagttctttaatatgattcctaattcacaatatgttttatttgaataatgaattaggaaaagcaggtgccaatcattggactggtgatgaatgatagaggttttatctctcgagtgctctgccccaaatttggaggataccttacttttggctctcttgaaaaagaaaaagaatctgcgcctgctcagcccacatannnnnnnnnnnnnnnnnnnnnnnnnnnnnnnnnnnnnnnnnnnnnnnnnnnnnnn

SEQ ID NO: 14558 - DNA, 826 bp, Oryza sativa
tttcgctgctggctagaggacataatatggtccagtttagagactagccaaaagttattttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggccatgtgggttgctcggcacggcacggcccaagcccgacagtgcctaggccgaggcttgtcgggccggcacggcccaaccaacacaccaggccgagccgtgccagcccatgggtggcgtacacggcctaggtacggcccaatactactcgggccgtgctgggctggcctgaaggcacgatggctcatcgtgcttccttacagaaaaagtctatttttgattcctcaactccgtgggctgtgtttaaatggctggaaaataagtctattttgtatacctcttgtcttgggccttaccttatataattatttaagtctattttgcatctctatattttttttctttgatcgggccgggctggcacgggcatgatcccagtcgggccgtgctgttcttgggccgggccaaaattgtgagcttcgggccgggccgtgagcctcaggccatatcaccatctataatcttaagtagtcggtatggaagctccatcaataaatacctcagtgcagcggtggatctagaacctaggcaagcttaacgatgaacaacaaacacgagtagaaattgttctcgtaactaaggtttatgataggg

SEQ ID NO: 14559 - DNA, 2032 bp, Oryza sativa
  unsure (1)..(2032): unsure at all n locations
accactgctgccacaggataaagaaatctaaaagaggaagtagctgtaaccggtggagtgttaaatgccgttttttttcggttttcttaaacttgtagggttgtgtcatataggtccctaaactctcaaaatgcatatccaagtcctagtacttgtcaaagtgtatcatttagatcccaaattgacacatcccctctaggatcctacgtggcgctgatgtggcaatgccacatagacgtgacgtgtcctttttttttcttcttttctttttcgttttcttctcattcttctttttttttctttttttctgcacgggtcacagagaaaggagaagaaagggaaaaaaagagaagaaaaaaagaaaaaggaaaaaaattaaatgggtcccatttatcagtcaaaataatgccatatcatgtccgtgtggcatgccacatcaacgccacataggatcctgaaggggttgtggcgatttgggacctagatgacacactatgataggttctgggacttggatatgtattttgagagtttagcgatctagatgacatacccatataagtttaaggaccgcgcgtacactttactcaagagaaaaaaaacagggaaacgctaggattgtgccacgtatacgggagcactgatcggagcacgccctgggagcaggcaagcagcgtccgtaagggcctgtttggcacaactccagctccagctccacccctcctggagctggagctcagccaaacagtttcagctccaccaaaaataagagtggagctgggtggagttctctcacaaaatgaactagagttgtagagctgggtttagacagctccacaatttcactttagatcaactcctgaagctaaatttaagatgtgaagctgtaacaaacaggccaagtatggtcgtatggatatcgctctatactgcgtggtgggccttcccgtcccaaggcaaacctggcccgtatgcgtccatcaagaggttgttctgtttgtttgtttcgatcgtatgacacatacagtcatcgatgcctcagccgatggatggccaggtacttcgctgagccggcaacagcacaacgctccattctgatcccccgctagttgcagcgctgatacaaatgcaagctagtgatttcgctgctggctagaggacataatatggtccagtttagagactagccaaaagttactttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggccatgtgggttgctcggcacggcacggcccaagcccgacagtgcctaggccgaggcttgtcgggccggcacggcccaaccaacacaccaggccgagccgtgccagcccatgggtggcgtacacggcctaggtacggcccaatactactcgggccgtgctgggctggcctgaaggcacgatggctcatcgtgcttccttacagaaaagtctatttttgattcctcaactccgtgggctgtgtttaaatggctggaaaataagtctattttgtatacctcttgtcttgggccttaccttatataattatttaagtctattttgcatctctatattttttttctttgatcgggccgggctggcacgggcatgatcccagtcgggccgtgctgttcttgggccgggccaaaattgtgagcttcgggccgggccgtgagcctcaggccatatcaccatctataatcttaagtagtcggtatggaagctccatcaataaatacctcagtgcagcggtggatctagaacctaggcaagcttaacgatgaacaacaaacacgagtagaaattgttctcgtaactaaggtttatgataggtaaaagacaaannnnnnnnnnnnnnnnnnnnnnnnnnnnnnnnnnnnnnnnnnnnnnnnnnnnnnnnn

SEQ ID NO: 14560 - DNA, 802 bp, Oryza sativa
  unsure (1)..(802): unsure at all n locations
tctgtattgaaaatactattatattttgctataagcttggtcaaacttaagataaatttaactaagaaaaaagtcaaacgacttataatatgaaacggagggagtatttgaactagaagtcccctatgcagtacggtaatgcttaaacataataaattaaggaaaaagtacgaattaccccccccccccccgaactatcgcggtcgtctgaattacccccctgaaccacaaaaccggacattcttcaccccgaactatgcaaaccggacgaattacccccctcgacctaatccgcggtggttttggtctacgtggcatacgcgtggcagtccagtcagcattttatttattaaaaaaatgtgggacccacctgtcatactcccatccaactattcctctctctcttatctctctctctctcttctctcactctcttctcactcacgcgcatggaggcaggcgggcaacagggagcggcggcggtggaggcgagcggcgggggatgaggcggcaagcggcggaggggtgcggcggaggaggtgaggcgaggcggcaacggcggaggaggaggcgagcggcggcgggagctcgcgctgctcgaggcgaggcgaggcgaggcggcggcggaggaggcgagcagcggcggggtgcggcggaggaggcgagcgcggcggcggggtgcggcgaaggagacgaccggcggcaggggcagcggaggaggcgggggagacggcgtcgcgggccacgtggagnnnnnnnnnnnnnnnnnnnnnnnnnnnnnnnnnnnnnnnnnnnnnnnnnn

SEQ ID NO: 14561 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnaatgttgttgggtgatcctcgcttctgcagttttttttcttcaggtgttaagatccttttggttaattttggttttgaaatgcagctcaaaagatcaagtcattgtggattgcagaatgagagggtcacgtttgaagtaactgcagtcagcatgaagctattgtgtagtactagatactggtgttggattgagagggctgcattttgaagttacattggttggcatgaagctattgtgcagatactgtatactgtttttttttaaacaaagttggatactggagttcctgtgactaattgaaaatcatagctctcttggattgagccttccaagctttgacaagttagatttgagcgtgtttgcatatttcgtacgagtacaggaaaatatgcattacatttccatgatactagaatatgaagtaatctggaattagatgggttacgaagaatgtggtgatattttagtgctaaataattttatcttttctctctttttctttatattaatctttaatctatctcgnggattagcaacagaaaacaaaaaaaaaactttttatatgtgtgtctttagcgattaaaaagggcattcctgtaaataaactacgacaaaatacaaacaaattcaacttcaaaataaagttttgaa

SEQ ID NO: 14562 - DNA, 683 bp, Oryza sativa
  unsure (1)..(683): unsure at all n locations
cccactgaagaggcacgccaattcatacaagattatggtatgtgcctctataatctattgcaactatattgttattttcataattacaaataaaattgacgataaaagattttttgatgaaagtaaggtttatttatggtgatcagtgaatgttctattgttatgtccatcagaaatttttgaccgtggaatgtatgctggacctgttggttggtttggaggagctgaaagtgagttcgctgttgggattagatcagcactactaggaaaagtaagaaaaaaatgtagtcagtacgattgatcatataattgggatgtgatgtttttttgtcaaatatgtccatgttgttaccatatcctaagggccaattagttaccaagctgttgtttgttctagggtcatagcactttagtttatgctggtgccggaattgttgaaggtacaaatccatcctttgaatgggatgagcttgacctcaaagcatctcaggtattattggtctaactcatgatggattactgctatatttctttttttttaaatgctaatgcatcccatttccaattattttcagtttgcaaagttactgcagtatcaagaacaacatatttgcttgcaagaggctnnnnnnnnnnnnnnnnnnnnnnnnnnnnnnnnnnnnnnnnnnnnnnnnnnnnnnnnn

SEQ ID NO: 14563 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnntattcacctatttgtaagtagtaaccatgccatcacaattcattagaaatatgagatatgtcgttccctatactgtaaacgtcattggacacatgtatatgccactatatttttataacccaaaatgcccctatgtacatttatgtgggcctcatgtgtcataacctttatcaatcttcgagcgaggagtaaccttgctggcgatgtcatcggtctactccttagcatgtgactctcatagcttgtcgtacaccgttcgcagctggttttctttcatgattcagaggcgagtgagcaatcaaactgcgtcgcaacaaaagctggagaactgaaaaaaatgagggaaatcggcaaatggtagcgtgacataagaacatggggttagaaaagaagagccgccactgccaccgttggggacgactaccgccatcgagcgtccatcatgcgcttatcatcgacaggttcttctcgtttctgtctcgtacgtgcatgggtcgatgatgaccagatctgctcctatccctgaccaccacccagatctgtctcgtctctgttcttgccttcgctagccagatctaacgcactccaaaatgataaaagaaaaataaaaatagcctgataacgctagaaggagcatatggggcatatgattagaa

SEQ ID NO: 14564 - DNA, 688 bp, Oryza sativa
ctaaaaattgatttagcacacacttcaatgaatactaatcagcaagatactggaatataaagtattatgcgtgtagagacctcttattccatcctcaatagcagaaattgcaccaacatagtcagtattgtagcctacaagttttccattaggttttctgatgattgtattgacagctccaatgtcctggacaaaattattgcttacaaatgttactctggatttattgaagggttcaagaatatcctaaatggaaaagcaaaaaagcagataaaatcaccttggcgataggatcaacttcatcacagcacctaacagcagcttccttatggggaattgtgcaactgcagtccaaataattagatgaaatggataatggttatacacatggagtattagagcatggggtcaagaaataaaactgaaacagaaattgtgtacctaaaaccagcaaactctggtgaagagtatgtattaagaaagttagccaggtcgttcaccaaaaagggcacatatacagcattgagacccactgatctgaaagcttcattatgcaaaattgggcttttactgtggcccaacaggttttccgattataccatacaccttagtatctggaccaatctgttaaatattgaacacattaatcaagtctgttactgtgggctgagcaggcccagattctttt

SEQ ID NO: 14565 - DNA, 5658 bp, Oryza sativa
  unsure (1)..(5658): unsure at all n locations
ctatagggcgaattcgagctcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttatttgatctttgatgcaaccaatctccaaacaagctttccttaccgatctttcatgcaaccatctaggggcaaaaaagaaacttgtccaatacaaaaatgtaatacaatttgacaaagtttgagttgaaaccatctcacgatctacccataaatataacggtgaactcaaccagagactcacaaacgagccttgtgtgctgtgatcccagctgccttcattgcgtcaggattgtccaaggaattcgccagtgctcggaatttacaatcaaccactgaaaaataaagatgatgacatttcagttttttttctctccactggcaatgttagatgttcgcaaccattaaattattattacaagcatttaacaggttttgcagccttgataacatataatctctctacgaaggttgcgctagaatgtatctttgttgaacaccaagctaatcagaaatatggtataatatgtgaacatactgatactgaatcttcacaatcaacagggtaattgcaataaaatggaaccaatatccgacatggtttacaaacagcggtttctaaaagttaaggatgaactagaaccgattttgtagacattatgatcgaagggaaggttgctctttggacaaaccttactgtatctttgtcagaacaatatcacgcatcaagctatctggagctgtatgacgaggcatatgaaaaataatgtaagacatactactatagaggagagcttgtgtgctggcataaagaaaaggaagaaacaaatgtaaatacctggcatgcctgtaaaatgctcaaattgacccattgcttgccttatgaacatctccaaaccgctaactactgtggctccacactctgcggcctctcggagaagtctggtctcttttggtgtatacaccgcgtcgaagacaacggcataagatttaagtgcttgctgcaaaattatgatttgtcattacatgtagctatgaaggcagaaggtactgaatacaaatgtcatcaagtaagtctaattcagaaccttggataaaggagtttcattgacatttggatgcattccaattgcagttgtgtttgcaagaatcatttcttcctctggatggtaattttccaactccgccaaagtcagagcaggcgcaccaagtaagttgccaagttcttgagcacgcgctggaaaatagaaggcataaatatatgttgagttcagaacatcatgctcattgtcctatcacacctttatcttaacaaaccatttggcggaaaatacaaatttaagaaaaagaaacactaacaaacttaagtacacaataaatatcaattaaaagcccgtagtgcaaaggtatcaactgttccgtggagcaccccaactagattgctccaaaccaaccaacacatgaatataggcatgggagcttttgaagaaaaaaaaactagtgtaaaatcatatgttctccatcagttataaaattcaaatttgaattggatctacatatccagaaacaaaatcaagtgtgttcgaggaaaaaaaaatccagaaacaaaagggacaaacctcagtgaacaatttccctttttatttttcagcagaatttttcctttttatttcctgatgtgtaattttaaattttgtggagtgatggagtacatcaaactctatgctaccatttttattttcaaatcctcattatgactatttgcgcgtgttttggttggtatggagccccaactaacgtgttcaatggagcgctagatatcttgtcagcatgtactagttatagccagggtagtaattttggacccaaaaggtctgagcatttttacatgaccttgctacgaaaggttctcaatagtgaatacttctcagaaacaacacactttttttttgccgggacagaaacaacacactcaaaattattcaaatggaatggcactgtttatggttaaatttaaatcagtataaaatgaagttatggaaaatgtgcataccaaaagtacggtttgctattacaactcgtgctcccttctcttttgcaccataagctagtgctttccctgcaccaccagctccaataacaacaaaaagcctcccagccaatggtgaagtggtagtatccgttggttgcgaagctaaaaattgatttagcacacacttcaatgaatactaatcagcaagatactggaatataaagtattatgcgtgtagagacctcttattccatcctcaatagcagaaattgcaccaacatagtcagtattgtagcctacaagttttccattaggttttctgatgattgtattgacagctccaatgtcctggacaaaattattgcttacaaatgttactctggatttattgaagggttcaagaatatcctaaatggaaaagcaaaaaagcagataaaatcaccttggcgataggatcaacttcatcacagcacctaacagcagcttccttatggggaattgtgcaactgcagtccaaataattagatgaaatggataatggttatacacatggagtattagagcatggggtcaagaaataaaactgaaacagaaattgtgtacctaaaaccagcaaactctggtgaagagtatgtattaagaaagttagccaggtcgtccaccaaaaagggcacatatacagcattgagacccactgatctgaaagcttcattatgcaaaattgggcttttactgtggccaacaggttttccgataataccatacaccttagtatctggaccaatctgtttaatattgtacacattaatcaagtctgttactgtgggctgagcaggcgcagattcttttcctttttcaagagagccaaaagtaaggtatcctccaaatttggggcagagcactcgagagataaaacctctatcattcatcaccagtccaatgattggcacctgcttttcctaattcattattcaaataaaacatattgtgaattaggaatcatattaaagaacttgagaaatgaagcatgggcatcggcatatagcataatatttttctcaaatgtgagaactcctgaatcaacaagctgtgcattttaagtccattatcctaactagctactctactctatcatgtcttaaaagttatattactgtatacttttgctaacaaaaataaaagaaagatgccttaggggatacactagagtcgacctgcaggcatgcaatcacccgtgatgatttatgtttcttatgtatgggaaattacaccttcattacagtccaactgtgcactaataatctgtgtgtagaagtagcaactattctaaccctggatactggcacaccttattaccgagagagccattttaccgacctgcttttgaatgaagaaatccttagaatgttagcatgttcattaccaattattgtagtgaggatatgctgataatagtgcagatttaactaaagtataattctcatcgacaacttagcgtttataaagctaacggccaacgagagactgcaagctagcgaggcaacagaaaacagataagtggattatattctcaatacaagaaataaataccaagacactaacacctatggatataaaacttgaatagaatcagatggtaaactcacttggcaatgtacaagtatttgaaacatttttgccacatcaacaatttcggtggcggtggttgcaattttcactatgtcagctcctgttgcttgtatctgagccaccaaattttcgagctcctctgttgaaggagtgttctcaaagttatgggatgaaacaataagcttacatgtttcaggtttctttccagaaatgagtttcataaatttgtcagcgacctgcgtaacaagagggttactatcaattgatttgttggtttggaatacacagctaacaagtacagctttttcaatactgatcattttacataagagtttatttcagtgatttaggaacttgacattgtaagcttaaactggcagataaataagtatcagtattgcaaccaaatgaaaaggaacttttgatctgggtaagaaactagacagacttacattgttcattccatttagcttaaagtaatgacaaatactaaatcaaatcgcaaatatctctttgagaagtttgcgcacatgaatatacataatcttatggttcacagagaaaatggagtgagggtaaacccaaccttaagctcaatatcaacatattcagcccccatttccattgccaatagaagcgcctcgaatcgtggctcgtcatcgccttcatattcacctccttcccacttcggcctacacaagaaaaatcaaaaaaaattgcttagctttttaaatgctgcaaacaatccgaaatgtccacaggagtaataaccagatgatacaattcccaagtgcctgtcttatgatgacagattcttccttctccattcagttctggtgaataaaacctattaatatctaaattcccaagatgcaattccgaattgnnnnnnnnnnnnnnnnnnccaccgagaagttctctaacatgtgcagtgcaattccccaccacaccacaccaacctcgagcgagggaggagggggctcacctgtaggtgacgagggcggggagcgggcgcggctgcgcgaggaggacggggaggtcccggcggggcgcgaagccggcgaggcggtcgagccggagctccgccacgtcggcgccgagcgccgcggcggccgccaactccgccgccatctcccgcggcgcccgcgccgtcgccggcacgcagagcagcgtcctggcccgtgccaccgccgccgcgccgacgggggcaccatcgccgacgccgacatcgccggagcagcaggaggaggaggagggacggccgcgtcgtgtggcggctatagtacggtggttggtggagtggtgggaatgggggttttatactctctcgattttggatggttttagacatttttttaagctggttttcattagcgtttttttttcaaactgctaaacggggtattgatatcgtaaaaaactcaattaattatgtactaatagctttcttgtttttgtgtaccgtatttaacaattatattcatcactaccggtgtggcacgaattcgatgtggcatgtgacaacaaagcacaccagatccaacgtgggataggagaggttgacacgtcagatgatgacattgtgagagcatgtttaccatagtaccataataggctcatgtatcatagaggtgtgaaaaccattacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatcccaattaaccccaacagccaagctaagctattttt

SEQ ID NO: 14566 - DNA, 22467 bp, Oryza sativa
  unsure (1)..(22467): unsure at all n locations
nnnnnnnnnnnnnnnnnnnnnnnnnnnnnnnnnnnnnnnnnnnnnnnnnnnnnnnnnnnnnnnttacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatcatgcatccaaatcttatcaccgtcatagccatcgaagccaatctgataaagactacgccacactagtaagggaatattcaatatggggcatccacgaaggttgtgacatctaggatgatgtcattgcattccatcctgaactaggttttacgtggagagctcaccttgagacacaaaggtgatagagagggtgaacaacatctgaaagaaaagtatgtgccatctatagacgtcacgattttggtgcttccactagcgttggcacccttgacctagatcgtagcatgtgcaagtgcaacctcctccaccctctctcgtgtgtgattattatgacgctaaaccaaacgtaccatgacaccatctagcgatttttcttatgcgacttccacttagtatattttttttcttatgtgagttacacttgtacataaatgttacttgtttgtaaacttaaaaaatacatgctacaagtccaaaaaaaatagcaagggaaaatccctacatccattaatagaaaatgaatggttgctcttttcatgccgtcgggaatggaagaggctcacgtccctctgactttacgtcagaggagctccgtctgccgggaatagccctttgtaccccattcttttcctttgtttctcttttgtatttggttgtgagttggctttgtgaggcaatatcctttaatcttaatacaaaaatacgtaaatcatttgcgtattttgtaaaaaagaaatagaggttaccagatccagctaatgagagataaaactaagcacaatttctttttttttcctcatcctaacaaccgatcaagagggtgctagattgggatgaaaacggagcggatagtttccgtccgatccggacaaaaacggatacggatacctttcggatcggataattctcggatagttcagatatggatacgaatacggatattttctcccggatacgaatacaaatatggtatcagggattccgtcggatacggataataattcggatatccggtgaacagtgctattcggatatccgcaggacccatgagacataccccatttttttctaactctataaccttcaatatacctttatagatttttaatagtagtttatctcttaacactagtccatactattaatattatttaaattttaaaaaatatttataaattatacctcattttatataaaatgagctaattatatatgttgatatttgtttctattagaagttgagttggttttcgtgttccgagaaaaaaatgtttccgtattcgtgtccgatcatattcgattcttattcgtattcgagataatccgtatttgtttccgtattcgagctatccatattcgttttcctatccggtaaaaaatatgaaaacgaatatggtatgagcattatccgttcgtatccgctccgttttcatccctagcgctagagactcgaagcatcccagagatagagaagcagagcaacaacttgtgaagcagaagttctccctgaagacctctagcatggcatccatcaacactgcaaaactaaaaaatagattcaacctaatttttttttacggggagattcaacctaatttgatttaaggttcaacccatcccatctatcaaaccaaacacacgattacatctcactaatttcttttacttttttccctcttttttcccctcttatcattttcccattcttttcttgtgccccaccccgagttttcatcatgaagggtgtctggctaggagcaagaagggggacatacaagggcagaataaaaaggacaggaccagacacgtggatgaaagggagagaagaggactggcttgacaaggataaaaggaaaaagaaggagaaaaaggaggaaaaaggagacaaagaggtgatgccatattgcatttagaaatggtgcataggggtgtgttcgatagcacaggttaccaaccggggcaacagtacgcgcggaaaacggagcggtctattaacgtgtgattaattaagtattagctattttttcaaaaatggattattttgatttttttaagcaactttcgtatataaacttttttttaaaaaaacgcaccgtttagtagtttgaaaaacgtgcgcgtgaaaaacgaggtagatgggttgaaaaaagaggtgccgaacacacccgggcgtgttctatacttctcctttttcaaattttactttctcatttttcacatgcacgctttctgactaaacgatgcgttttttttccaaatatgttctataagaaagttgttttaaaaattcatattaatcactttaaagttttttaagttaatacttaattaattaggcgcaaatgaatcgctccattttccgtgtgcaggggagaaatttccaaacggtacattcaaacacagctttagggttaacacagtctaaaaatgcattttttgagtttatcgatcaaatgtcacccgtaaaataagtttaagaaccattagcgtattttactcaaaatcgcatgtgactgttgcaagtacttacaagttacaattacatgatcacatcatctttcaattttctcaaccaagcgcccgcccaggcacacaaagaaacctgatgaactcaattcagtagacaaagatctgagatgccaattccctgctaggatggttcaaaagcaaaacccatctagcaattgcttggcaatgatcagtcatcagatgatgactccatcctctgcgatatcaaactcaccgcggcattggcagccgagaacgcgccgtggaagctctccttgtatgacagcttctgcagatctcccaccatcttcagcaagatctctcccaggtcagactctttcgccgtcagggactcgtagaatgaccgcgcagcggtgttgctgatgtccacattggctggctccgggcagtactcgtcgtcgagccacttgtgcagtgtttccctcagccattcggattcctgttgagaagtagaagttaatctcacatatggtaaacaccaagatttcataactgcaatggagttgtcatataggcacaagggacaaatcatctgtataattcggtatagggcaagcaagctgtggaatcaaacaacagggtttcagctaagaataaatgccatttgtgttaatatgatctactttcctattcaaatcataatataaaggttattcacaagcatcgttatttatgcatacaatgcaaagtttccaattaagcatcgatttcttcggaacaggccataggacatcatagcttgaatcagagaccacagagtgacaggaaaaaaaatgcattgttgcattcaaacagaagataaatgtaagcaaccagatgctcacaaagcgcatacattaacacattgtgatttcaggactagcataacacattcatgtgcacatttgttcactgaaataccataacatttcaagttgaactgcaagtaatctgacagggcactacaactacattatgttaaggttccttcagaaagcatgaatttgcaattcaaaattaaacctactaccgattactgaaccctagattagcagcagcgatatccaagaaaaggatgaaaaccacactaatcacccacaaagtcagctacagaatcgaggagatgggttcttggactggacctgcgctgctcctgcaggggtgagccaagaaccgggcaccctcagctcctgcacgcggctgtcctcctcctccccgccgccgccgccgccgctcgcgcgaggtgccgggagaatccgtcgtggagaggaggccgagaatccggcgaggttgagccgggaagcgatgagaggttgcgcccttgaggtgggagaggcgcggccatgagcgtgagcgaggagaggggaaaggacggaggtggaagatgacattttttttcccttttcttttcgcaggtttgtgttgttcagatattctgcctctgatattttctccttttttttcaattttcattttcagatgttctggcttaggttttggctgtagttttccaaacttttctattcattctggttttatttgcttgaatttgtatgattcaaatggaaattatgtggattcccgcatttaggccatgcacttttctgttttcgtttgcacgtttcctaagctactatacgttttctaagctactacacgtcgcgtttcgtgcaaaagatactaccatataaatttttcacggaatacctctctaaagcaaatttttaactttgtagtagttaatttattcgcgtataccctcaaataactatctagattatccaaatccatcaatttcagctatctagccctcaaaaaagccaattttgtttcctccaacataatatttttctaattttcattcaatcagatgtgtggtggataggtggttgcttaccacaagattgtcatccacatcaaacacaaacccatgagttcaggagctgcatttcctgtccacaaatctaccattacatcatctcattcagattttcatagtttcagaccatgaaaacgctgtagcctgtaagcctcctcagagacccaagagggatgaaccagtgactcttgacaagttattagtattaatttttcttcagcagtatacagtacatgaaatggaagtggcacagaacaagtggtctcaattaatttccctcatgtagcctttggagtacaaaaccctaccttcaatgatcaaggaaagaataaatggggtagcaggaatgactgaacatacaatacagatagaatgcaaagttggccataaattttagaagaacgtattctctcccgaaacgcaattgcgagatcaaaacatagcagcagccctttggcgtttccgaaagggctgatgaattgaggtgcatggtttttatgcagccttctccagcacgagcttctcgatcaggtttgctgcatcttgaacagttgcgatgtcctgcgcacttgtttcgtcgacagtgatgttgaattcctcctcgaggcccatcacaatctcaacctacaaaggagatttggcatcactgtaattgcgccgtattatcggaaatgctgcttttgtttggctgacagggattaccgtatccagtgaatcagcaccgagttcagagaattttgattcaccagtgacagcagttccctcagggagtgccagctgtgtcttaactatgttgcaaaccttgtcgactgtctctttcttagcctgctcaacataatggtgaatatcaacagtattccaaattggttctcactgttttagtgttgtctaacctagcaaattattactagtttccaggaaaaatggtagaagatttgcgctctttatctgactaactagataacacacattgtccatgaaaactttagctacgtcaaagtgtctggttcgtatttatagagtggggttagccttgatgaatctaggcatcaagaaagcacttgatcaagtgcaaatgaactaggcgcctatgcatcaatagaacaataaaagaaccatgccaagaactcaagatgaactcctatttaattatctatttactgctgattcactagatattccaaaatctaaactagtttggaataggtaaacaattgctccagacacctatgaaggttcttgaagaacacatgtgcataacagaaaaatgtgcaaataaactcaatacattggtagaacaattgctaataggagaaaaccttagcataccgagcagcaaatcttaaaacgaagctgacttggccttgaacgaatggacataaaacttattctctggctgttgaaggaaactgagctccgtctcgaaattacattagtcacctgaaatgcacatcaacaaattgctggtgtaactggaatattcatatgcacagaagatgatgagggtactacagtggaaactggaaagtatgaacatatgacatcaaactaacaatttttactttgctcaaacaaatgctagttcgctcaaaacttttgagtgcttgaacacaagattgcaatgcgacaaatatacattcagaccctttggtaaacagattacttcaagttttttttctactggatgctcccactgtcctcacaaaaaaaaagtgctcctactggatgagcaataaaaaaggagagtagattggcaactaggctcatttgtgaatctaaatgctcgctaacctcactgacaagaagctggaaaacaataaaaaaattaacataattaagctctcaaagccaatatatctacagcacaaaacatgaattatcactgacttttgacattagccccctaggaagcaaccagcacttgtaaatctctggtgaacagaacttatctggtctacggttagaaataacttaacatggacaatacacaaggatgccaaacttttcaatcacctctggtttcacgtgttgaaacctaggtatacatgtggaatcccatgaagcaggacactccaggtccaccaagatgcacatgaaaatattagtctacacttgtaacaagaaaggaccgacttttctattcaactgatgcatcaacattgatgtggagaagccaagtgttgataaagaatattttttaaatttcagcaagatctaaagcatgtgctgccatttgctgtccttaagtggtttctcagagcttttacagtgtcttcccaactaggctgcattagaattcataaattttgtcttaaaataagtccaacgggggatccaatccagttacagtgcccgtgttactttaactatgacaatttcggaatctttgcagtttgcactaaaataaagaggaaatgtgagcaattgagctttttttccatgacgcttaacttccatcaatctcaatccaaggctaattaaccttgtagcttatgtaaagcatttgaacctgcacaattgtaaattgtaatcacacttgcgcgataacctactactaagcactgcctatgctatactgtttttgacatgtactaatcatagacagattccccacaataggaataatatatgacatgaaggataatactacaagttttgcaatctgcatcaagcagggaaggaacctatcaagaaatcgagtaatgctacccagagaaactaatccaatcggaagctgccactaaatcatcatcatccatacatcaagccaatccaagccaagaaccaatccaaaagaatgaaaccagttcaccacccctcaaaccctcatgaatcacagcctaaaactcaacaaatctgcagaacaaattgcaaacccccccccccccgggcaaaaaaaaaaaatcaagaaacagggcatacatatgatacaccaggcaagctgaagtactgaacgaaccccaagaaatcaaaaagcagctacaactaaaagaagtggtgggcttagcgcagggcacaaacctgtccgggcagtcgccggcgtgcggcgggcggcgagaaggacgaggcggcggcggcgagggagtgcgccatgggaggctgggctggcagcttagctgaggtaggggctttcttggctcgcgagctagctaccacgcagacgcagtagtggcattatagctcaggtaaggagataaatagattgaatagataataggatagaggagagaacacagtccaagaaagcggtagatgcagcttgcgttgcgttgcctccatcaacgaaaatggcaaaagatgaaaggaaattatgctattactagaacaggggtgaatagtcaaagtggtcctccaaatttcatctgaggctcagtttagttcttaatgtttcaatctatccatattaatccttcaagttttcattttagttcaaatttatccttgaattaacaactctatttataagagaacacttatacccataatcattcacatatataagagaaaaattacatgcttgattttttatagataatacatagtatattatgtaaaacaaaaaaaaattatgtactagcaagtgtacacgataacaattgcttaagtttcatgtgcacatgttgaaataatgagaagtacatctgtaatgtatttattcatgttgactttctcttttatagtatatagttgtatacaaattaagggcaaaaatgatattctttaatagaaatattgactaaaaatagccatatgacatattaaatgggcccaaggatgatttcaagccaaaacaaatatttggaggagctatgtggacaaaatgaaacgtgaaggaccaaattgagcctgaaagggtcaattaggcctagaaggggggtgaataggctaatttaaaacttaagaaatgtggaagcagtaattttcggagctaggctgggaattttcggaacttccgaaaatgcacagagcagcgcacacacaaaatgaaaactctagatctacaagactataacaggaaatacaaggcacaatcagcaactagaccaatagcggcacaagcaagcaaagttagaggagagggatgaagaaatttcaccaagatgtagctcccaaagttgttccccggagttcaaatccttgaggggattctactctctgttgaggagctcactaagagccgggtcttagctaaccctttcctcaagaggttgtattaagcactcctcctttcactaagaggtatctcttcccttgcgaaggcgagatccggccttcacaaacttctcccggccaaccacaagtagatcggtggctcgggagtgacacctagccgtctaggagtcctcaacctccaaaagtaaaagatgatgcaaagaactcccggagatgatgcaagtgctcacaaatcttcacaaagaccacaagaagcacccacacaagctcgaatccacactctcacacacacaccaaatccaaatcaaacacgggtggagagatgaatcgaggaagcaaggctcaaatgaacgagagagagagagagcaagccaagggcataaataattggaatggaaccagcagccctcacaagtaaggggaggtgggtatttatacccacagcacaaatctgcccgttggagtgcaacaaaagggattttcggaacttccgaaacaattttcggaacttccgaaaattccagatttgagaaaaattgaagtcaacgcccattttcggaacttccgaaaatacttctgaaagtacttccgaaaatttccagaacgcttctgtgtattttcggaacttccaaaaatttccagaacactccaaaagagaaaagcttcgaagaaaaattgattttgagcacacgcatcactccttatatgtctatgcatcatcccccttaatagtatggctttcctacgacacaatgcgaggaaaaagatacaatataccatttgatcattgccgcattgcatcgcgatgtcgcattcacgggatatgcattgtattacaacgtgttgaggacttaacaaccttcacatttgcttgaataaaaatgttagtcctctctaatcgcattgtaatcaatcatcaaaatcattaggagcctagatgcacttttagagccttcggtgaaacttgagggactaaattagctattcaccctactagaatactactagtagcttgttgctgccaggcaccgttcttttcggcaacttacataagtacaactattcattaggagaggtcacatcccacatttttttcagagagagactagaggacaagatcctgttaggacgggatacttaaagtgactcctcccctttctttcctctgtatagctgagcttgcacgtcttttctccttgtcttgctagccagatcaacagaaggaaagggaggaaacacattgaggaggggaaggaatgagaggatagaagatggcaacaagaggttcgttggccgggcacgacgacgatggcatgcgctccctcctcacacctggtacctatgggtgttctggctggtacctggtaccttggataccggctggtctctaggtatcagaccttggtacctgggtaccatgcctaatacttgtgggtatgagccatgattcctccctccttacacctggcacctataagtgttctggctggtacctgataccttgggtactagctagtacctaggtatcagaccttggtacctgggtaccaggcctgatacttgtgggtattagccatgatacctccctccttacacctggtacctatgagtgttctggctggtacctggtacattgggtattagctggtacctaggtatcagaccttggtacctgggtaccaggcctgatacttgtgggtatcagccatgattccctaaggtaccaggcatgatacttggtatcagccatgatacctcctgataccagtcaagaatgacttatttccatggtggccgcctcgtctccaacgtcgttgtcgctcccttctccctcttcacaaccttggctcccttctcctcttcctcctcctcctcctccgccaccacccccataaccggacgcttctctagggcgcccacgagaccaccacaaccacctccgtctcccccaccttcgccgggagagaccctcatgaccggggagtagggaggaaggtggaagatggagagaaagaatcggagagaaaggaggaggagaaacggatctgtggagaagaaatggatctcgggtgtatcccgtccccacgagattccgtccactagtttttctcttttttctaggttgttttttttaacggagggagtagttttcttgtttttattatcaaattactataccgtacattctatgtaatatatatatatatatatatatatatatatatatatattgcaaaaaattaaaatcatataaatataaaaatagaatgctctcgatatgtaggttccgtttttgtaaacatatctccaatccgcctagaggagagatgtcttttattttcagatttgctaaaaaaatccgcctagaggagaggtgccttttattttcagattttttgtcaaaaaaatagtcgattttgtgacagtacgatttacattaaggcgccgttacggagagtcgaatggagaccttcgaagtcgcagacagagctcctaaccaaccgagcacggtattggcattcactttattgccaaaacaaattaatattgaattttgaagtacttatacactaaccacacccccacttacattcacttacacaacacttacactataattacatatgtaatttattcacttacacggcacttatacaacacttacactataattacatatgtaatttaggaacttataatgtaaatacatgctgactattttttggtgaaaaatatggtgccataaatatagctactccctttattttttgtttttaagggggaatcggatatagagttggatttttttagagacagaatcggacatattcttttttttttattttcttcctttttacccggtgtcggattcgtacagatccgatttttttttcctttttttcgcccatttttttggtcggacaggtttaggttttttttttcatccgaatttttctggatcggatagatttggttttttcgccctttttaatcggacaggtttgttttttttcttttattccgcctggttttttttttgataattttggtttttttttcatcaggttttttttgacgatggaagcacctcttattttttaatagtgtatatatatatatatatgtatatatatatatatatatgtatatatatatatatatacacactatactacaccctgatacattataactaaaatactccccctcacatcctacccccaccccacccctaccctaccctatacctcggcggcaacgaggaggagaggcaatggcgtgaggcgcccggcgacggcgacgacgtgctatagggatctaatgggtcaggcggcaagaacgggcatgtccgtgttcgtgcgaggaggcggggacggtttcgctcccgttcacgcggttgtcgccggcattcgtccttccccgccggtactcccgttccgctcagccacggcttcgacctccaccgcccccaccgggcctccacctccggcgtcagcttcctttgcgcgccccaaggagctccaccgccactggttagccccgtatcccgtcacccatttcctcctcctattcctccgctctaggtggcgacggtcgccgccgccgccccccgtgcttccggcgccgtcactcgtttccgcttctgtcgtccacgctggtcgtcttcttcgactccgttacctgacccgcgaaatccagggagctctcgacgttggtggacgaaggaagccgatggtacccctccctgacaccggtggctgcgtgaagccgttgtcgtggctctccggcaccggatctggtggctcggtgtagaaactgaacggcggcggtgtcaagaatcggcagcggcgaggaggcgcttccaatggtgtggaatgaaatcctccaaatcgatcctggaagcggcgatggcaaaatcaatcttgctgtgcgctgttctatttcttttttgcctaagggaatatataaggttaacctcttctcttggtcaccgtgaatcagatttgctttgcatcagcagttagaaccgattaaatttgttttttccttcatttgagttgctatggttcttgtggtgttgaatcattcccatcgccaagatgtgaacctgcagggtaaagaaggatgagatctacagataacccacttaattaggtattagcctgaactgaaaattactactcctcatctgatgtatatggcgaacttactagacaatcaggcttttgaatgttacctgaccacacattgttactaacatgtgctaattttagtcagaaataaatattgaatgttcagctgttgctccctgattggtaccccaaggagagcccaagcctgtggggatggccggatgggcgctgcccacgccgccaaccttcctcacacatccacaggagcaggtacgcattgacctggtctttttttcccatgtattattgcctgcgggttgatgagttttcttattgactttgagccatacagacgcatgttatagattttgttaagactatttgaaatgctcgatgagctagttattagtattctggggttttggagctcccagactcatcatataatagaaagatgtgagctttgttcaacagagcaattttcctaagaagatttatcgcttcgggatgttggatagttctagttttcttattttgcatcttactttttgccaacgaacggtacacatcttcctcaaactatggagaattcattggatagctgtacgctgaaatttcctggttcaacataacaacagagtgatgatggggacataatgcattagttcccaacccatatatatttttggtgcctgcattgtcaggtttcaggcttggagatttgtccttctatttatatttttggtgcctgcaaacaaatataatgttacatggtagccgatttgttagcaatttacttatctgtcactgaatcagaaccatgagcttcttgagattgctaaacctgttacaatgaaagttctttttggttagatatgtagtgcacacgttaccggtgtccgcatccattgtctgctggaggtccttgtatatgctcttcatcgttggatccattcgcttcttgggtttcttcgtgccggttcttgttttcttggcattgctttgctcatggaggttcatgttttgttgatgcattgtcatggtggtggatgctgcatctcagccttttgcatgattaatttcagattgtgctttcctttctagtgcagtgctgctgctagcatcttacaaggtcattaaactgtatgatggggggattggttcaattaagtatctcgttgattctcagagttattttctatatggaaaaaaatatgtttgctttcttttatggcaaagcaattcacaacagcaatcttatggctatgaaatactaggtttaagtgaaatcatatttattttgctgatttgtgatacttagaagtaaccttcatttttttttttatccagatggctatgagaatgcctctccagagccgtggtgacagatatctgtcgacagggaggacttgagaatctgcagcacttcgtcggctcaacgttgatttgttttattggcgttgtcttgcttgttggattcgtgcatgcgtagatggatcattggccttgatctatattgtcgtattagtcttggcatcaatcttcatcaccgtatccttcagtggtgttgctgttgtgatttttttactggagctgttgtgatctttaattagttctgtttattctaccgatgtaccacattgcatgtgtgatcacatcattgatgtaataccgaaattaatttactcgatcaaaattttttaaatctaacttgtgagtaattaatttactgataggaggcgggctataagttatgtctacgcatagagtaattcatctactgacataagaccaccagaatcggaacggaattcttgctagattcaatatgttatgtctatagtaatttctttacataaaagccaaaaccaaagaggggaatggatcaatatgtttcgtcgacagtaatttctatacttagaagccaaaaccaccaaggaggggaataaaataaaccgggagtaatttctttacctagaagccaacacaaaggaggggaacaaaataaaccagaagtaatttattttactgaagaaaatttcgtggcagccaacaaaataaaaataaccatcaaaaataatttatttaccgaagaaaaattcatggcaatattaatatgttgattataagtaacagaaaattcgtggcaagattaatatgttgattagtaatttatttactaaaagggaagagaagcagtgggaataaaaaaaaaggtgggaacggaaggggtgggtggcggttggcggacgagagggaagtgggggtgggagcagacgagagggaggtggggtgggagtgccgaccgggggtggggtggggtaggttgtgaggggagcattttagttattacgcagcctgggtgcggtttagcgctgccccacatatatatatacatatatatatacatatatatatatatatacacacatatatatatacacatatatacatatacacatatatacatatacacatatacacatatatacatatacacatatatacatatatacatatatatatttatttatttatttcctcacgaaatcaaataattccacttcctaaatttataataactaatacccaattaatcattagtcatgtgttaattacctgtcttattttacatgcattaaaaactactctctccgtctcaatggttcatgtatccaacgtttcaccgtttgtattactttaaaaaaaatatgaaaaaaatttaaaaggtaaaatttgctacaggacatccaaaagatatgtaattagctgtgggatgctgcaaagatgtgaatttgctcgaagccactctaaaagtgcggtaatttgttacaggacactggacacattaaaatataatatcaactgaattgatgagagaggaaccacgtaaatgacagtcttgcccttatcttcttccccatctctcgggccattttcggcctccaccgcctgcaggtcgtccctgttgctgccttcccccaccgatcggcgatcaccgccgccacgggtattggtggctattaaatgccaattctatgccgtcaatacctgcataaacataaagaataaagcatccaacatattgattaggtttaattctaatatattccacgagtgttggtgtatatgcgcatgcaggtaataaaccaccgaagttgggatgaaaatcagacttaagtggaggtgaaatcctatcatacaacgagtgggccaaaaactacacaaaacttcaacaaatgggccttccactcgaataaatagataagggagcatgaggaggagcaacaagcatgaggaggagcaacaggccaaaaagtgggactgttgggccaggcctgggttaggtcgaaccactcccacagcagtctgatctggggcttggcagggatggtccagatgactccctaatggcggttggagggtagaatggatatttcgccttctcccaaccgtcataactgccctatataaagacttcacctcttcacttcacacacacacttcaagcttgagttgaattataagaggctctattgtactttattgtatactagattagggagagagtagagtagaagaagccggaggagttccggagctgtcggtaatcctcttcttatttcttttgctctgttaattactctgattttaatagaaatatcttttgagtaatttagttttgtttggtgagaattatctcttaggttagttcctaatcagcgcgtgcgatcattgttcactgtaatccagtaaaatatagtgattgctttagtgtgtagctaacattaaagtaagttattactccctctatcccaaaatataagacataaccactcataacacaaagaccaagaaaatatttaatcaccttcttggttggatcaccttaatgcatgcaagcaatgtgattgagaggtttgatgatataagatttaaaacaaatcaatgttataagaccaagagatgctagttaatgtatgcatgcatgcacgccttatattatgagacatgagagaaaaatggctgtgccttatattttgggatggagggagtaattgcttagatgcggtgtctaggtagttgatctctggtgtttgctccgtatcccacagtaggtgtgagatgggtgtagaggtggtgacagccctcaagatcactaaagtcctctctgtccggatacatagtagagcgatatctgagagcggtgagctggccagtgtctgaagtatcacgttaggattaaagttaagctttccgtagacactgtttctcaccggtgaatcctctctatcctttgcctatccttagctttgtgtctttggaagaacctggtgaagagctgacacacacgttcactgtggaaatcgatacctgagactactcccgggtgaagtgttacatcaatatttttcgtgcgcttgcggattttatctgtaaggttaagaaataccaacaacgggcactcctctacgtgccctccaccactaccttccgcactccttggcgagctccagctccaccctcgccatctccgttacgcgctccacatacgcccgcctactgcatctgcgtcagtagtagtagtagcagcagcagcagcagtagcaacagcagcagcacgacgagcgtcgctcgccgctggtccacgttctcgctcgactcagtcgccacctccatgccctcctcctccccgtcgcgctcgcaccacgtggctggcgtcgcctgggcgcccatccgctctgccgccgcgccgcttggcctgcgggacttcaccctcgttcgctgcctgggcgccggggatatcggaccgtctacctcctccgccttgatggggaacatggcagcagctcgctgtcgctgtcgacctgtcgtcgtgcgagtatgccatgaaggtggtggaccgttgccacactcgccaagaagggcaagctggagttctaccctggtggcgacctccactcgctctgccaccgcatgctcgatagccgcttccccgtcgcgccctccaggttttacgccgccaaggttctcttcgcgctcgagtatctgcacatgacggccaggtttaggtccagaggtatacaagcagggatggcctgtaggtggtggaggccgcgaatggcccgagagaacggggaagaagataagggcaaaacaatcattttatgtggtttctctctcatcaatttaatggatattatattttaatgcgtccaatgtattgcagcaaagtaccacacttttagagtttcctcggtcaaattctcattttgcaatatcccacagctaattacatatatttttttaatatcctatagcaaaatttgcatattcttataggtccaccaaggcagttaacccacacaccaggacagaagttagagaagaagtcaacgaaaggggaggaagaacaggaagggagcccggcccaagcgcacaataatagcccatccacgaatcgtaaccccgacccaaaaaaaaaaaatttcctcgctccgagaaagttcaggctagggcaaaagccggagggggatggcggcgggggagggggaggcaacgacttgccacaagagatcggcggcggggcaggaggaggaggaggagtcgaagaggccacgcgatggcagcgaggaggaggaagagctgctcaccgacctctcccgctaccgccgctactggacggatctgtggtccgacgtttccggcgacatcgccaaaagaagtgaggaagcttcttttttttttgttttgttttacagatgattttatggtaaatacgaattcgctcatgctcttgttaggtttttagttttcatctcaaatcgacatgctcgctcgctgattatggtaggcgggagcctggggtgcacaattgtgggggatggaaacatgaacatggaaaatgttgggattgctatttttcacatgaatttctatcaatgatataatggctcatctctttggtatgttgcaaaggaaaaagaaatggtaatgcttgactgattgatgtggtttattggatggatgcagctgagtttggtcccatgcggtacacggaggaaccggtgcccccgttcgcaaagctccaagatttactagaggttttttcttttgaggtgactgagctgaaaggtattctaagctggccaatagatgtgtttggcctcatctctgtccgtgactcgctggaccggaatcgcaactatatctttgagcgcaccaggaactactgccagactctcactgcaaaggtacctctatgcttcatggaaataacagcgcaaagtcatcagtcttttgacttttatacaggcagctagttagttttgcaatttcacaattgtggtgcactagtgcagtactttttcactgcactgcaatctagagatgtctgctgcagttccgttaagaaattggatgttacttaaacagattagaacagtccaaacttatatgcacatcatggttccatttcacaaattatatgtgatagtctggtactagttgtatcacagaagcatattagtaaacaacttgaaatattcaaatgctcatgatttagaatcatgtaatggcatttcttttttaccaaaggcaaaacataaaacctgtgataacataatcaagcaaattttccaatctcaaactcccctacacaccagagcttagcaaattctcatgatatataaggggcaccacaaacatgtgtgttgctaacagaaacaactacagaaacattcggtgtgcaggcgctgaattagtacttcaaaataaaaggctaccaaatcatcaattgatagcacatgcaagggcacttccccactctgatttaattcatagaaactagcgttttgccccatatgaacttgcagaggctatcttttcttgcaacatctgtgctccttgcttcagtttgtctgcaagaactgtattcttttgccaatcattcaagtaggatatttaaacacacccctcatgaatgcgtgaatggtaaagtgagggtcaagaactttcctatggtcaaaagagatgctactctctcggtagtacaactgtcctaactgcagcaagacgaatcatgcatggattcatctccttgcagtacagcttgagcctaagggaaaacattttgcaaatatttaagggtaattaacactgcgagaacacacctgaaaggttgtaagcaggtcacagtaacagcaagtgatcaattgtgtttcaggtttggcagacatataatatttgttatctcatagccatcttcgtttctttattgcaatagccatcatgttttaatgggattgttgaatattgaacattattaatgccaatttccaagagcctaaggagatgcaatggtgatccaccattgatgatagaaaggaaattctttgagatgttttagggtagaggaaaaaaggtagcaccaagagtacagtttacccaacaataaactacaatttgttgtgatattttgacatactatgaatattctttatgaaaagctcctgaaaaaaagtgttaataaataatgattgtattaatactacacttctgtgacaacagtgcaatattaatttgtgagtgctggtcattaaagattcaagcaataaagatgaagttgtcaatacatatattaaatattaatcgtagatcatatatatgcttattttcctatgccgtatcaatgtgttcttgagcaaagggaaaatagaaattccaagttgagttatgcatagcatgctgtcaggctcacatatgtttttctattcataattatatgctcatgtttttattttgttttgacagttcaaatgtgccattcatattgttttgttgagtggaacttaggacacagaacgcaatagagttatgcacgtttgttcaccttcagtctagctagtttcatcttatccaataaatttggaaatatttgctatgttacatcgttgctaccattcctttccaattgttttcatgcagagctaagtggtggattgcgcatcattactattattcttatatttagtaatgtcatcagtgtgtgtaggattcatctctggttctcactggtccaagccgtgcagtccaattgattgaccctgttgaatttgaaattgagctaagagtcaaggggacaagtccctccaaagataagatcttgagcgctgaagcatttgggtataactgcattgctcagagactcagatgtggctcactccgcagtatgatgttatcaggagcacgcagcacattggagttcaagtatgcacacattcctttggcattggaggctacaatcaaggtcaggattactaggggttcaactgatttctgtggaaagttcattgcacatactgctagtatcaaggaagatgtcatattgctggactctggagaagaaatggtggctatctcccatgatggagccattaatttctcccgcagtgtagttgcagttgaaggaaatggcggagttctgactgttggtgttcatgcaaggcagagtggtggtgagaatatgagatgttcttataaagagtttatcccggtaagatgtggacggagtcatgacacacttgatgttggattttgccagatgagcgttgaagttgcttggtcgctcatcttttaatattgaaaaaagtctaggccctgataatatttttcttgcatatgacaatacttaatattcggtattagtagtggaagtaatagatgtgctccgtggcattgtaatacactaatatgacagtactgagtttggaccgggggcctcacgatccatgccattgtaaatttgctactctatatcataaaaatgctattattattcacctatttgtagatagtaaccatgtcattacaattcttttgaaatatgagacgacattttctacactctaaacgtagttggtctcaaatataggccactgcattttttttatatcatccaaaatgcccttatgtacattaggtgggccctacacgtcatcccctccatctctcttggagcaaggagtcgttgttcaccttgttggtgacgccgtcgttttgctccctcgcatgtcgctgactcgctcgtcttgcgccattggcggctagctttcttgattcaaaagcgagtaagcaatcaaacttcgccgcaacaaagagctactccctccgtcccaaaatattgtcctctaggcaaaggatagcgacaaccttagttggatgagggaggacgcgcgtaggggcgcagcgtccacagcaactggcgatatggggcgtgctccgggcggcaatggacgtcgctggtgaggggcggagtcaaattcaaatttgaatcgggtatgtaaactttgacttataaactttgggtctataaa

SEQ ID NO: 14567 - DNA, 4411 bp, Oryza sativa
  unsure (1)..(4411): unsure at all n locations
ccaaaaaaggaaaccaggtggaggaggggggagggggcgcccaggggcgatcgatcgctccttagcatttccggagaccggtatggtatgtatgttaattagaggctatcacgttacaacagttaagacaatacggtctctaaccattaatataccaaaatactttattactagtcatctttcctttattagactcaatacaatgaaaaatttcctaataaatgctaagagttgactctatgccgttgttatgcgtaacaaccatatttctctttccttcttcctctctcttccacgtcaccaaatatgcttgcatgataataaagagagatcgctaataaagaccattgcacatgtcctaagaaatgtttgaatcaggttattttctaccattccattttttatttgcatgcattcatttctaaatgaagtacagtgaattacgttccatggatcatacaaaaaaaatcatgccccttaattatgttgaatcaattgctttccatgtacgcggatttagatgttttacctttttccgtgcgttgcaacgggaaagataagaaagtcgatgaaaaaatagagtgcagtcgacaaacggtgattggaacgaaagagggttagtcggctgatgacagtgagagacggtggcatgtcaaaccctagcgggatagaatgataggagggaacgcagattgtggaggcaagggttgcttaaatccatttgagattttgattatgtgtaatggtttatcgggacaaccatttgaaattacatcttagtagctgatggccatatttaatagttcatgacatatataaaaaataccattagagattctaccaggtaaagcttcggaaaatgtttcctcgactcattttctgggggtggctaatgggcgcgcgcgccggcaacgcgcgcaccagctggccccctcccccgagcgattttttttctttttctgttttcacgattttcttttttttttcgccttcccttttacgtattttctgattattttcttatcttcaacacacgtgttttcaaatgttttgacttgaaaatttttaaatctcgagttggaagtttttaaatctgaattgaaagttttcaaatctcgaattaaaattttcaaatctcgagttggaagttttcaaattctgagttggaagttttgaaattttgaattgaaagttttcaaatttaagttgaaagttttcaattctgggttgaaagtttttcaaatttgagatgaaaagttgaaagttttcaaaatttgactttaaaaagttcaaatttcgagttaaagtttttcaaaatttgactccacatatagatttcttttcaagatgttaaacaaaagctatccgaaaaaaaaatcttatgttaattgtcggtattatctctaactaacaggattagttggtacgtttctctgagaaaaaagtccggccgcgtgcgcgttggcagcgcatacgcgcggggtagcttttccgtcattttcttctatcggcgtgtgcccacatctcgtacctatatctgttgctccagtgtggttagtgtataggcggatctccgtttcgctagatctagtcaagctcaggtctacccgatccagctcgttgaggcagcggtagatttagtgatttaccgcacggctaccctaagcagctccccgggctcccaagcctacagctatcgagttgttcctttgtaagctggtgattttgcatgcaacgccacaccaaaccccaagccaggcaatgacggtcacgagtatcgccgggagtcatggaccttgcaatgcaacacacaagtacaccacatcagcacacctcttgacttggtgctagtttaaaaaaaatgtagacgagcgaagcagaggtgttcgactctagatgaggtctggttgtcaaatctctctctttttaattttttattctactaaaaaaatatctgtacgttgcaacgggtgaaatctattttaatattattattgttaaatggtttagttaagatgaaatttactgtgggagttcgcttggatatatatatattttttagaaaatcatgagctgcagttaggagtccgatcatctcaagttagtatgcgagtttttttaaacagatttcttatatgattccttctgtattatcaaaagtgaacgatattaaaaaccgattcaaatacggatatttatttccaaagcaaacgaacttaaaaactgactcatacacggatgacgtaccaaaataccggtaaaaacatatttaatttttataatagtagagatagagatataagtgacgagttccatggtatgcccgattgagattagtcatctgtgatgggtactataactaatctcgtttgactcatatgctgagccaaacctatctatgacgggccttatacttagtccgattgagataactatcatccgtgccggtcaaatgcccgattgagataacatctcacatcaatgatctttgcttagtgacggtagctcttcctggcactgattgagacctatcccatgctagtgaatccagtggctaacagaaggtcgcatcacaatcgaacctctgcgtcgtgactctgtggccgcgggataagcagcagtcagtcacctccccatcgcagaaggctgctattgatccgatctgatttatcaaaaaatcggagagaaagattttttttttctgaaacaagatggcatcgagtaatgaactgcaggggaaaagttgatgtttcacatgaactgtaccataaaaacagttttgcaaccaaacaagactaaaatttgctcaacaattaactcaccgtacaacaaaatcgcgatcagttccttcaagtaaacaagctcacagccattgcgtacaaggatgaagcagcatgctcaccggaggtcatggactcctaccagggccgatgcagccacctggcctcgtcctcctcatccaatcacgaaaagagaccgtgcgattaatgaagcaaatctgggcgttattatgtggaggcagtgagacgcaagagatccgttcgaatggagaaagaggagacgaagagatcgagtcggagaagcgtgggacgggacggacaggtcaggacgaggtgaagctgacggatcaacgtgcacgcctaccgaccggccgaaccgacgaaacaccaaactcctgaattctgatccgatttggacacacaatgactgacgaaaaactacgacaaaaacatcttaaacttttataatagataaagataaagatcttttatctatatatagatatttatttactatactaaaatgcatgctttcaatttgtcttttacctatcataaaccttagttacgagaacaatttctactcgtgtttgttgttcatcgttaagcttgcctaggttctagatccaccgctgcactgaggtatttattgatggagcttccataccgactacttaagattatagatggtgatatggcctgaggctcacgggccggcccgaagctcacaattttggcccggcccaagaacagcacggcccgactgggatcatgcccgtgccagcccggcccgatcaaagaaaaaaaatatagagatgcaaaatagacttaaataattatatagggaaaggcccaagacaagaagtatacaaaatagacttattttccagccatttaaacacagcccacggagttgaggaatcaaaaatagactttttctgtaaagaagcacgatgaaccatcgtgccttcaggccagcccagcacggcccgagtagtattgggccgtacctaggccgtgtacgccacccatgggctggcacggctcggcctggtgtgttggttgggccgtgccggcccgacaagcctcggcctaggcactgtcgggcttgggccgtgccgtgccgagcaacccacatggccatctatacgtaagatcagtcaatgcttccaactctatataaagcagttgtggcgaactctacatgggaaggtatattaaaaaccaaatagctctcaaacccctagttgggagtatccaaaagatatcgggctcaaaaatcatctccatctctaagaatatccaatacttgattaaaaaaactttaaaatctgtcatgtcatcactggttggccctactaaactgatttttctcgagtgcgtgcaggtgtccaaaactagctactatttggttggattttagatgtacctaaatattggggggcctcatttggaaacctgttggagggttgattttacccttaattcttaaaatttaacttttagggacaagattctcttggagatgctctttaccaatatcggctgtttatatcggttcaatttnnnnnnnnnnnnnnnnnnnnnnnnnnnnnnnnnnnnnnnnnnnnnnnnnnnnnnnnnnnnnnnnn

SEQ ID NO: 14568 - DNA, 18618 bp, Oryza sativa
  unsure (1)..(18618): unsure at all n locations
gcttgcttgctcccagggcgtgctcggatcagtgctcccgtatacgtggcacaatcctagcgtttccctgttttttttctcttgagtaaagtgtacgcgcggtccttaaacttatatgggtatgtcatctagatcgctaaactctcaaaatacatatccaagtcccagaacctatcatagtgtgtcatctaggtcccaaatcgccacaaccccttcaggatcctatgtggcgttgatgtggcatgccacacggacatgatatggcattattttgactgataaatgggacccatttaatttttttcctttttctttttttcttctctttttttccctttcttctcctttctctgtgacccgtgcagaaaaaaagaaaaaaaaagaagaatgagaagaaaacgaaaaagaaaagaagaaaaaaaaaggacacgtcacgtctatgtggcattgccacatcagcgccacgtaggatcctagaggggatgtgtcaatttgggatctaaatgatacactttgacaagtactaggacttggatatgcattttgagagtttagggacctatatgacacaaccctacaagtttaagaaaaccgaaaaaaaacggcatttaacactccaccgcttacagctacttcctcttttagatttctttatcctgtggcagcagtggtgaagggtagctggctgccggcgcccagaaaccggcgagcagagccggcgtggtggggcggcagcgagggatgagcaggaggaagctgcagagcgacgagtggtggcgcatccacgcgcggccgtgctggtacgggctgagcgatgggtatcgccgggtagtggctgaagacatcgttgctgataggtctgaaagggagcagtacaccaggatgtgcaagaacctatcaaacaacacttcgaagctctaaggtaacatctatgtattgtagaatttcctaagtaaatgaccgcaatcaagcaggggtccttagcagcatgatttgatctaaaacaactgagccttttcaattagcactatatattggtttctgacaataagatctgattgcattgcaggtttcaacttcagagtttacaacccacactctgctccacatttcatttctatcatgggagatgtcaaataattgttgtaatgatttgagaagacaagtagagaataaataaatgagtagccgaacattattcatgtactctgtagttgaatccatcaggagagaaagatatttttctcataaacagggttgatcggaagttaaaaatcaataatgacaaagaacatgagcatctatgtttaccttttgggtttctgctggatcatttatagtctcatccattgcttttaaattttggtgtggatattggtggcttgatggtgtataatcatgtggagatgtgcgggagaaatttgccgggggtgatgcttctgttggcgcgaactggaaataattttcccaccaaaacactgtgatatattgttaattacttgccgttaatgatgggattcacctgatatggttgtgggccaaggagaaaaagcagggaaacactaggattgtgccacgtatacgggagcaccgatgggagcacgacctgggagcaggcaagccgcgtcccatacgacacaagtactccgtatctgacaaggctggcgtgccgaaacgaaacaaaacaggttaaaggcgagtttatatataggaaaatactttacgtcgagcgaccggcgcgagggagccagatcggacgctcctccgcgcgcccctccccccacgtgtgtactgttgggccacccacttctctctccctttttttcacaaaagatgtttcacctagtgtacttataatgtttcactatttatagatctaatgttacagttaattaaaatactcttttgcaataaaaaacccacatattttggaaactctctataagggaatttggtttattttttgttccaccaaaaatgttttacctagtgtactcacaatgttttactatgtacagatctaatgttgcagtgaacgaaacatttcattgtaaaaaaaactcacatattttggaaaccctctattaagagaatttggtttattttttgttccaccgaaaaatatttcacctagtgtattcacaatgtttcactatgtatagatctaatgttgcagtgaactgaaacattctttcgctatttgctgaaacattgtttttatataaggtgaaacaatacccgatttaaacgagtgaaacattttcgatctacttagtgaaacaattccgatatatctggtggaacatcgtgcaacatttaaaaataattcaataataagctaattttttcgtcggaatatatccatatgtgatcttgttttgaagatttaattgcaacaaatttaatgatgcaatcggatcatgatttggataagtaatttaagagaaaaatcagtttaaagtagttttacatgtaaatcggacgctgacgtcagcgcccggttttaccccctccggattgggcgcccgaccgggagtcgtctccttttatatatatatatatatatatatatatatatatatatatatatatatatatatatatatatatatatatatatatatatatatatatatatatatatatatatatatatatatatagggaatcgtagatggattcggattgcgtaccaaaattcagacaaaaacatgtttaatttttataatagcaaagatagagatatagatatatataccatcggtcggttttctaaaatttagaattgagattagatgcttacgtacgtgccttgccgttagtcgttacaccgccggtagtgttgccggattccacccggacagaaaaacagcgatcaacccactattaaaaactagtaatttgcccgtgctaatgctacggtgatatttaatatgtctccccagacaaagtaattaaaaaattgtatatttttaaatttttgccaaagggagtagtaaatctagatggagcaattaatcgcatcttacgtatatgcaaaaaaggtaaattgtgaatatttgcaaatataccaatattataacgtgaattgtctcatttcttctccaaaaggaaacatctaatatatttttttatccacaaattgcatatacaaatacatcccgtcaatctcaaattcctctccataaatttatcatcataacttcaacgcttaacgacctacaactctctgtccatatctctatgtcacagacccccatataacccatcaacatattttcctggaggatatggacaactcccataactcattacccaagaagtgcacctaggtgacacgcatactgttatcctaggattgttgcagcaacatatttcataataacacagtaaatttcaatacatctatgcaacctcatttagcaggctcaccttttatactattataaaaaatattaatatttaacattacattacttattgacatgtttacacaattgtaaaataaatttaaaagcaaagtacaatacaaccatgcatttcacatcactgcacaaaattcttaatgagaaaatcgcacgagaaagcaattgtaataaaaaagcacaaaaaggcatattattcattattggaccatttgcttaggtgaacagtttggtgccatacaaatgtgctcccggcaatatgaaaaagtttggcacaatataattaaagagttacaactttttgaagagaatagaagaaaactcaaacaaccctcatggaatactgcctattcctcttttcgtccagtgccgcagttcctaattattcaattgaaccaccatccacgcaagagtactaatggcctcagcaaacaatgggagactgcaagcaaatcaagaagatagtacacctggtcactgcacaaatgctatttgctcaaaaacagagggctaaaagaatcagtcatatattcagtctaatttatatggtagcaccaaaaatgaaatatatagtacatagatatactgcttatagacgtgcaataatctagaccaaagctacatgacagatttggcactctcttggatctgatctaatatctctgcacaaaaaaattaatatgcaattgatgataattgatgtcaaaaagtggaaaactttcatcatacctctgatgcagtcccatttggcttgctcgatctggtttcagaaagactcaatttcatgattaaacaaaaaataatagctaacacttatgtctcttttcatcaccatgatgcatgggtgtttttatagtttattggagcaacttatctgttttacatggatgtagattgtattcttacttcaagttgcatttagttgcctagaacaaccgagtagctactgtagtgtttttcagaataatattaaacagttaaatagtaagaccatgtactttgtttttcgtggagtaagagcatgaactaacctatattgataatatgaccaggaaagaagagtaaatgagcagcttatgtgtaccattgacagttacttaaggcacattctttctcatacctaaatattgcttgctactaaacagatgaaaataagcatgtccagaaaaagaagcaaaaccacagggattacctcatacctgagttcataatctccctcactggtgaactggagaggcacaagcatttgtaaaagagaaggaaaggtcataggagccttctagcaaggtttgttgtacaggcctatcagtagatggcatcagattaatcaggccttcacacaattatgcagaaacatatagaaataattaaatgaaatggcaacctcgttacttccaagactccagccatttcttcttctccttacccagatcagatcagatcagctgaagagagcaaattaaagagaaaaagaagaaagtaggcagcctacctagatgacagttgtgttcaggaggagagggttgatatttgagaagcacaatccatcacaatatacattttaaaatcaattttctattcaactgaaactgatggttgaacttggacttgaacttgcaccacaaatatacaacagaattcagaaatatatacaatcttacccagctatgcacttggagttgaaacagatggttgtggtggtggttgtggggatcatgcgtcttggaattcaaattgcaatcgttttccttaaaataaatgtgataaaaatatttacactgcgacaattgcttacagattttcctgcaaaattgtagaaggatatgcaatcgggaaaagttaaagagacctacaaagctaacctaaagtaatgtaaatctttgttggtcatgagggaggcatcatgagggagacattgcaattaacattcctctagcagaaaatgcaagttaactgcactttttgtaaatcttctctaacgaagaaaataacttgagctattatcttccttcagaaaacttatcgcatatagcttgacctatgaacatcatatacatcaaaggctacatgtgtttctcatttctgtgtaaatctaatgacagatagtcaaacattcaagctagatctatccactgattccttcacatctgcacaaaaattcaaatatccaaaataaaaaaatacctgctggcgtgctgcagcctgcatagaggtctgctggtggcaattacttgaagggttgtgggcatacaggaggggaagaacactaaggaaacccagacgttcagattctgcatcaggttaagccaaaagaaagttaagttatgcacttctgttctgtttttctctagactttgctacaaatttagaaaggtattacattatttaacgacataaggacataagtgaatatctggatatgaataactgaatcagtttgtctaatgacatggagacatagttcagaaactcaggtaataacaccaagtagagtgcggtcctaggtggtcacacttaattgattcctccatagtatataaatggatctgagtttctaaattacaatcaagggtaggatgttggtaatttgaatagttcagctgcaagtgagactgtcagttctagtggcagtaacaaatggatctttgatccaagtattattgagctcaaatttactgaccatgaaatcgtcaataaccagatccttcatttggatattcataagcttccacaatccattgaatcctctagatccaggttctgtaaataaacatgatagagatatcaaatgggtgcatcacggcatctagtgctgtaagatgaactgatgcatattaacaaatgcaaaaaaaaaaaaaacatgcagagcagtccatctagttttgcgagaaagattcccaaggtaaaattgtactctgcacatattatgaagcaaatgtatcataaactatggcatacaaattttctttgcttatgcacatattgtgaagcaaatgtatcataaactatggcatataaatttttttttgctgaaattcttttgagtgcacgataatagaacattatatgactttcttttttcccagattcatttttaagagatttaattctagacatccagctgcagcactacagttaccacaaatcaccatgcgtaatagatgcatactgcaagctaactgagcgaggtacaatacaagttgatagagaaaatcattttggtgctctgaattcgctagcatgttcctttttaaagaaagaaccggttctgctctagttgacgaggatgagataaagaattaaccaactaaccacaacaattctcacagagattgaaatgatcagccaagcaaacgaagacgatctcaacccatgcctaaagatcaaacggaatacattggaatcagattagggtttctccccacaccaaatccctcaacgatcttgcccaagcaaaacaaaagatcaaacataatacattggcatcatattagggtttctccccgcaccaaatccctcaacgatcttgcccaccccgatctacaccggagttgccgcacgccgccgctggccggcgtacgggcggcggactggacggcggtggcgacaatggttgagcggcggaaggagaggggaggcgcatagtttgttggaggctaagggcggccgatctcgaccggcgtgcagcggcggactggacagcgatggcgacgatggtcgagcggccaaaggagaggggagcgcaacggcgtgagcggccgagacgacgcgcttgatgacgtctccatggtgttccggcgatgatggatcggcagcggcgccggcaggttgaggcggcggccgctgcggcgaaatagggttaggggagggggggagcggcgtgagaggaggaaaaaagcgtcgggggtgcggcggcggcgtgattagtgggcgcaggtgtgagggaacagggaggcgaaggcgacggcgcatgctatgcgggagcgattctggacgttggatatgagtgagataatcccaattccttctagatacacgattcccggcgcccgccgcacacggcctacaggtcccacacacggacgtcacgcgatgccgcgatctcatccgatgattttctctgatcacgcgatcacagagccgcgccgccgccggcccacgccacgcgcgagcgcctgcgcgacccggcgcccccatgccgcacgcccagtcccacgccgccacgcgcgacccggcgtcaccggtcatccacaagcttcatcgcaacaacatcatcatcggtcgcccatgagattcgttgttgctgctaccgcttgtctgcgaggttcttcgccgccaccggtggtcgtcggcgtggttcatgggtaatttagtgcaatctattcttatatatgactcgtactaattaagttttaccattttgcaggttaaaaaaagactaggcacatgagttctctgcttttagagacctttggtctataagcctcctgatgtcttgattcatctaatggtggttttcactgtcacatatgagcatgatgatccaatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcctaaggagctcctgatcattgtagtacagctaaaaacgtactgcagagaaaccgaaaacgggaggagaaaaaaacagcaagtacgagaagggaggttcccccacttgagtaagtgacattggattaggccgatccttctccctcacaagagacattgctgaaagtacaggaagtaaaagttcatcctctccctccaaagactgttctgatccatcaagctacgttgacagttagattgttcgggcttgcagaagtaagtgttgcctgtagatcttctttgtactggctagttgttgagtgcttacttgcagtcactgcagttgcggctccggcgcatgctgttgcaggccagcaaacgcctcttctctgtaaaggatgagcagcaactcaccatctggttcacccgcgacaagatttgcatcatagatgtcgatcgggtgaagcttgtcaagctcttcctgaagatatccttcaataccatcatgctcccgtctccagcagtgtaatgcgaatgcagatatcaggctccagctcgtgattctctttcttgtaatgaggcttgtgatggttccattcacatataggtccatttggtgatagacaagtgctctgactgatctcaggcgtgcggcttcacaaaacatcactgctaagcgcgcaattgctttcctttggacatgaataagtgggtggtcgcgcggaagaccattgttgaagttcagtagtctgtagtatgaatcaagtacagacggtggccccactgtaacctcatccctgcaaaattgcaatgtttcaagtcattactaacttcttatagatcagaaacaaagacattataacaattttcatgtacaaagtacaagtttttcttggggcggtagccgcggtattcccaagtcattcgaggccatctgttctagaagaaccaatggttgagtatagtaggtagtaatatatgtcatcacttactaaaggataattaaacgttttgacagaatatccgtaggaaataaatgctaaattattatttcatttattaactgcccttactacagaatattctgactgaccatatctttaggaagatgagctttgatcttttacagatattcccttaaaacaaatgtacgcatcaaacattaagaaccgaataatattttggagaattaaatgtagtagaacataaattttgtgaatcttaaacatccaaataatttagaatattagaatataaaaatcagaaagaccccaatgaacttaatgtcgaacctagaggaaaaattgataatgcaaacttgaattttcaacactctcagtgtaaatttaaaatcatgacgaatcaaattcaatatttgaaagcaaaggtttgtatttttctatttctgttatatcaatgcacatatatattcttaaacttcggtttgataattcgatatttgatcttgaatgtgctttattatcattacttgtgtcaatccaatcctgatgcaaaattaatagaatcatttgtggaacggtagagagctagtagaattggtccaatgcacacttttatttatcaggatacatgtacagtgactaactagagctacacacagagagggaacgtaccataagaattaataggacgatatgcacacacgttcacaggtttgctaacatcatttatcatgttgcttcttttttttagctcaaaccacagcccctgtgaataacacactaaacacgattacaattttgtttaccagttgtccgcccctatagagtgttaagattaacctaaagtattgcctcttgaagggtaaaaggagcaacttgaaacaacttaaaagtacagctaggaaagctacacttaccagtcctgcagaaggtgaccatagtctgctttcaggtataagataggttgggcatcgagaatgtctggaggggtttctgcgtcagagaagttgaaccactgaccagctccatctctgatggcactcaaatatgcgtttctttggtcaatgagtatctgaatgttagaatttcaatggttactctaattgagaagaggatggcactcagagtagggcaattttctagttttttttattcacaaactcaaaagccatacctacccgagggaggttggatacatatatatagccatagctggctgctagcctattgttgcaccctcctagtctaaaattcgaaatttgaatgggatgctgtcctagagggcatccaaactgaataaagcataaaggaggcataaaggaaatgctaactgctgctatcctactaaccgcagctgtcctagcaactgagaaatatgctaaaggggtagatgctgtcctgaaaaggtgaaactacccaaaagcaaaaagaagaatcacgaccaaggaccacaaagacttatccatcattctccccctaagtcttgtgcgtcgtcttgtggggaagttgggccatcccgatcctggagtagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagagccagagcggacttgctatccaccctgagctccaccgctccagtatctttgccgaggagatcactaagtagtcgagtaagccagagcgcctgggtcgaagcggcagaggctgccatgtactcggcctcgcagctgtacagggccaccacctgctgcttgaccgactgccagctaacgaggcactcgccgaggaagaagagaatcccgctcgtgctcttgctggtgtcgatgtcgccggcgtggtcgctgtcgctgtacccgacgaagtgtgccttgccaggacatctcgggtagtagagaccgtggtcgagagtccccgcaacgtagcggatgatcctcttcacagcctgctggtgctccgctgtcggtcgctgcatggaccaactgacgtagccgacggagaaggccaagtccggccgtgtgtgggtgaggtagcgaaggctccccacaagacgctggtactgtgtagcatccacttcctccgtcgtgctatcacggctcagcttcagtctctcctccaccggagtgagagctgggttgcaatcggtgagcccagccagctcaacgacgcgcttggtgtaggcggtctgtcgaagcgtgttcccggagacatccgggtgcacctcaatccctaggtagaaagagagaggccccagatcactcatctggaaggtagccttcatctcctccttgaacgccgcgacctccgtatccttggtgccggtgattaccaagtcgtcgacatagacacccaccagcaaggcatttcctccattgccccgccggtagatggccgcctcgtgcgggctttgctcaaagcccatccccttgagcgtggacaaccatgtgatggacgccccaaccttcctgagcagccagcgcaagaaggagtcgcacggactccatccgtgccacgggagcgaaggcatcgtcgtagtcgatccactcctgctgcacaaaaccgcgtgccaccaagcgagccttgtgcttgacaatggctccggcttcatccctctacagcttgaacacccacttaagggtgatcgtgcggtgaccacgagggaggtcagcaagctcccaggtgcggttctcctgaaccgcgtccatctccgactgcatcgcggcacgccatgccgcatgtttctcggcctctgcgaaagaccgaggctcaccatcaccgcacgcaaggtgcaactgcgcctccaggtcgcgaggcactagtcccggcaccggctggtcgccgagaagatcctccatcgtacggtaccgtaactgctcgccgtcgtggtacgcgtcaatgcgctccccgtcgtgggagagcggagtagcgaactccaccgggctgcgctcaacacgagctggcgtcggagtagacgtgctcagaggagtggctgttggtgctggggcgcgtcgggtcgccggctgtggtggtgtcggcgaagagctcgtcgcagtcgaagtcgtggcccgagggtgtgttggtgtcggagttggtggaggctcggggactggggtagacacgctcggtgaagaagagctgcctactcccccagctccctcgaagtggacgtactcgacggtgaagtcgtcgtacgtcggagtcgaaccatcgtccaccgccttgtcccatacccaccctcgcccttcgtcgaacactacgtcgcgcgctgtgcgcacacgctgtgtctccgggtcgaggatgtgataggccttcgagccctccgcgtagccgatgaacacccctagggtgctcctgtcgtcgagcttgccgatgtggccaagctccttgacgaacgggatgcagccgaagacccgcaggtgggagacccccggcttgcgcccataccaagcctcgtacagtgtcctgccatcgagggccttggtaggcgagcggttgaggatgtagatggccgtcaccactgcctctccccagaagatggccggcatccccctctgcttgaggagagcccgagccatccccacaaccgtctggttgcgccgctcgacgacgccgttctgctgcgggctgtacggcgcggtgtagtggcgccaaatgccctcatcaacgcagtacgacgtgaattcagccgccgtgaattcgccgccgttgtcggtgcgcagcacgcgcagcttgcggccgcactccgcctctgcagtagcctgcgcgcgccggatggcgtccgcagcctctcccttgctgccgaggaccatcacccacatttagcgggagaggtcgtcgacgagcagcaggaagtaacgtcgtcctcctggtgtggccggtgtcactaggccacacaagtccccgtgcacgagctcgagccgctccttggctcggaaactcatttgctggggaaaggggagccgcctctacttcgttaggacgcagacgtcgtagagctgctccacgtggtcaaggcatggcaggcctcgcaccatctccttggcgctgagccgcttcagggcctcaaagtggaggtgcccgaaacgctcgtgccactgccacgcctcgtcgtcccgacgagcggtaaggcaaactggttgtgcgacctgcgcgctgaggatgtatagtcgattagtgcctctggttaccttggcaagaaggcgatggcggcgatcccaaatcctcatgagtccgtgctcgaccaacacgcatgagccgttctcatccagctgtcccacgctgatgatagagtttctcaacgcggggatgtagtagactccggtgagcagcatgtgctcaccggacttggcggtgaaggtgacggagccgacacccttgatctccacgccagaggcatccccaaacttgacagagcctcggacgctggagtcatgtgatgggtggcgccggtgtcgaggtaccacccatcagccttgtcgttgctggagctgttgccgaggaaggcgtgtactttcggctcctagaggtggaggaaagctgttgcggccggtgccgctgaagatagctcgatgctggcgtgtgccaggagtagagtcggctcttcctcctccacctgtgcgatgtgggcctggccagagtcgacctgcaggcatgcacgcgtcgtggctgtcgacagtctttggcccaatggccaagcttgccacagttgcggcaggcgtcgtctcgtgccggcttgtggttgctagcggcgccgccctgggcgcctctgcgagcgccaccctcggcgtgtcttcgcgtccaccgcagctggacgcctccgcgcgccttgcgcggcttgcggcccctctcgagggagaggactcccccttcttcccatcaccctggctggcctcccactgctcccgagtgagatggagcttcccgccaatggtgataggccccgagagaggctgtggctcatcgccgtcgacgaccttgaggcgacctaacgcctcctcgatcgacatcgtggagaggtctagcagagactcaatcgagcgagcgatctgcctgtacttctctgggacgcagcgaaagagcttctcaacagctctctcctcgtcgtaggtgtcgtcgccgtactgcaccatcttctgcaaaagagtgttgagacggagggcaaagtcatcaacatcctcacctggcttgaaggctaggttctcccactccttgcggagtgcctgcagtgtggacttgcaggcgcggtcactgccgatgtgtgccacagcgatggcgtcccaggcctccttggcagtccgcttctgggaaagcgagaactgcatctcgggcgggactgcagtgatgagggcatccagcgcccgtcgatcctcgtcgtagtcgacgtcgccgtaccgaactgcctcccacatgtgccgcacctggacctggttttggtgaggggccacccaccgccaggaccaaagtccctgaccaccgtctggacgccgtggtgaccatggcgccggtcagggaagggagaattgcgctgcctgggagggccgcgcgcgggctccgggctgccgccggcacgcccgcgcccgtctgggttcccgtcggagggcgcgcggtcccttgggccgccgccgccgccgtggaggtgggctactgcccaccgctctgcccgctccccgtgtccttcctcttgccagctcctcaagctccctgtcggtggtgatgttgccggcgatggagccgttgatgctgctgcgcaaggtctcaacctctacctccgccacacgtgccgcatcttccgccgcctctgcttccgcctccgccctggctgctgccaactccgctgctgccagtctggccgccctcgctgctgctgcaacggtctgagccgttgctcgcctgcgctcttctgctgcggcgagctcggcgtcctgctgacgccgagtgctcgaggcgaccgaacgccgagaccgaacgtcgaacatggcgcacctccggggggctgctgcgtggagaggaggaagggaaaggggaaggaggagtagccggtgctgctgctgctgctggctgagagctcaaccgagcttgggaaggagtggaacaagagatgtttagcctacaggaaagtgtggttctgataccagatgttagaatttcaatggttactctcattgagaagagaatggcactcagagtgggacaattttctggttttcttcattcacaaactcaaaagccatacctacctgagggaggttggatacatatatatagccatagctggctgctagcctattgttgcaccctcctagtctaaaattcaaaatttgaatgggatgctgtcctagagggcatccaaactgaataaagcataaaggaggcataaaggagatgctaactgctactgtcctactaaccgcagctgtcctagcaactgaaaaatatgctaaaggggtagatgctatcctaaaaaggtgaaactatccaaaagcaaaaagaagaatcacgaccaaggaccacaaagacttatccatcactgaacagatggttcctcaggcatgtcaagagatattatgtgccacccctcctcattgcttgttataggaacattcctgaaatcgtgatgtgctctctgctgaaaaagttgtccaatatcgtccatgaggtcattgtagttctgactggacaaatcaaccacgttgatgttgagaactggtatttcctgcaagaagaaggatccatccagtgcatgagcaactgtaaggatattcagtttctgcacttgcacttgttcaaaagtcaaaacaatgtcatttcatttcaattaatacttcaatctttatgtgcactttgggaaaatgtgatacagtttagctacagtgaatagaaccagaaattgtttcacaacaaaatattgcagaactggctggctccccaagaggttggcctgtgcagcaattctttcggtctacaattaaatagaaagcagggctcttgcctttcttaagaagaaaaaaaaagtgcatacgtcaatagaagacacagagtatcattcacatgtgctacttatcatctgttttattctcagtgatgtatctaaacttattttttgttttggagattctcggaacaatgaatcatgcaacttcatttagttttagcaaaggatttcatgttgagctgcacatttggatatgttaagggcttgttcgcttagttcatatgacgaagagattggagaggattgagagggtattaaactattaattccacactcaataggtttgtggaattaatcatctccaaatctcctttaattcccatggggagggattgaccgagctagcaagttaagaaaactatggattaattttcttttccaaaaaacaaattttacttacaatttttagtaacataaagtctctaattattattctcatcatgatattttaagacaaatacgcttgttatagcatggaaaatgctaaagtacacgtattaaacaccatttaacacatttgctctcgataaaagaagttaacaaggttacatacttccattttgagaaatgcccaggagtcttccggctagctccacaaggtggtgggctagacgacctgggtacaaagcctcacccctcctaattatttgatattaggtccttccctaatattctagtttttttttttacatacttccattctgagcagcttagacgcgtcctctcttcacctgcaaaatagagtcatttgtgattcaaatgaacatttttaagcaaacaaatggtacatttttttaaaaaaagagtaatagtgatgttatttatttctttatctttatatatcatgtatctttatgcaaaccaataaataaatcaagcgaacttcgctggttttaacaaaccggttggtctttcctgataagtagggataggagagtgtcctatgctgaaaaatggactccttcatcagttttgaaggacggttttgctaatatggtgatgttgacatgatctttatcccatgtagcgcttatgtgatattagaattaaaaaatatatgtgagattcatttgtcattcacatacaaaaatatatattgtgggactcactgacatatggggcccacgtatcatcatctctctctcaaacccttcttccacctccctctctcccttatctctctattttctttcccccttcggtcttggcgatgacaggcaggacgacgctggcgagcggacgagggccaaagcagcggcggcggggagctgattcccatccctttccttggcttcccagaaaccctaatccatgcgccgcatttcgcctctccctgcgcaagaccgcatcacatgccgccgacatctactcacattgctcatagattactgcccgcgctagccatgggacatgtcgggaactcaaggttggctgcactcgagggcggggaacgggtaatccgtgcgctagagctggcgccacacctaggtcgtcctgcaaaaaggaggggagcacaagcaccaagagaggagaagcaccaccgtccaaagaaatgggatgatcggtcgcaatccagagaggaagtggtcagaggcaccggtggtggtggcagaggaggagggggatccacctgtggcggaggaagaagacgaggaagaaggcgtcgacttcatcagtgacctcccagacgccatcctcggcgagatcattgtccgtctccccaccaaagaagccaacagcacccaagtcctcgccgctctaatgctccacaccgctcaacctcggctgttgtcatccccgcgcgagaaaggatgccctcgctggctccgtttccgcatccctagctagacccagccgatgatctccaagaacgactctgcgtgcgacgaatcctcgccgtccagctgcccctcctccattgaatatattttgatacaaatgtttgttctgtattgaaaatactattatattttgctataagcttggtcaaacttaagataaatttaactaagaaaaaagtcaaacgacttataatatgaaacggagggagtatttgaactagaagtttcctatgcagtannnnnnnnnnnnnnnnnnnnnnnnnnnnnnnnnnnnnnnnnnnnnnnnnnnnnnnn

SEQ ID NO: 14569 - DNA, 26148 bp, Oryza sativa
  unsure (1)..(26148): unsure at all n locations
atataagagatagaagagagagataaactgacaggtggggccccacctattttttaataaataaattgctgactggaccaccacgtagaccaaaaccaccgcggattgggtcgaggggggtaatttgtccggtttacatagttcggggtgaaaaatgtccggttttgtggttcaggggggcaattcagacgaccgctatagttcggggggggggtaattcgtactttttccataaattaacaatgtgcactaatgagatactctcttattcatgaaatatctccgctcgtgctcgcatgcattcccgccctgctcaccggcctccctatctccttcctttccgccgctaagctcgtcgtcgcgctggtcgccacctttcctcctctctagccgtcgccgttgagccgaccgcctctctccccctccccgccgcggcgccatctggcagcaaaccaccagcccgctgccactccgcccgccgcctgtgaccgccttccgcccgttgtcgcgctcgcccgtcgccgctctaccgctgccccctaccttcttcgccttccgctcgcttccgacgaaggggcggagcacgaagaggacggggttgctctacccgcccgctgcccacccatcgccgctccgcccgctggcctccctcattgaagagaagagaagagagaaaatagaagagaagaagaagaaaagagataaaaaaatgtgcagctgacatgtgggccccacatactttttttttaattttttgctgactaggatgtcacgtcagcgaaaccacccatatatactgtcatgagatcttaagtgcacggtttgtgtgagtttaggtgtacacatttctgattttgtggttatgtaacctcgaaaaatttcgctgttaagttgagggacgtccggtgtgaacttattaccaattcctcgttccgagaaacttcagggccggatggcggcagcggtggggcaggaggaggagtcgatcgatgaggccacgtgatggcagcgaggaggaagagctgctcaacaagctctcccgctattgccgctactggacggatctgtggtccgacgattccagcgacatcgccaaaagaagtgaggaagcttcttttttttttttgttttagagatgattttatggtaaatacgaattcgctcatgctcttgttaggtttttagttttcatctcaaatcgacatgttcgctcgctgattatggtaggcgggagcctgggcgcacaatagtggggatggaaacatgaaaatggaaaatgttgggattgacatttttcacatggatatgcatcaatgtgatctaatggctcctctctttggtagtatgttgcaaaggaaaaagaaacaataatgcttgactgattgatgcggtttattggatggatgcagctgagattggtcccatgcggtacacggaggaaccgccccggttcgcgatgctcctagatttactagaggttttttctttcgaggtgacggagcttacaggtattctacgctggccaattgatgtgtttggtctcatctccgttcgtgactctctggatcggaaccgcaactatatctttgagcgcaccaggaacaactgccagactctcactgcaaaggtatctccatgcttcatggaaatagcagcacaaagtcatcagacttttctacaggcagctagttagttttgcaacttcacatttgtggtgcactagtgcagtagttcttctttacctaattataatagcagcgcaatcatgagatgtctggcatagttctgttgagaaaattggatgtgtctgaactagttgtacctttggtgcatcatttagtttacttaaacaaattagaacagtccaaacttatatgcacatcacggttccatttcacaaattatatatgatagtctgatatactagttgtatcacagaagcttatcagtaaacaacctgaaatattcaaatgtgcatgatttagtatcctgtgatggcatttcttttttacgaacggcaaaaataaaacctgtgatagcataatcaagcaattttccaatctaaaacacccctacacaccagagattaacatattttcatgatgcataaggggcatcacaaacatgtgggttgttaacagaaataactacagaaacaattggtgcacaggcgcagaattgatactacaaaaataaaatgctaccaagtcaattgatagaacatgcaggggtacttcccacgctcttatttaattcattgcagctagcattttccctatatgaacttgcagaggctatcttttctagcaagagctatgctccttgctccttgcttcggcttgtctgcattcttttccaaccattccagtaaagatgaagttgtcaatacatatatcagatatttatcgtacatcatatactgatatgcagattttgctatgcggtatcattttattattgagaaaagggaaaatagaaaatccaatttcagttatgcatagcatgtcgtcaggctcacatatgttatctttacctaattatcctcttgtttatattttgttttgacagttcaaatgccccattcatattattttgttgagtggaacttagaacacatacgggatagaattatgcatgtttgttcaccatcaatctagctagtttcaccttatcccaaaaaaaaagggaaatatttgttgtgttacattgttgctaccattcctttctaattgttttcatacagggttcttaagtggtggatagtgtatcatcaatattcttatactctctacatcgatcccataatataaggcacggtcaaacttggcacgatctccaaaactgatcttcggattataatttctcatatactataaggtttatagcaaaaaaatatataatcatatgaaagtagattcaaatgtcaatctaatgataatatttttagaaaataaaattcaattcatactatagtaattattggtcaaatgttttaaaagttaaaacttaaaatacgtgcacaccttatattatgggatggaggaagtatttagtaatgtcatggatgcgtgttgggttcatctctggttctcacaggtccaagccatgcaatcctattgatggaccctattgaatttgaaattgagctaggagttaaggggacgagtccctccgaagataagatcttgagcgctaaagcatttgggtataatggaactgctcagagacatagatgtggctcactgcgcagtatgatgttatcaggagcacgtagcaaattggagttcaagtatgcacacattcctgtggcattggaggctacaatcaaggtcaggattacaggaggttcaactgatttctgtggaaagttcattgcacatactgctagtatcaaggaacatgtcatattgctggactctggggaagaaatggtggctatctcccatgatggagccattgatttctgccgcagtgtagttgcattggaaggaaatggcggagttctgactgttagtgttcatgcaaggcagagtggtgatgagaatatcatatgtgcttataaacattttatcccggtaagatgtggacggaatcatgacacacttgatgttgggttttgccagatgagcgttgaagttgcttggttgctcattttttagtattgaaaaaaaatctaggccatgacaatacttaatattcggtattagtagtggaagtaatagatgtgctatgtggcattgtaatatactaatactagaagataatccgcgttgctgtgggacatagtgcataagacaaaacaaagtgaaattctatgggaacatttgatccattgcaattagacatagtgcataggaaaaacatttaagtgaaatttaaagaaaacatttcatcatcacatttaacatgcttcattggttgaatagatccaagtattttcgaacaaaccttaatatacttctcatttgattgaccatagaaaaatgaattttcttgactacaaattttgtaatccatcacatttaatatacttcattggttgaatatacccagttttttttcccaacagaacactcttatttgatcgactatagaaactgaatttttattgactataaattttagaaatagctacaggaacttaccttctgaggtgatcatgaaagttaagtaatatgtgataaaaaggaatgaaaaggtgtaaggagcactgttcattgtgctatggtataaattaaatacgggtcagttgtacaattattttcagctcgatatgtagagatggcattacattatttgattgaaataaataaaactgtagtaggaaataagctaatttatggtgtacaacctgaaaatttctagaaattaatcattctcaccgaagaaattaaatttctattctgaatcataacatatctgtaatatgaattaaagtagaaacgagtgaccaaaatttacatttggaattaggtgagagcatgtagcataaaatccatcggtaaataagtatatgatcttcatctaacaagaaagggagggggaaacgtgatattaaatattggctggcagagtgaagacgaacacctgatgcattaagctgagttctttgcgtgctaaacaatgtgtgtttttaaaagttttctatacgaaagttgctttaaaaaatcatattaatcttttttaaaaaaatatctaatatttaattaatcatacgctaataataagttgctccatcttacgtgcgtgaaagattagttctcaactcaggaaactgaacacagcctttaggggaaaaaaatgtgtacaaccaataatgaattcatccaaaagccacttgttttaacttggtaaaccaataaactcaacgtgggagagtgagggaaaagaataatgtacctgatccagcttaaggtttgttggggaacataaaaaatggtgcagaccaggaagacaggaaatgaattggctagtgcgtgagatgaaacaacgttgccggagtatggattagctgtggccgtttgcgcccaataatccctaataatatcagctaatccatctattttgttatcaaaagaacatattagccagtgtgccgcaacaattagttacatagaaaatgggaatgccggtagtcatttcctactaaaagattgaagctgcatcgaaaaaagccaccagagctgcagatagaagtcaccaatcctgataatcaccaagcacgatggataacaattatatacactcacaatacccgtgatgggtatagcacagggatttaaatgcgttatcacggtgcccataaggagaagttgaggcgtctgcggcgatttcctgattttccacgcacgaagaaaggcgaaggccactggcccactgagaagctgaacggtcggacgaggaatcgtcgtgaaggtaggggaatcgggctagggagattatcaagtaagattattttgcccgtttatcctacttctattttattttttctttctaattttcactgttatgcgaggaataaactagtaaataagtttttatgcgggtaatgggattgcccatttgcatcccctagtgcgcgggcgtgagcagtgctatgcgctcgaggaaaatgatcgattccccctatcctgtagaggatagcgaccacgaggggcaggatgggatgggatgagctattcaggctgtcacatgtggatgtgataatgtgggtcgtattttccctagtatgattcactccatcaaagttgcttcagcattggtacatcgcagcttcggcgttcgtacgataggagatatggaggacatttgatcaaaccgttgtgcataaaatggatgacatggcttaaccatagatcagaaagttgataatattactactctaagtgaagatcacttgtatagatttataggatgccagttagtactgaatttggaccggaggcctcacggcctagcttattatttatttgatcaatcaaattataaacttgctactactattcacctatttgtaagtagtaaccatgccatcacaattcattagaaatatgagatatgtcgttccctatactgtaaacgtcattggacacatgtatatgccactatatttttataacccaaaatgcccctatgtacatttatgtgggcctcatgtgtcataacctttatcaatcttcgagcgaggagtaaccttgctggcgatgtcatcggtctactccttagcatgtgactctcatagcttgtcgtacaccgttcgcagctggttttctttcatgattcagaggcgagtgagcaatcaaactgcgtcgcaacaaaagctggagaactgaaaaaaatgagggaaatcggcaaatggtagcgtgacataagaacatggggttagaaaagaagagccgccactgccaccgttggggacgactaccgccatcgagcgtccatcatgcgcttatcatcgacagtttcttctcgtttctgtctcgtacgtgcatgggtcgatgatgaccagatctgctcctatccctgaccaccacccagatctgtctcgtctctgttcttgccttcgctagccagatctaacgcactcaaaaatgataaaaagaaaaataaaaatagcatgataacgctagaaggagcatatggtgcatatgattagaagaatacactgcgttgaatgaacggcaataaacatctctactacttttaaaaaaaaaaggagagagagaatcgctcaatttctatccctctgtctttacttctctctccatctcccacttgcacgtaaaaatctctcaaaaaccaacaacctcaaaaaaaaaaaaaaaaaaccaactggccaaattccggttgcaacgcacgcatttccacagtgctttttattgggctctcctagcccggcccaagtgagcccaaatataaatcctctacccaaaaagactcctcgctccgaaaaacttcaggctagggccaagccggagcggagggatggcggcggcggcgaagccggaggcgggggagggggaggcgacgaattgccacaggagatcggcggcggggcaggaggaggaggaggaggagtcgaagaggccacgcgatggcaacgatgaggaggaagagctgctcaccgagctctcccgctaccgccgctactggacggatctttggtccgacgattccggcgacattgacagaagaagtgaggaagcattcttttttttttctttctcaattagccgctagctagcgttggggatttttttagatgattttatggtaaatacgtgccagacccttgtcgaattcgctcattccctggttaggttttaggtttcatatgaaaatctgaaatcaactggttggcgcgccgaattcgctcatgctcatgttaggtttttagttttcatctctaatcaacaggttcacgtgccgattaggattatggtagaaatggaaaaatgaaaataacatgttgggattggcattctttacatagatatctatcaatatgatctaatggctcatctctttgatatatctattctgatgcttgactgattgatgtggtttattggatggatgcagctgagattggtcccatgcggtacacggaggaatcgccccggttcgcaatgctcctggatttacttgaggttttttcttttgaggtgaccgagctgaaaggtattctacgctggccaatagatgtgtttggtctcatctccgttcgtgactctctggaccggaaccgcaactatatctttgagcgcaccaggaacaactgccagactctcactgcaaaggtacctctatgcttcatggaaataacagtgcatagtcatcagtaaacaacctgaaatattcaaatgtgcatggtttagaatcctgtgatggcttttctttttgaccaacagcaaaaaataaaacctgtgataacataatcaagcaattttccaaatctcaaactcccctacacatcagagcttaacatattttcatgatgcataaggggcatcacaaacatatgtgggttgctaacagaaataactacagaaacttttggtgcacaggtgcagaattgatactacaaaaataaaaggctaccaaatcaattgatagcacatgcagggatacttccccactcttattgaatttatagcaactactccctccgtttcacaatgtaagtcattctagcatttcccacattcatattgatgttaatgaatctagacatatatatgtgcctagattcattagcatctatataaatgtgggcaatgctagaatgacttacattgtgaaacggaggaagtagcattttcccccctatgaacttgcaggggctatctttagcaagggctatgttccttggtccttgcttcagcttgttgcgaaccattccagtaggatatttaacagacccctcatgagtatgtgaatggtaaaagtgagaatcaatcggtagtacaaatgtcctaactgcagcaagacgaatcatgcatggattcatctccttgcaatacagcttgagcctaagggaaaacattttgcaaatatttaggggtagtaacattttgcaaatatttaggggtagtaacattttgcagacatataatatttgttatctcatagccatcatctttggtttttatcataatagtcatcatgttttaatgggattattgaccattattcatgccaatccaagagtttaaggagatgtaatggcaatccacaattgacaatacaaagcaaaattctttgagatgttttagagtagagagtaaaaagggcagcatcaagagtacaatttgcccaacaattaactacattttgttgtgatactttgacatactatgaagattctatatgaaaagctcatgcaaaaaatgctaatgaataatggttgtgttaatactacagttctgcgataacagggtattattgatttgcaagtgctggtcattaaagattcaggcagtaaagatgaagttgtcaatacatatatcagatatttatcgtatactgtatacttatatgcatattttgctatacagtatcattttattgttgggcaaagggaaaatagaaaatccaagttcagttatgcatagcatgtcgtcagtctcacatatgttttcttttcctaattatgctcctgtttatattttgttttgacagttcaatgccccattcatattattgtgttgagtggaacttagaacacatatgtgatagaattatgcatgtttgttcaccatcaatctagctaatttcaccttatccaaaaaaaaaatggaaatatttgctgtgttacattgttgctaccattccttatatttagtaatgtcacgggtgtatgtaggattcatctctggttcttactggtccaagccgtgcaatcctattgatggaccctattgaatttgaaattgagctaagagtcaaggggacaagtccctccgaagataagatcttgagcgctgaagcatttgggtataatggcaccgctcagagacacagatgtggctcactccgcagtatgttgttatcaggagcacgcagcacattggagttcaagtatgctcacattcctgtggcattggaggctacaatcaaggtcaggattacaggaggtttaactgatttctgtggaaagttcattgcacatactgctagtatcaaggaagatgtcgtattgctggactctggagaagaaatggtggctatctcccatgatggagccattcatttctcccgcagtgtggttgcagttgaaggaaatggtgtgctgactgttggtgttcatgcaaggcagagtggtgatgagaataacagctgtgattacaagaattttatcccggtaagatgtggacggagtcatgacacacttgatgttggattttgccagatgagtgttgaagttgcttggtcgctcatgctttcatattgaaaaaacataggcccgataatattatattttgccaagtctaggccctgataattttgcttgctgtgacacaagctgtttgctcgatggcattgtaatatactgatatgacaatacttaatattcggtgttagtagttcatttttttagagaaggctatacggccctgctttttattgcgttcttatagaaagcaatatgtctttatacatagattcagagatgctggggccaccagcttgccagacacagcacaggaaactgactgtaaacacactaccaactacaggacgcataagcaagtgctataatagagaggagtattatctctaattctatccatataatctactactcataaataagaagcaatatatacaataggtcacctctaatacacaatacaaatactagtacttctaatactatcacacctagggcttgtttggtaaagctccaacttctaaatttagcttcaggaattgggtctggagtggagcagctccacctctctagttcattttttgagagtgtttcactcagctccactcccattttaggtggagatgaagtcatgaaactgtttagctgagcttagtttcaaaagaggtggagctagagctgtgccaaacagacccctattttgttacttctaatacacacatatcaatacttctaataatactctcacacacatatggaggttctcttagtacatgagaaggttgctcagctatatgacacttagggtcatccaatcctacgtgacactcatgtcaaaaaaaataaataaatcatacgtgacactcttaaaacagcacatcaagtattcctgtatatcatcactcaatcgtacgtgacactcgtgttaaaaagaaaatcgtatatgatgcttttaaggacagtacatcaattatagtagttgctcccaggctccaaactccagaatgccagcaaaagccaaaagcaaaactaaaccaccggtaacaccgatgttagcctattccagctcgcgagggacgaagaccgttgacagcatcttgtaatgccgccgccatggactccagagtagcaacgtcatcaggcttcagaaatgatttccactacaacagtaagccaatcaaacgaaaaaagaataattagaggtgaggaaaccatcttatccctgaagaccatgtcatgtctagttgaccaaagaattccaacataaagcagctaaaagaaggcatccaactctagattttttaagcctgttttccccagaaccaagcagaaaaagtcatcaaaatcatgaggaattctactctggccaagggcgtctctacaaatacaccaggcaaatctagcaacggggcatttgaaacaaactagaaataactgcgcgcttcgctgcacccgtccaatatcagaggagaaataaatttaacagcatataatttttttatatagcatgtatttggatcatttacatattagaaatgagcaaggagaaacagtaattgatgaaatagaattgtcttacaaatttcataaattaaacagtgcacatgataaatatcaccaaatgttaaagtgtcaacaaatagtgttggttctaatatgggagccaagagaggagtgagcagttgacagttagtgttgtgaccacaagatagaactgagaatcacacaacagagcatgttagtggagaattcttacaaaatgtggacattaagaataaaaaaactaagaaaaaaaacatatcctccggattagtcgttatctcacatatgaggctccccaactgttcatacttgcatttgtgttcatgagctcgtccatctacaaattgcaaaggctaaaggcatatagttgcaaaataagaaataatagatacattaggtgtggtatgaagtattactatttattttactgatatatacatatataaaaaggatgtggattatctccttcagtacaaaacatatatgaccaaatattatcaggcatttgcacatttctaagaatgtacctttaccatgctagacaacagtttgggcaagctgttgcctatatatatatgtatatgatacatatatgatatatccatcctgttatagcttataaggtaatggaaatgctaaacccaaatgttatggcttgtagccagcagtctgataaaagaagaactcatagcagtgtagcacagtaggactgagtgccctggtaagtgataacagcaagagtagactgttggcaagacatttatagattcatgtccctcatgacctcaattcagaaaatgaaaagaaaagctatctattgaaagaatgaagtcacctaactaagctttactttttgtatatctacaaatatcaccttttgccaatataattattacacattgggaaccattacatatacgcagcaccacgtgatattcataaagaatgaaattaacagtgaattttaaattagaacagagttgacttccatttggtaagtaaactatcctatatccaacaaaaagaatagtgtcccacattccatagatacatatttcataggagcataggatgatatatacttgcatatgtcttaaaatatgatggtctgcaatgttttttgtgagattcagatataatacaatccgactcaacacacctgtaatagcagtgccaaggctccttacatgctgctgaacctcacatagataaaaaatggcaaaagtgaacctagaaacaatggattgtcacatgtgacagcagtaattgtaaatcattaatgctctctaaaagtctaggcctgtagattgtaccgatcagatgagactttttcatgaaggcacctaaattgtagtgctaaaaatgctttttctttgggaatgtatttcaaaccacccacggacctaggcgctacctagctggctatcccaaaagctaaatgtaaaggttattcttcaattttagaaggcacactgaattatatgaactcaagcagtttgagttatttttggcatgccaaccctatagatgcctcagaggagatgatgatgcaagcataaacaacagatgtacacactacagctgacagaaaaaaaatgaggaggtactatgagatcataagaaagcctggatagtagatgatttacccatatttttcatagtgttggttttacagtgttaattaatgatcacaagtcgtgccccaaatttctccaggagggatggtttgattcctgggattcctgtacacgaagaaaccatgtagatcaaatatgtaatgctgtcatgctgtgctgatacgttaaaccaaacaatgcaacatttggtcttacctgctaacctcgacgaaagaaaataatgaggagcaatcagtgaaaatcttgccctgtcagctgtgactccttgttctttataagccagatgccttccatcaggaagttgaattgttttggcacttgggggacctatgtagagtttctttggcagctctactggggtatcatcaacactccctacacctaatactgcatacaaaatattcctgttaatcaagcgataaaaaattgatccctacattaagaaattgttttcttggatttcgcatttttcacaaatcaattgaagtacatagtgcattgacaaaatgattgtacaatgtgtagcatgtaaaagagggtaaaggagcacttctgggtagaaattctacatgctagcatgcatcaagttcgcatataagcaaccaagtgccataaaactcaaaaataagagggcaaaaagaatccacctggcaagcaatctgttggcaccaaaatagtaatatcaatacagcaaaaaaaaagcagctagcttgactcaatagtaaaacaattgactgaccaatgaccacaatattagactatggttgacctgtcatgaatttcaaactgcccgtaggccatgcattgtaccccatggccatgaaggcatgaacacaagcgcacaaggcatggatcccacaatccaaaaaaaaatctccttgaaataattacacgctttaaccaatatatatctagagtagcgttcacaacagaaacgcagcataaagagacagattgattctaaatccaaacaaaatttcaggggaaaaaaagagcaccaaacggttagttagatccatcccctctaatgactgaacactaaacgtgcacgctcatatcatacatcgtgatgcacgacggcataaaccaaactgcatgctgagctgtagtcagagcctcactcgcacgcaaggaagagaagatcgggggagggggggtgagagatcagcgggggattaccgatgagcgtgacgaacgcgacggcggcggtgatgacccagcacctgacggggttgcagtcctcggcgaggtacgcgttcatgaagctgaggcgcttccccatggccacggcggggcccctgagccgccgcgcgagctcgctgtcctcggcgccggcgaggctctgagcggtcggatccaccggggggagaccaaacgccggatcgacggcctgccagtggatttggcactacaccaagcagggtggagaagatggtggtggtggctcacgacccttttgtccgggcagccggaatcgcctgcggagaggaggtggtcaccggattcgatgcccctggtctcctcgctggtagatgaagtgacctgactggggagagagtcgggggcggtgcagcggcggcgagaggagggcgaggaggcgacgcgcatgagagaggagagcgaggcggcgcgggcgagagaagagaaccgagcggccgagccgcgcgaggtcgcgggcaggagactgaggtggctagggttcttggcaaatccaggccgtctgttcctaatccaacgatctcacgatggtggaagagcagccacgctgggacacgtggacggccagatcgtccctcgcgcgtgatcgaacggacctcaatagcctgaaccggaatgcaattaaccaaagatgaggggtatttctgaaaatattgatgaggtggcgccctaatcctcacccattcccacggcgtttaagtaaagtaatatgtggacagtatcctcatacacaccacataggcacattctggcaaaactctgatccacccaatagcactttctcagctgagcagaagattgtatctttcctcttacagcagccagccagagaaaatattttgtttttgcttaggagggataggacaactccaaatatcatgcatcctcacatcatttacccccttaaagggttagcatcctgtagattgattgagatgagtacacccccttcttgtctaaagacccccacactatcttttctctctcatcacacagtaatattgtcagccgaatgagagctaatgcagaacttgtaatgctgaactccctaccacatattctccaaacattgaatacacaacagactcaaatcaatttatcaaagatgaataattaaaatgataagctatatgattgtcaaaggcaggataaagaaaattcaagttactcttatcgatctgcaatcagagccataacctgcaaatacttgcacctttatccatataccagcagctaattccagttgcttttgcagctccaagggctcagatggtctgatgacaggactgcccaatagatcagcctgtaggtgggctgcatataataatatacgttgtcagcaaactctttatttgtgtccctgagatactggaagagatactagcaattggaaggctaggattgcaagtattctcttttacaaattgctaggaaggagaagaattcttttacctgaatctgcatcagaagattatggactgtgtatcgccaccgaacacgcacgtaatcagaatttcacttgtcatgcctagagatggtaacgggtgcatacccatcaggttttcttaccccatatccacaccctcaatgcacctgtcgcgggtacaaaccatccccatacccacacccgtgcgggtaatgggtactcatacctatataattgacctgtaacatttataattttgtactctaattagccatattagatctgtaaaccatcaatatttttcctaacaacaatgctattaacattagcgttcaaaggcgagtaaaaaaactttacaatcacattacataatcaagaaatcaaataataatttcatataactagactagaacaatgcttaagatgcgaaataagttttatgctatgatttaatagtcgttgagacttatattactcatagttttatgcttaatttacgggtttttcaaccaagggttgatgggtacgggtgggtaaagaatggacctatacccacatactcaatgggtaagagttctcgtccgttagtagacccataaataaagagttagaacatgattagcttctaataaaataaaagctcatagggtgtcgggtcataggtcccattaccatctctagtcatgcctccccgtcatcgtcgttgcagctccattggccattcgccggcttgatgccccgatgaggaatctgctggaatgagaatggaaagaggagaagaccgtacttgttgcggggaagacgagatgcccgtttagaactcctccaatacccataaaacggagcaaatccattttcacatgattaattaaatattaactaaattaaagttaaaaattaaattaatatattattttaaattagtagaaaaggtttttataaaaaaatacatcttttaatagtttgggaagttttatatgtgaaaaatgagggagtagaaattaaaaagagttggtaaagaacacactcatactactacacagctagccgtgcaatggacaaacgagacgccaagcaactgcttaaccaatcgacgaaatacatattaatttctactcccaaaaaacaaatggatgaaattgaaccgatataaacagccgatataggtaaagagcatctccaagagaatcttgtccctaaaagttaaattttaagaattaagggtaaaatcaaccctccaacaggtttccaaatgaggccccccaatatttaggtacatctaaaatccaaccaaatagtagctagttttggacacctccacgcactcgagaaaaatcagtttagtagggccaaccagtgatgacatgacagattttaaagtttttttaatcaagtattggatattcttagagatggagatgatttttgagcccgatatcttttggatactcccaactaggggtgtaagtggctaacccgcgaaacccacttataggctaaaataagccgtgagcccgcttattttgacttataagtgggttcgcggctgacccacttacacccctactcccaacacaagttttttaggagcctaaacaactctttgagatgctcttaacgacagcatcactcatacgatttgcttagtacgtgggttgcaacttgcgtctttcatcatctttaagagcaactacttagtcataatgcaataaaagcttttgattttagcttaattattccctatgtttcatattataaggccattcccaacccaatgactaggatgatgtccattgtattaaataagtttccacctaggatgaaaaatgatgtggcaaatgaataaatgaggaaagtgaaggaaaccatatcttgcatgagacatagtttctacgtaacatcccagacatcaagtgagataagtagcattaaattaaagtatggaatagtgatgtttgcagtggaagagtagtgtctagtactagtttcttgatgatgtagagtttatggaaactatctctggtaatggcctaagtcgctttgatatttttttctagttaaatttttttagttttaaccaaattgatagaaaatctaacaacatatataactccaaattagttttattaaataaaatattaaatatatttttaataatatgtttattttgggttagaaatgttactatattttttataaatttattcaaacttaaaatataagaaatatcaaaacaacttataatatgaaacaacgaaagtacctacttaggacgacttacaacatggccaacaatatctataagtgaaacccaattctaaaattaggattttctttttgtaaagaacttgctccaatactctctccggactgataatacttatcgttttggataaggatgaggtcaaattttaaaatctttggttatgaataatttataaaaatatttgtctttgaaatatggtgattatatgtatagattaatcttaaaaaatacttcaataaaatcatatatttgttaacatttatatacatattatactaaaaaataataaataatgatcaaagttgttttttaagatcatgcccttgttcaaaacgataagtattatcaactcggagggagtagttctctagagatgtatccaaaaattgaaatttccttcccatcctttctcgctctccataagtcgggagacgctcttgctcccaatgttcgcacggcaaaaaagagagggcgacacatgggaagggggatggaccgagcgttttttttatatcgggttcattttttatttttgaagttaatttgagatatctcttagagatctgtttgcaccttaaaatcaattaggaatttgagaatagaattttagaaatagctttttagatatttgttgggcatgctcttatgacgactaattacctaatttctttttttagcttttgagggatatagctgaaatcagaattaagaattttatgaggataggcagccccaggacaggatccgattggacggctgagcatattagcaacttttggaagttcatttgccccaagcctatagtgaaaatctcaaatttattatactagttgattttcatgtcaaatttgtcctcataaatttagtaaccacaatctcatcatccacaaatggtgtaaaaacaacagtgcgtcaccaacgcattgtaaatgacaaagaccataaggaaacaaatgtggaaccaaaatatttttagtattatcaaaaatctttgtcaaagtgaaaagtaaatatcataaagaaaccaggatatgccatgtcatctgacaaatattaaccatcggatacacttaaagacaaaataagtcgaataccgtaggatgaaacttaagtatagtcgtaaaaaatgtaggaatgttctagagtaccctgtagaacctcccctaactcttggcacagctgcaagcccaagctccatcctcttttctccatgcctgaggcaagtttagaataaaaacaaaataaactcctttactaacaaaatgtgaaacttatagttagataactttcaaattgaaatgcatttcctcggcccacatcagcggtgtcggtgcttcgattcatggccaccacttacacctccattactatctcaatttgttcataaattcaatttataaccatgaataaatatagtgaaatcaaatccatatgaagtgaaaacactacatatataaaaagtgattctcgatatatctttgcatagccgtagagtaacccaatgaacatactgaataacgtgttttctatggaatttatgtcaatagagttacaataaatcctacattcacaattaaacaatatagcaggtctaaaattatcagatgtgtcggtcatagaaacgatcctgaataaataagataaaaaaaatctaccacctacagaaatatccataactaacgaatagaaaaatcaacctaattgctcggacttgaaccaaatactctccaaagttcaatccttaacataattgaataatagaattcagatatagaactagaccaattaaattttaactaatatgaaaatagaagatagaaggagaaagagagtctcctgtcttaattcttaaatctctataggttcttaaaagatcagatttataaccattaattttaatccagaatcttccgtcttcacccttcaatgcaaagccttgatacaactgacccataaggccataactgtcgaaagccttccttagaatgcacttgattattcaatagatgtacacagaaataaaaacgtacaaaacccggcctctacatgcaatacaagtacaaaagtgtttagacccaaactcgttataaaaggtttcaacaaagcattgaaagacaacaaccaagcaaaagacaaatacaagaccacttccaatccctttctacagttccgcccaaactttgccgcactcctccaatttgtggtcaccctcttttttatgcaacaaagaccaccaacacgtccttgaagattacctgcaaattattggaattaatttgggagccattctaaatttctaataataagttacttacctcgtggatttgtctaaaaacgtgaaagcttcccggcgcctctccctcctgaaaacaccccttcatggggttcatcacgattcacgaatgattactacctacaccaaaggtagcaatttgtggattcactttggatcatcatcttgatcttgttggcaaaaactcaggatcaaactacacacgaatccctggaaatcgacaatgcttgacgatgaacagtggaagagaagaacacacgcgagaagttttttgtgccgctaaacttacgcagcttttctgtatatttcatctccttttatggaaagcgaaaacgagatcatgcaatcgtgtagatcgtgtctccggctctgtgcactcccacttcctccatttgcgcatgtgccatcccacacggcggagaacgtgagcgtacgactcgctacactacgcctaatcgtgaacttgcacgaatccggctttacaggacgtgactcgaactgtaacaaccaagccacaaaaaacggaaataaaacagactctaacaaacaccttgcatgcatcgaacagtgcacggtgtgagaaggaaaaagcagagctcctaaaacagagctccatagtgccagcttatatcatcaagtctaacattctccccctaagcctggcaccgtgaactgacctcgacgacgctgatgcgagctcgcaattcttgaaaacgaacccgcccgagtgccttggtcaggatgtctgcaatctgcccatcaatgccaatgaactcaacctgagctctcccgtcctccacgcactcacggatgaagtggtagcgcgtggcgatgtgtttactcctgtcatgaaacactggatttttgctgagggcgatcgccgatttattgtcgacgaggagcttgaagctttctggctcctcttgcttgatttctcccagcagctgcgccagccaaattccctaacacgccgccgtcgtcgccgctatgtactccgcctcacaagatgagagcgcgacaaccttttgcttgatggactgccaactgaccgggttggcgcccaggaagaagacgaccccgctggtgcttttgcgagtgtcgacatcacccgccatgtctgcatcacagtatccgacgagctcaggtggcgtttccatccttttgtagtagcagccgaaatcaaccgtgccggcaacataacgcaagatgcgtttcaccgccgcgtcatgctcggtggttggagcttccatgaagtggctcacgtacccaacagagaacgcgaggtccggccgcgtgtgaaccagataccacaggcagccgacgatgctgcggtactgggtggcatccaccggcgccgccgtgcttgccttggtcaacttgagacgaggctccatcggcgtcaagcaggaattacatccctgcatcccggctcgctcaagtatgcgttgtgcatacgatttctgcgatagtcgaatgccgtccgccacctgttcgacctcgatccccaagtagaacgagaggggaccaagatcactcatcttgaatagggacatcatctcagctttgaaacggtcgatctccatcgccacgttgccggtgatgatcaagtcgtcgacgtacacgccaacgagcagtcggctgtcgccactgccccgcccgtagaccgcgtgctcgcagtcattgcgccggaaccccagcgacagcaggctcgcgtccagcttcgcgttccacacgcgtggagcctgccgaagaccatacaaggccttgtccaggcgaagcacttgatgttcgcgtccgtccacaatgaacccaggaggttgcttgacgtagacctcctcggtgagctccccgttgaggaacgccgacttgacgtccatgtggtggacaggccagcctacttgcgccgcccgcgcgagtagcattctcaccgactccagccgtgccactggagcaaacacctcgttgaagtccacccctggctgttgcatgtatcccttcgccacaagacgagccttgtgcttggtgatcatgccacgcgcgtccttcttgatcttgtagacccatttgagtccgatggcgcgatgaccgggtggcaagtcgacaaggcgccaggtcttgttgtcctcgatggaggaaatctcctgcagcatggcacgccgccactcttggtgatgctcggcctcgccgaaggtggtaggttcctccgccgccagcaagtaaagctcgccgtccgccaggtcccttgttgctagacccggcgtgtacgctcccccagaatcccatcgatggagcggtaccggggcggacagtcgtcggcgtcggcgtcgaggttgtcgtcgccgtcctgcggcgggctgacgaatctcggtgacctcgcattgagcagtgaggccgtcagtgacggcgcgtcgtgcgcaaccgcgccatgtctcggtgtggccagcgtcggcgtggacaactccgcacgttccggctcctgagtgacaatgtattcaacagagaagtcagacgagggaggggaatgcataccatcagtggcatcccaatcccagctggcgccctcgtcgaacaccacgtcgcgcgtcacttgaacacgacccgacttcgggtcgaacaacttgtaggctttggatccctcaacgtagcgaggaagaccgtgggcttgttgcggtcctggagcttggtgacatgcggccgaacatccttgacgtacgcgagacacccgaacgtgcgcaggtgcccaacggccggcttccgcccaaaccaagcttcatacggagtcttgttgtccaagcatttggtcggcgcgcgattgagcaagaacacagccgtagtgactgcctccccccagtagcacgccggcactgacttggccttgagaagactctgcgccatccccagaatcgtctggttgcggcgctcgaccaccctgttttgctggggggaatacggcgcggtgagctgtcgcttgacgccgctctcggcgcaatgcgcggcgaactcggcggaggtgaactcgcccccattgtcggtgcgaaggagcttgagacggcagccagactcagcttcgctgcgggcttggaagcgtttgatcgccactgccgcctccctcttgttctgaagcagtgcgagccacatgtagcggctcgcgtcatcgaccaacagcagaaagtgtttcttgccgccgggcgtcgcaggcgaaatgggaccacagaggtcaccatggaccagctccaaacgatcctccgcgcagaacagggaccgccagggaaacggtgaacgtcgttgcttggtgatgacgcagcagtcacacagttgctcaacttgatcaatttggggaagaccacgaaccatgtcctgtcgagcgagtcgccggagcgcgtcgaagtagaggtggccgaagcgagcatgccacagccacgcggcctcctgcgtgcgtgctgagaggcacataggccgagcgacggtgatcttgatcaggtacagctgattgcgcgtacgctgcacgcgagcgaggagctgtcgcgcggtgtcgcggatcgtgcagacgccatgaaagatgcggacgttgcagccattttcatccagctgcccgagactgacgaggttcgcgttgagcttggggatgtagtacacccctgtgagtgcgcggtgttcaccgttcctgcactcgaagataattttaccttggccttcaatggcgaccacggagccgttgccgaaacggactttgccgcgcacagcagtgtcgagctcggcgaagatatcacgcacgccgggcatgtgattggtaccaccggtgtcaaggtgccacacaccggtgtcaacgtgttcctggcgatgcaggggagcgaacaccttgggttcatcaaggtcgagcaaccccgctggaggcggggacggcgacggaggtggcgccaactcaatggcatgagccatcagcaacgctggctcatcatcctcctcttcaccatgggcgatgtgcgccgcgacttgtttcttgggctgacgacagtctttcgcctagtgaccgagacagccacagttcttgcacttatcacgcccttgatcgtgcgtgtcgcgcgcgccacgctcgccatccgcagcggccttggatttcttccggccaccgcggcggcgacggttgttgcccgccttcttgcccaacgatccctcaccggactgccgttccttggcgcgagcagcccactgttcttcaatgagatacagtttgccgccctcatcaccggacttcttcttgggacggcgttcctccgcatttctcagacgagtctcgatggacaaagcaatctgctcaagatgatcaggaacaacatgaagaaacttttcacagacctttgattcctcgagctggaacccgagtacggcaaggttgttgacgagcccactcagccggacggagaactccacggactcgccttccttgaactcattcgcgtcgaactgcttgcgcaactcctgcgctttggacttgcggacgcggtcgacgccgacgcgcatcgtcttgatggcatcccaggcgtctttcgccgtctccttgacagcgagtaccggcagcagatcagcggggaccgccttgaggacggcctccaacgccatcctatcctcctggaagtcgacgtcacccgtctcgacagcttcccagaggccgcgcgcctggagcattaccctcatcaagagggaccagtcgctgtagttcgtcttcgtgaggatcggatagttggctgagccccccacctccttgaccacgcgcctaagcggaaccatgtcccaggcgtcgccaggcctacggcgaccacggcgcggaggaggcgagcgggattgacgacgcggcgaacgcgaaacgcgcggcgtcggagccgacatggctctgataccagatgttggcaaaaactcaggatcaaactacacacgaatccctagaaatcgacaatgcttgacgatgaacagtggaagagaagaacacacgcgagaagttttttgtgccgctaaacttacgcagcttttctgtatatttcatctccttttatggaaagcgaaaacgagatcatgcgatcgtgtagatcgtgtctccggctctgtgcactcccacttcctccatttgcgcatgtgccatcccacacggcggagaacgtgagcgtacgactcgctacactacgcctaatcgtgaacttgcacgaatccggctttacaggacgcgactcgaactgtaacaaccaagccaaaaaaacggaaataaaacagactctaacaaacaccttgcatgcatcgaacagtgtacggtgtgagaaggaagaagcagagctcctgaaacagagctccatagtaccagcttatatcatcaagtctaacagatctctgtgtttggaaccagcctgattggaggggagcaaggcgtgcagaacgatctccctaagcccgcccagaatgcaatgcgaccaacttgtttcttgttttgcatagagtgctgcatccgaaaggtcagacctcatattgatattgtgattgttcatcagtagaccaagacaccaaacttttttctcctattctggatcggcatcgtggtatcattgcaaagagaaaaggatgtgttgcaagctttttcactggaaaatgaaaaatccgaccttgcaagaaattgagaatccgaaactagattcatacacgtgtgcctcaaatgtgctggccattaattgttacgccaaaagtatgtagaactgcattcctacactcctgtctgttcagaacgaaagttgactggcacattcaggatcgctcgtccaaatccaaaaccacagcaatacacatcattcttnnnnnnnnnnnnnnnnnnnnnnnnnnnnnnnnnnnnnn

SEQ ID NO: 14570 - DNA, 4344 bp, Oryza sativa
  unsure (1)..(4344): unsure at all n locations
nnnnnnnnnnnnnnnnnnnnnnnnnnnnnnnnnnnnnnnnnnnnnnnnnnnnnnntgcatcgaacagtgtacggtgtgagaaggaagaagcagagctcctgaaacagagctccatagtaccagcttatatcatcaagtctaacagatctctgtgtttggaaccagcctgattggaggggagcaaggcgtgcagaacgatctccctaagcccgcccagaatgcaatgcgaccaacttgtttcttgttttgcatagagtgctgcatccgaaaggtcagacctcatattgatattgtgattgttcatcagtagaccaagacaccaaacttttttctcctattctggatcggcatcgtggtatcattgcaaagagaaaaggatgtgttgcaagctttttcactggaaaatgaaaaatccgaccttgcaagaaattgagaatccgaaactagattcatacacgtgtgcctcaaatgtgctggccattaattgttacgccaaaagtatgtagaactgcattcctacactcctgtctgttcagaacgaaagttgactggcacattcaggatcgctcgtccaaatccaaaaccacagcaatacacatcattcttcctaatgagcttctgattaactgaagtacgtactactgctcctgatccattgtagtacagctaaaaacagcagataaaccgaaaatatgaagagaaaaaaaaaacagcaagaacgagaagggagactcccccccccccccccccccactcattgggttaattaggccgatcgatccatctccctcaaaagaggcattgctgaaagtgcagtaactaattcatcctccctcgaaaaactgttctgatccatcaagctactttgacacttagattgctcgcttggcttgcaaaagtgagatctctttgtactacttacttacagtcactgctgttgctgcgcaggctgttgcaggttagcgaacacgtcttgtctgtaaaggatgagcagcaactcaccatctggttcgcccgcaacatgatttgcagcatagatgccgatccggcgaagtttgtcaagctcggtctgaagatatcctccgatgccatcctgctcccggctccagcaatgtaatgcaaatccagaaatcaggtcccagctcgtgattctcttccttgtaatgaggcttgtgatcgttccattcatatataggtccatttggtgagaaacgagcgctctgactgatctcaggcgtgcagcttcacaaaacatcactgctaagcgtgcaattgctctcctttggacatgaagaagtgggtggtcacgcggaagaccattgttgaagttcagtagtctgtagtatgaatcaagtacagacggtggccccactgtaacctcatccctgcaaaattgcaatgtttcaagtcattactaacttcttgtagatcagaaacaaagatattaataattttcttgtagaaagtacaagtttttcttggggcggtactcccaagtcattcgaggccatctgttctagaagaaccaatggttgagtatagtaggtagtaatatatgccatcacttactactcaagggtaattaagccttttgacaccatatccatatgaaataaatgttaaattatcattccatttattataattgcccttactacagaatattctgactgaccatatctttaggaagatgagctttgatcttttactgatattcccttaaaacaaatgaagcattaagaaccaaataatattttggaaaattaaatatagtagaacataaattttgtgaattttaaaatccaaataatttagattagaaaaataagaaataccccaatgaacttaatgtcgaacctagaggaaaaattgataagcaaacttgaattttcaacgctcccagtataaattaaaaatcctgaacaaaaaaactcagatcgtaccaatcaaattcaatatttgaaagcaagagtttgtattttctatttctattatataaatgtacatatatattcttaaacttcagtttgataatttgatattgatcttgaatgtgccctattatcattacctgcgtcaatgcaatcctgattcaaattaatagaatcatttgtagaacagcttattcatttacaaatgataaataaaagtgtacaaatgaataagccgttctacaaatgattctataaatgattctacaaatgattcaattatcctgatacagattcacacttttatttatcatgatacatgtacagtgactaactaagcgagctacacacaaggagggaacatgccataagaattaataggacgtatatgcgtacacgttcacaggtttgccaacatcatttatcatgttgctttttttttaagctcaaaccacagccactatgaataacacactaaacacaattacaattttgtttaccagccgactgcccctatagagtgctaggattagcctcttgaagggtaaaaggagcacattgaaaaaaacataaaatacaactaggaaagctacacttaccagtcctgaagaaggtgaccatagtctgctttcaggtacaagataggttgggcattgaaaatgtcaggggctggtgtgtcagagaagttgaaccactgaccggcaccatttcggatggcaatcaaatatgcatttctttggtcaatgagtatctgaacagatggtgactcaggcatgtcaagagatattatgtgccacccctcctcattgcttgttataggaacattcctgaagttgtggtgtgccctccgctgaaaacggcctccaatatcgtccatcagcttgttgtagctcagagcagacaaatcaaccacgctgatgtggagaattggtattccctgcaagaagaaggatccatccagtgcatgagcagctgcaaggatattcagtttctgcacttgcacttgtccaaaaatcaaaacgatgtcatttcatttgaattcttcaatctttatgtgcacttgggaaaatgcgatacagtttatctacagtgaatagaacaagaaattgtttcacaataaaatattgcagaattggctggctcccccaagaggttggcctgtgcagcaattctttcagtctataattaaataggcaacaaggcacttgcctttcttaagaaaaaaaaagtgcatagctgaatataagacatagagtaccattcacatgtgctacttgtcatatgttttattctcagtggtgtatctaaaattattttttgtttcggagattctcggaacaatgaatcatgcaacttcatttagttttggcaaaggatttcatgttcagctgcacatttggatatgttaagggcttgtttggttagttcctataaggaagagattggaggggattgagggggtattaattccaaactcaatagggttgtggaattaatcatctcaaatcctcttcaattcccatggggagggattgaccgaacaagccctaagggagttcggccacattagcaagtcaagaaaactagggattaattttctttttcaaacaacaaattttacttacattttttagtaacataatggtctctaattattattctcgtcacgacaaatatgttttgttactactgaaattgctaaagtacatgtactaaacaccatttaacacatttgctaccgtaaaaaaagttaacaaggttacatacttccattggtgagcaacttgaattgtgtgctctcttcacctgcaaaatagaacttttctaagcaaacaaatgatacattttgaaaaaaggagtaatagttatgttatttctttctttatctttatatatcatgtatcttaaaccggttggtctttcctgataaattgggatgggagagtggcctatgctgaaaaatggtgactcatgtactactattattaagatttgccaaaggagtcctatatatgtagtaatgatcctattaggcttaccgttccaacttgcgtcgggagactaactagtaggcagttaggcacattacgcaaggccctgtgaatgtgaacagccatactgagtagtgcttaaaatgcaagagaatctcatctgaggcaggtagaaggaattacggcatgaaaaagaatcacaatgcactactttctcttggttcttgatgccttggatgcattgatgaaaacatattatcaacacatacatacatacatacatacatatatatatatatatatatatatatatatatatatatatatatatatatatatatatatatatatatatatatgagattccccttaaagaaaggagatgtgacaattaaggattttttattgggcccacatgctat

SEQ ID NO: 14571 - DNA, 6352 bp, Oryza sativa
aatatattttgatacaaatgtttgttctgtattgaaaatactattatattttgctataagctaggtcaaacttaaggaaatttaactaaaaaaagtcaaacgacttataatatgaaacggagggagtatttgaactagaagtttcctatgcagtacggtaatgcttaaacataataaattaacaatgtgcactaatgagatactctcttattcatgaaatatctccgctcgtgctcgcatgcattcccgccgtgctcaccggcctccctatctccttcctttccgccgctaagctcgtcgtcgcactggtcgccacctttcctcctctccagccgtcgccgttgagccgaccgcctctctccccctccccgccgcggcgccatttggcagcaaaccaccagccctctgccactccgcccgccgcccgtgaccgccttccgcccgttgtcgcgctcgcccgtcgccgctctaccgctgccccctacctgcttcgccttccgctcgcttccgacgaaggggcggagcacgaagaggacggggttgctctgcccgcccgccgccgcttcgctgccgcgcgggcccgccacccacccatcgccgctccgcccgctggcctcccttactgaagaagagaagagaagagagaaaatagaagagaagaagaagaaaagagataaaaaaatgtgcagctgacatgtgggccccacatactttttttaaatttttttgctgactaggatgccacgtcagcgaaaccacccatatatactgccatgagatcttaagtgcatggtttgtgtgagtttagatgtacatatttctgattttgtggttaagtaacctcgaaaaatttcgctgttaagttgaggaacgtccggtgaacttattcccaaaaaaattcctcgttctgagaaacttcaaggcgggatggcggcggcggtggggcaagaggaggatttgatgaggccacgtgatggcagcgaggaggaagagctgctcaacgagctctcccactatcgccgctactggacgaatctgtggtccgacgattccggcgacatcgccaaaagaagtgaggaagcttcttttttcttgttttagagatgattttatggtaaatacgaattcgctcatcctcttgttaggtttttagttttcatctcaaatcgacatgttcactcgctgattatggtaggcgggagcctgggcgcacaatagtgaggatggaaacatgaaaatggaaaatgttgggattgacatttttcacatggatatgcatcaatgtgatctaatggctcgtctctttggtgtgttgcaaaggaaaaagaaacaataatgcttgactgattgatatggtttattggatggatgcaactgagattggtcccatgcggtacacggaggaaccgccctggttcgcaatgctcctagatttactagaggttttttcttttgaggtgacggagcttaaaggtattctacgctggccaatagatgtgtttggtctcatccccgttcgtgactctctggaccggaaccacaactatatctttgagcgcaccaggaacaactgccagactctcactgcaaaggtatctccatgcttcatggaaatagcagcacaaagtcatcagacttttatacaggcagctagttagtttacaacttcacatttgtggtgcactagtgcagtagctcttctttacctaattaaaactagtaatatacccgtgctaacgctacggtgcaattatataataacactaataaaaaaacaatatcagcttagtctctcttatgcttgaaagctaaaattaaaatttcaaaacttaattttgaagttgaatttgtttgtattttgtcgtagtttattttacagaatgccctttttaatcgctaaagacacacatataaaaagttttttttttgttttctgttgctaatccacgagatagattaaagattaatataaagaaaaagagagaaaagataaaattatttagcactaaaatatcaccacattcttcgtaacccatctaattccagattacttcatattctagtatcatggaaatgtaatgcatattttcctgtactcgtacgaaatatgcaaacacgctcaaatctaacttgtcaaagcttggaaggctcaatccaagagagctatgattttcaattagtcacaggaactccagtatccaactttgtttaaaaaaaaacagtatacagtatctgcacaatagcttcatgccaaccaatgtaacttcaaaatgcagccctctcaatccaacaccagtatctagtactacacaatagcttcatgctgactgcagttacttcaaacgtgaccctctcattctgcaatccacaatgacttgatcttttgagctgcatttcaaaaccaaaattaaccaaaaggatcttaacacctgaagaaaaaaaactgcagaagcgaggatcacccaacaacattctcagctactttccagtctttgaacgtgcatccctagttttccagctttgtgtgttttatccgataacaataaattgatatagcaagaccagccacgctatcaatcacctttagaaaaatgatctatagaaaaaatatatttatgtactgtgtacctccatatcaggagaatctttgattggatttaaaagaattagcaagttttatgtacagggggttcagatgtaaacatcttacaaattaaatataattttcgatgcagccagttgcacaaatactgctaggaattaatgacattcaagtgaatcacatattttagggaacaaaggtgcaaagcaatcgcagaatttcagtataataatcttcaacataagatattatcctccaaagatcagatcttataggtgatttatttcaccgtcttcagaaaatacctaatacatacaaagccatacgtgaactaaactgtgaagaaacactcagcagtgacggtgagcagcggctcgcccagcagctcagatattcaaatttatccaatggaaaatcacatcattttttcagtatttgtagccaaacctaaatataggaaatagcatcctcaatctgctaaggggaaaatcagcacgaaatgactcaacactgaatgaacatgcgcttgaatttcttttagaattattcgtgtacataagttgaatatgaaaaatacatcgaagctactgttaccatgtgcctgcttcacttccaaaacttccaataagctgacacatgggctgtacaataacgtggaatatattactccccatcatgtaagtagagagcttgaaaattctcttcttgactcaaccaaacatattggctgaaaataatgtgaatcaaattcaccatactgagtgctactaaacaaagtagcaatactggtgttggtgcatgatttaaaagagaaaaatgctgttaataaatgatttctactgatattacaagtcacagggaattgaggtggcattgtataacgagtaattcatgattaacagcaacttaccggggatggctgcaggcacgcgatgcgaaggcttcgcctggctgcacaagatctcgtgcgaagctgcgctgccagggcgctcgaccagccggggctttcctcgctgctacgccggctaagccaccggcctccctcgccggttcgttggctcgtcgctgacaatgcgggtcagtggttctagggtttggggtgggaggttgaggggtctgtgggggtggaggacgctgaggtttggggatagggttcgggcgcggggcggggggagtacatggcggcgttgagggagtggggaaaagaatagatcagccgattaggcggaggggtcacgacatcatcattgtggggaggggcgcgacaattgggtgcgaccgagacttaggggaagagcgtcatgaatgaaatcggcgaggggcagggaatccgatccggcgatggagtgggagggagggggagctagcgatgcgagacgacgggggcgatgtctggtgtgcggcgatgcgaggcgacgatggcggcgtctggtgtgcgagagagattagaggagggggagcgtgcgggtccaaggtgcgcagagggccgcctcttgcgatgcgcaaggcaggtggcgattacggcactgggtcaggggcggcgtgagagatgcacggaagagggcggcaatccaaaccgtttgatcagatgtagatgaatacagagcgttagatttgatgaatgaagtatgaaaggatgtaagaggtacttggtgaattatagggtagaagaatagcagcgcaatcatgagatgtctggcgcagttctattgagaaaattcgttgtgtctgaactctgaactagttgtacctttggtgcatcatttagtttacttaaacaaattagaacagttcaaacttatatgcacatcatggttccatttcacaaattatataggatagtctgatactagttgtatcacagaagcttatcagtaaacgacctgaaagattcaaatgtgcttgatttagtatcctgtgatggcatttcttttttacgaacggcaaaaataaaacctgtgataacataatcaagcaattttacaatctcaaacacccatacacaccagagattaccatattttcatgatacataaggggcatcacaaacatgtgggttgttaacagaaataactacagaaacatttggtgcacaggcgcagaattgatactacaaaaataaaatgctaccaaatcaattgatagaacatgcaggggtacttccccactcttatttaattcattgcagctagcattttccctatatgaacttgcagaggctatcttttctagcaagagatatgctccttggtccttgcttcagcttgtctgcaataactgtattcttgtccaaccattccagtaaagttgaagttgtcaatatatatatcagatatttatcgtacatcatatactgatgtgcatattttgctatgcgggatcattttattcttgagcaaagtgaaaatagaaaatccaagttcagttatgcatagtatgtcgtcaggctcacatatgctatcttttcctaattatgctcttgtttatattttgttttgacagttcaaatgccccattcatattattttgttgagtggaacttagaacacatacgtgatagaattatgcatgtttgttcaccatcaatctagctagtttcaccttatccaaaaaaaagggaaatatttgttgtgttacattgttgctaccattcctttctaattgttttcatacagagttcttaagtggtggatagtgtatcatcaatattcttatactctctacatcgatcccataatataaggcacggtcaaacttggcacgatctccaaaactgatcttcggattatattctcatatactataaggtttatagcaaaaaaaaattataatcatatgaaagtagattcaaatgtcaatctaatgataatattttcagaaaataaaattcaattcataccatagtaattattgattaaatgttttaaaagttgaatcttaaaatacgtgcacaccttatattatgggatggaggaagtatttagtaatgtcatggatgcgtgtagggttcatctctggttctcacaggtccaagccgtgcaatcctattgatggaccctactgaatttgaaattgagctaagagtcaaggggacaagtccctccgaagataagatcttgagcgctgaagcatttgggtataatggaactgctcagagacatagatgtggctcactgcgcagtatgatgttatcaggagcacgcagcacattggagttcaattatgcacacattcctgtggcattggaggctacaatcagtgtcaggattacaggaggtttaactggtttctgtggaaagttcattgcacatactgctagtatcaaggaagatgtcatattgctggactctggggaagaaatggtggctatctcccatgatggagccattgatttctgccgcagtgtagttgcattggaaggaaatggcggagttctgactgttagtgttcatgcaaggcagagtggtgatgagaatatcatatgtgcttataaacattttatcccggtaagatgtggacggaatcatgacacacttgatgttgggttttgccagatgagcgttgaagttgcttggttgctcattttttagtattgaaaaaaaatctaggccatgacaatacttaatattcggtattagtagtggaagtaatagatgtgctatgtggcattgtaatatactaatactagaagataatccgcgttgctgtgggacatagtgcataagacaaaacaaagtgaaattctatggg

SEQ ID NO: 14572 - DNA, 3295 bp, Oryza sativa
  unsure (1)..(3295): unsure at all n locations
nnnnnnnnnnnnnnnnnnnnnnnnnnnnnnnnnnnnnnnnnnnnnnnnnnnnnnnnnnnnnnnnnctccttggtccttgcttcagcttgtctgcaataactgtattcttgtccaaccattccagtaaagttgaagttgtcaatatatatatcagatatttatcgtacatcatatactgatgtgcatattttgctatgcggtatcattttattcttgagcaaagtgaaaatagaaaatccaagttcagttatgcatagtatgtcgtcaggctcacatatgctatcttttcctaattatgctcttgtttatattttgttttgacagttcaaatgccccattcatattattttgttgagtggaacttagaacacatacgtgatagaattatgcatgtttgttcaccatcaatctagctagtttcaccttatcccaaaaaaaaagggaaatatttgttgtgttacattgttgctaccattcctttctaattgttttcatacagggttcttaagtggtggatagtgtatcatcaatattcttatactctctacatcgatcccataatataaggcttggtcaaacttggcacgatctccaaaactgatcttcggattatattctcatatactataaggtttatagcaaaaaaaaattataatcatatgaaagtagattcaaatgtcaatctaatgataatattttcagaaaataaaattcaattcataccatagtaattattgattaaatgttttaaaagttgaatcttaaaatacgtgcacaccttatattatgggatggaggaagtatttagtaatgtcatggatgcgtgtagggttcatctctggttctcacaggtccaagccgtgcaatcctattgatggaccctactgaatttgaaattgagctaagagtcaaggggacaagtccctccgaagataagatcttgagcgctgaagcatttgggtataatggaactgctcagagacatagatgtggctcactgcgcagtatgatgttatcaggagcacgcagcacattggagttcaattatgcacacattcctgtggcattggaggctacaatcagtgtcaggattacaggaggtttaactggtttctgtggaaagttcattgcacatactgctagtatcaatgaagatgtcatattgctggactctggggaagaaatggtggctatctcccatgatggagccattcatttctgccgcagtgtagttgcagttgaaggaaatggcggagcgttgattgttgatgttcatgcaaggcaaagtggtgatgagaacatcagctgtgcttccaaaaagtttatcccggtaagatgtggatggagtcgtgacacacttgatgttgggttttgccggatgagcgttgaggtttcttggtcgctcatgttttcatattgagaaaagcgtaggccctgataatattttttgcttgctgtgactgaagctgtttgctccacggcattgtaatatggccatgtttaatattcgttgtaaataaaattttcagtttatagctattgaattgtagagtagtcagttgctaagcacagcttcagaagaaatcacaagattagttaggtatacttaggttagcctgcaattgctagtgcatggtggaattataggaggattcaatgagccctgcactagtggtctagtggatgaaaccaacttttaggactgaattcaatatttttcatacttaaaccttgtatccataatagtttattttgtactttgtttgttgatctatatctgaaataactagaatagttccaatgtacattctctttcactctggttgaatgcagattgcatcctttgttgaagtcccttaacgaccacacaaactaatattgcactaaaagttaccgtatgcaatacggtaatactaaaacataaactaacaatcactattttatgaaatagtatcactgaaaccaacattttggtggggttggcaacgtgggaaaacgtagattaaggacacagaaaacaaaaaaaaaaacatcagcttatgattaattgagttttaattattgcaaattttaaatagatttatttaatatattagaacaacttagcagtttgaaaatcgtgctaattgaaactaagttagaatctgaatattactcaggaaagaacggggcctttgtgatgacaaaatttgaatctatgcattataatttcaacaagtatttcaaatttgactagttactaatacaatgcataaccttttcaaattagaatacaacttatgaaaatctaagacatagaaagaacctgtttgacggagtttaggattaagcagttggttattttctggattctatagttacaaattcttagaatcgggaataaaatctaggctgtttggggatctacagctagggagtttgattttttaggagaaactgcaaccgttataagctccccaaacgctccccaaactgaaccatactgagatagtaatgtgacaacattcttcttcttcttcttctttattaaaaaaaacacaaatctcattttacaatgtgattcattgggctctcccggcccaagggcccaagagtaaagccccacaaaaaagcccataactccaaccgaatctcctcacaacccaacttccccatctagggccagcgcactctcctcctcccctcctccgccgccgtctccgccgcctccagccatcgatcccggcgagccagcgaccgagcaggcctagccaccatccttctcgccccccaccggcgttcgccgactctgttcttgctgctgtctcgaggtgagtctcgccttcccccccccccctccctctctctctctctcccctccgctgtcccagatcccggataggctcgcgtttcttgattcgatggttgatggattttggtttgtggaattgtgcaggagagttgctgtttgatcggccatgccggacaacaacaacctcgaggatctgctgctgcaggcggcggggcggacgacgggggcggggaagggcggcggggcacgggggccgtcgtcgggccagggccagcggtggtcgtcgcagcagcagcagcgggggaggcgcgggtcgtcgtactccggcgggagcggctcggacgacgacggcggcggcggcggcgacgggggcgactccgacgactccgacgccgcgccgaccctctcgaggaagcggccgccgtcggggtcgcaagtgccgctcaagaagcggcaccagccggagaagggcggagggagaggtggtggtggtggcgggtggaa

SEQ ID NO: 14573 - DNA, 1428 bp, Oryza sativa
  unsure (1)..(1428): unsure at all n locations
cgacaaggagcagctggagaagatgtcggagctggacagggagatgatcctggcggagcgcggcgcgcggatcgacgactacaagctgaagcagctggcgagggcgtcgtcgtcgtcgtccaaggcggacaagtcgcggagggacagcagccctccgccgccgccgagccgcgcgcggtcgtcggccaggaccgacaggtccgccgccaagagcgcgctggacgagctgcgggccaagcggatgaggcagcaggacccggaggggtaccgtaacaggttcaaggatttgatcccgcagagcggctctccgccgaggcgcagggccggaagcccgcccagcgacggtagtaatgatggtgataacagggggaggatcaccgatgaaacccgggatgatgagtttgatgaatcgccaagcaggcttgaccctctgaagtttgacgatgtgaagagtataaccctcaggagatcaaagcttgtgaaatggttcatggagccgttctttgaggaccttgtgtctgggtgctttgtgcggcttgggattggcaagtcaaaatcagggacccctgattacaggctatgcatagttagaaacgtggatgcgaatgaccctgaccggaagtacaagttggagggctacacgacgtgcaagtacctcaatgttgtgtgggacaatgaggctaatgctgctcggtggcagatgactcaagtatcagactcctttcccagtgaagaggagttcaagaagtggctacaagtggctgagaagaatggtgtgcgagtaccgactcggcaggatgtattggagaagaaagaagccattcaacaggcctacaactttgtgtattcagcacatactgtacagaagatgctaaaagagaagaaatcagctatcagacgtcctatcaatgttgctgctgagaaggatcggttgaggaatgagttggatatggccattgccaggagggatgaagctgaagcagaaaggatccgttcaaagctcaatcagctgcagaagatgtcgaagccaatatcaaataatgagaaggctgccaagttggaggcgatgaacaagaagaaccgtgctgagaacttcaagaacgcatcagaaatgaagcccgttaacacgagtttgaaggttggagaggctggttatgatcccttttcaaggagatggacaagatcaagaaattactacgcagcaaagcctgaaggagagagcgctgaagtccccaacgggaacgatggcagcgcagtagctggcgatgaagatacgaagaacgggccgcgaggtggttcagcagccactgcagcggctctagtggcagctgctgatgccggtaagctggttgataccaatgcacctgtagatctgggaacggaatcgaatnnnnnnnnnnnnnnnnnnnnnnnnnnnnnnnnnnnnnn

SEQ ID NO: 14574 - DNA, 2338 bp, Oryza sativa
  unsure (1)..(2338): unsure at all n locations
tcagctatcagacgtcctatcaatgttgctgctgagaaggatcggttaaggaatgagttggatatggccattgccagaagggatgaagctgaagcagaaaggatccgttcaaagctcaatcagctgcagaagatgtcgaagccaatatcaaataatgagaaggctgccaagttggaggcgatgaacaagaagaaccgtgctgagaacttcaagaacgcatcagaaatgaagcccgttaacacgagtttgaaggttggagaggctggttatgatcccttttcaaggagatggacaagatcaagaaattactacgcagcaaagcctgaaggagagagcgctgaagtccccaacgggaacgatggcagcgcagtagctggcgatgaagatacgaagaacgggccgcgaggtggttcagcagccactgcagcggctctagtggcagctgctgatgccggtaagctggttgataccaatgcacctgtagatctgggaacggaatcgaatttgctgcataattttgagctcggtatatcattggccggcctggaagaattcggcggtcccaagggtctcttcgatggttacatggcgaggaagcagaagattgaagcaaccatgggttacaaggtccctgacaatgatggaaggaggcatgctctaactctgaccgtcagtgactacaaaagaagacggggtttactctgaacttctcaagttatctgtgcctctgcctgctgttcgatggattcatctgcctctttggccacaaagttcatcagctgatcggcaccatgccattgtgactacttgtccagatcaatttgcattttagccttgagtgtatgtaacatgatgagacaagcaaggttacacattttcttttcataaacaggacctgtatgcctgaattgtgttgatgacaatttccgcattaatatttgtggagtgagtccttctgttatttagtttgttacccttgttgctctgcataaaacatttatgcagcggatattgggagactagactaagaggtacaaatattctatgttgtatacttatatgccaaaaggaaaaaaaaaacatgtgtcaagttatgaaagttcctaatgttccttaattagttcggtctaaatcattatatcaatgttgattatcagattcttatttctatactacaaaatgtaaaaaagaatagcaatggccgtgatactatagcaaaatttctactggaagaaggcaaagcttgtgttgaataataaaatcttgtgtaagataaagctgagcatctgctgcattgcatctcaggaagcttcataggctggtctactcacgaaaggcatacacaaaaaaggcttaattaaaccttcagtacaaaaagctaataaagaacaacgcatatttgtctaggcactccaaattagacacaaaagcttggtaaatgtacacagcaggtcagattatttatgcttttcagtgcaagattcaagatccatgagaagccttattcatctcagactgagctggttctctgaatacatccttgtttgcaattattacagacatggaagcctcaaggtcaacagattacacaaacgtcagtatgttgaactggcactaatcgttcttcgctttgatgaacttcttgatgatgcccatcatctcacttccagggaaacgtccaaggcagccccttgcagcggcaatctcgttgaattcaaagacagaatcgccactgaaagctttgcgctgatcagacttgcgatcagctacatctatgttttctgccacatcttctccagatttaactgaaggaagcaggaaatcgtccagggggaagttgataacattgtcctcccccatagctcctacgaaatctctaagtcggcacaacacaaaaggaacgggttcaaaactgtggtcaccgtactcaactggagtagagtggtctccggtgacacaaaggaaatactggtatttcccagacttttcagcttcccacaggagccttgcaagctgaacgatagcccgatcaacagcctctaggcctagtaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14575 - DNA, 301 bp, Oryza sativa
tttcctttgcaggtaagacatgggtcagtgtttgggtttagtacagattgatcagtcaactgtagccatcaaagaaaatttcggcaagttagtgaggttctagagcctgggtgccacttcttaccttggtgcataggacagcaaattgctggttacctctcactgcgtgtgaagcagctggatgtccgctgcgaaacaaaaacaaaggtttactccaatctcgttctattttttctttttttcatgctttgctggaaagtgaacaatgagtgaagaacatatttctgttataaagtgaaac

SEQ ID NO: 14576 - DNA, 694 bp, Oryza sativa
  unsure (1)..(694): unsure at all n locations
nnnnnnnnnnnnnnnnnnnnnnnnnnnnnnnnnnnnnnnnnnnnnaacgatttacattaaggcgccgttacggatagtcgaatggagaccttcgaagtcgcagacagagctcctaaccaaccgagcacggtattggcattcactttattgccaaaacaaattaatattgaattttgaagtacttatacactaaccacacccccacttacattcacttacacaacacttacactataattacatatgtaatttattcacttacacggcacttatacaacacttacactataattacatatgtaatttaggaacttataatgtaaatacatgctgactattttttggtgaaaaatatggggccataaatatagctactccctttattttttgtttttaagggggaatcggatatagagttggatttttttagagacagaatcggacatattcttttttttttattttcttcctttttacccggtgtcggattcgtacagatccgattttttttcctttttttcgcccatttttttggtcggacaggtttaagttttttttttcatccgaatttttctggatcggatagatttggttttttcgccctttataatcggacagggtttgtttttttcttttattccgcctgggtttttttttgaaaattttggtttttttttcataaggtttttttgac

SEQ ID NO: 14577 - DNA, 711 bp, Oryza sativa
  unsure (1)..(711): unsure at all n locations
nnnnnnnnnnnnnnnnnnnnnnnnnnnnnnnnnnnnnncttactttttgccaacgaacggtacacatctttctcaaactatggagaattcattggatagctgtacgctgaaatttcctggttcaacataacaacagagtgatgatggggacataatgcattagttcccaacccatatatatttttggtgcctgcattgtcaggtttcaggcttggagatttgtccttctatttatatttttggtgcctgcaaacaaatataatgttacatggtagccgatttgttagcaatttacttatctgtcactgaatcagaaccatgagcttcttgagattgctaaacctgttacaatgaaagttctttttggttagatatgtagtgcacacgttaccggtgtccgcatccattgtctgctggaggtccttgtatatgctcttcatcgttggatccattcgcttcttgggtttcttcgtgccggttcttgttttcttggcattgctttgctcatggaggttcatgttttgttgatgcattggcatggtgggggatgctgcatcttagccttttgcatgattaatttcagattgtgcttttctttctagtgcagtgctggtgctagcatcttacaaagtcattaaactgtatgatggggggattggttcaattaagtatctcgttgattctcagagttattttttatatggaaaaaaa

SEQ ID NO: 14578 - DNA, 652 bp, Oryza sativa
gaatacgaataagaatcgaatatgatcggacacgaatacgtaaacatttttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaaatctataaaggtatattgaaggttatagagttagaaaaaaatggggtatgtctcatgggtcctgcggatatccgaatagcactgttcaccggatatccgaattattatccgtatccgacggaatccctgataccatatttgtattcgtatccgggagaaaatatccgtattcgtatccatatctgaactatccgagaattatccgatccgaaaggtatccgtatccgtttttgtccggatcggacggaaactatccgctccgttttcatcccaatctagcaccctcttgatcggttgttaggatgaggaaaaaaaaagaaattgtgcttagaattatctctcattagctggatctggtaacctctatttttttttacaaaatacgcaaatgatttacgtatttttgtataaagattaaaggatattgcctcacaaagcc

SEQ ID NO: 14579 - DNA, 738 bp, Oryza sativa
  unsure (1)..(738): unsure at all n locations
nnnnnnnnnnnnnnnnnnnnnnnnnnnnnnnnnnnnnntgtggaagcttatgaatatccaaatgaaggatctggttattgacgatttcatggtcagtaaatttgagctcaataatacttggatcaaagatccatttgttactgccactagaactgacagtctcacttgcagctgaactattcaaattaccaacatcctacccttgattgtaatttagaaactcagatccatttatatactatggaggaatcaattaagtgtgaccacctaggaccgcactctacttggtgttattacctgagtttctgaactatgtctccatgtcattagacaaactgattcagttattcatatccagatattcacttatgtccttatgtcgttaaataatgtaatacctttctaaatttgtagcaaagtctagagaaaaacagaacagaagtgcataacttaactttcttttggcttaacctgatgcagaatctgaacgtctgggttttccttagtgttcttcccctcctgtatgcccacaacccttcaagtaattgccaccagcagacctctatgcaggctgcagcacgccagcaggtatttttttattttggatatttgaatttttgtgcagatgtgaaggaatcagtggatagatctagcttgaatgtttgactatctgtcattagatttacacagaaatgagaaacacatgtagcctttgatgtatatgatgttcataggtca

SEQ ID NO: 14580 - DNA, 1044 bp, Oryza sativa
tgatgcatcagttgaatagaaaagtcgttcctttcttgttacaagtgtagactaatattttcatgtgcatcttggtggacctggagtctcctgcttcatgggatgtcacatgtatacctaggtttcaacacgtgaaaccataggtgattgaaaagtttggcatccttgtgtattgtccatgctaagttatttctaaccgtagaccagataagttctgttcaccagagatttacaagtgctggttgcttcctagggggctaatgtcaaaagtcagtgataattcatgttttgtgctgtagatatattggctttgagagcttaattatgttaatttttttattgttttccagcttcttgtcagtgaggttagcgagcatttagattcacaaatgagcctagttgccaatctactctccttttttattgctcatccagtaggagcactttttttttgtgaggacagtgggagcatccagtagaaaaaaaacttgaagtaatctgtttaacaaagggtctgaatgtatatttgtcgcattgcaatcttgtgttcaagcactcaaaagttttgagcgaactagcatttgtttgagcaaagtaaaaattgttagtttgatgtcatatgttcatactttccagtttccactgtagtaccctcatcatcttctgtgcatatgaatattccagttacaccagcaatttgttgatgtgcatttcaggtgactaatgtaatttcgagacggagctcagtttccttcaacagccagagaataagttttatgtccattcgttcaaggccaagtcagcttcgttttaagatttgctgctcggtatgctaaggttttctcctattagcaattgttctaccaatgtattgagtttatttgcacatttttctgttatgcacatgtgttcttcaaaaccttcataggtgtctggagcaattgtttacctattcaaactagtttagattttggaatatctagtgaatcagcagtaaatagatattaaataggagttcatcttgagttcttggcatgggtcttt

SEQ ID NO: 14581 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnncaatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcctaaggagctcctgatcattgtagtacagctaaaaacgtactgcagagaaaccgaaaacgggaggagaaaaaaacagcaagtacgagaagggaggttcccccacttgagtaagtgacattggattaggccgatccttctccctcacaagagacattgttgaaagtacaggaagtaaaaggtcatcctctcccttcaaagact

SEQ ID NO: 14582 - DNA, 735 bp, Oryza sativa
  unsure (1)..(735): unsure at all n locations
nnnnnnnnnnnnnnnnnnnnnnnnnnnnnnnnnnnnnnnnnnnnnnnnnnnnnnnnacttggtaatcaccggcaccaaggatacggaggtcgcggcgttcaaggaggagatgaaggctaccttccagatgagtgatctggggcctctctctttctacctagggattgaggtgcacccggatgtctccgggaacacgcttcgacagaccgcctacaccaagcgcgtcgttgagctggctgggctcaccgattgcaacccagctctcactccggtggaggagagactgaagctgagccgtgatagcacgacggaggaagtggatgctacacagtaccagcgtcttgtggggagccttcgctacctcacccacacacggccggacttggccttctccgtcggctacgtcagttggtccatgcagcgaccgacagcggagcaccagcaggctgtgaagaggatcatccgctacgttgcggggactctcgaccacggtctctactacccgagatgtcctggcaaggcacacttcgtcgggtacagcgacagcgaccacgccggcgacatcgacaccagcaagagcacgagcgggattctcttcttcctcggcgagtgcctcgttagctggcagtcggtcaagcagcaggtggtggccctgtacagctgcgaggccgagtacatggcagcctctgccgcttcgacccaggcgctctggcttactcgactacttagtgatct

SEQ ID NO: 14583 - DNA, 125 bp, Oryza sativa
ctggtcgttgcaccttctctctcttgacaacaatgacagtgctaacggaatatggcgtggtggcaatatatagaaataattcttcattaggttagggggcaacaagtacaggtggatttgatagg

SEQ ID NO: 14584 - DNA, 1009 bp, Oryza sativa
aggtcccacacacggacgtcacgcgatgccgcgatctcatcggatgattttctctgatcacgcgatcacagagccgcgccgccgcgggcccacgccacgcgcgagcgcctgcgcgacccggcgcccccatgccgcacgcccagtcccacgccgccacgcgcgacccggcgtcaccggtcatccacaagcttcatcgcaacaacatcatcatcggtcgcccatgagattcgttgttgctgctaccgcttgtctgcgaggttcttcgccgccaccggtggtcgtcggcgtggttcatgggtaatttagtgcaatctattcttatatatgactcgtactaattaagttttaccattttgcaggttaaaaaaagactaggcacatgagttctctgcttttagagacctttggtctataagcctcctgatgtcttgattcatctaatggtggttttcactgtcacatatgagcatgatgatccaatcatatactttcttttaccaggtctatccaatggtcctaattattgcagctaacatcgctcatcctcctttcaaaagctgctttggctgtgtttttttttttggaggggttgcccctcccctctgcacgtaaaatgatggagtgatagattaacgtatgattaattaagttttacattgtgaaacggagggagtagctataaaaaaattaaaaatgtattaatatgattttctaaaacaactttcctatataaacttcttgcgaaacttaaaaaacaagaaagataagttgggaactcatgagaaagacagccgtacacttgtctgtctgtaaaatgtgcctcaaggacaaatgtgccaacagtatgaagagttgcattcctacacttgtctgtctgttcagaacgaaagtacgttgattggcacattcaggatcgctcttccaaattcagaagcgccgcattacacatcattcttcttaaggagctcctgatcattgtagtacagctaaaaacgtactgcagagaaac

SEQ ID NO: 14585 - DNA, 587 bp, Oryza sativa
gggaaaaggaaagctcaagcggaagttctcgcaacagaatacgcggaccctcccaagcgcccagacccataaggcagcgacacaaagaaaacatggtgccctatacacaagtcggacatacactctctagaagattgcctcgtcttcaaaaagtcgctcgcaaaacacatggcattggaaaaaggcaagcgagtacgcgtggtcgagaaggacgctgaggcaactgctcaggaatcggactcagcatacccagactctgatctccatgtctcgtacatctttggaggttccacggcatactcctcaaagcgagaatacaagaaagtggaacgggaagtttgttcgacgtggcaaggagctgtgcccaaaatgaagtggtctgagcagaagatagaattctcagaagaggaccaccccaagactgctgtcatcccagggcgatatccgatcgtggtcgaacccactattcggaatatcaaggttgcgcaagttctgatcgacggcggcagctcaatcaaccttctcttcgccagcaccttggacgcggtggggatcccaagaagcgagttgacacccaccgatcaacc

SEQ ID NO: 14586 - DNA, 883 bp, Oryza sativa
  unsure (1)..(883): unsure at all n locations
nnnnnnnnnnnnnnnnnnnnnnnnnnnnnnnnnnnnnntattgatatcgtaaaaaactcaattaattatgtactaatagctttcttgtttttgtgtaccgtatttaacaattatattcatcactaccggtgtggcacgaattcgatgtggcatgtgacaacaaagcacaccagatccaacgtgggataggagaggttgacacgtcagatgatgacattgtgagagcatgtttaccatagtaccataataggctcatgtatcatagaggtgtgaaaaccattacattcacattgttgacttattgtaagacaagataactgattttataaagataacgcttctagctaggtttgaatgtgtcgatttttattagatttgtagtatttttctattattaactttgagagtaaaactttcatgatggattgtttttagaaatatctctgttggtggctgtttatattcgtagaactacagccgcctaatgcttaccttgaagggaaagaggcgggctatgattttcttatccaattaaccccacagccaagctaagctatttttgtaacctgttactaccttcatcctgaaatatgagtaattgacctataaatcaatcatgcatccaaatcttatcaccgtcatagccatcgaagccaatctgataaagactacgccacactagtaagggaatattcaatatggggcatccacgaaggttgtgacatctaggatgatgtcattgcattccatcctgaactaggttttacgtggagagctcaccttgagacacaaaggtgatagagagggtgaacaacatctgaaagaaaagtatgtgccatctatagacgtcacgaatttggtgctccactagcgtggcaccctt

SEQ ID NO: 14587 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnattttgtactctaattagccatattagatctgtaaaccatcaatatttttcctaacaacaatgctattaacattagcgttcaaaggcgagtaaaaaaactttacaatcacattacataatcaagaaatcaaataataatttcatataactagactagaacaatgcttaagatgcgaaataagttttatgctatgatttaatagtcgttgagacttatattactcatagttttatgcttaatttacgggtttttcaaccaagggttgatgggtacgggtgggtaaagaatggacctatacccacatactcaatgggtaagagttctcgtccgttagtagacccataaataaagagttagaacatgattagcttctaataaaataaaagctcatagggtgtcgggtcataggtcccattaccatctctagtcatgcctccccgtcatcgtcgttgcagctccattggccattcgccggcttgatgccccgatgaggaatctgctggaatgagaatggaaagaggagaagaccgtacttgttgcggggaagacgagatgcccgtttagaactcctccaatacccataaaacggagcaaatccattttcacatgattaattaaatattaactaaattaaagttaaaaataaattaatatattatttaaaatagtagaaaaggttttataaaaaaatacat

SEQ ID NO: 14588 - DNA, 900 bp, Oryza sativa
  unsure (1)..(900): unsure at all n locations
ccttttgttttcgtcatctccccaccaaaagtctcttatcattttgtatattcatcacacacagtagcaggcaatttaaatactcccataacatatgtcgggatagcctgtgcgactgatttgattagaatctctttagccccagacgacatatatttttcagaccagtcagtgagcctcttagcaaaacgttgcttcaaagttttgaactttccagccttcatcctaccctccagagtaggtaatcccagatatttcgtctcaaaaacagttgattcaacctgcaaagcctgtcttatattctcccgtagctcatccgggacatctgcactaaacaacagagaacatttttgaaagggtcaattagccctagaaggggagtgaataggctaatttaaaaacttaagtaaagcggaagcaagaattttcggaactaagcaagaatttttggaacttccgaaaatactcagagcagtcgaacaaaagaggataactctagatcaatagcggcacaagcaagcaaagctagaggagagggatgaagaaatatcaccaagatgaagctcacaaagttgttcccggagttcaaatccttaagggggattctactctctattgaagagctcactaagagccgggtcttagctaaccctttcctcaagaggttgcactaagcacccctccttccactaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14589 - DNA, 640 bp, Oryza sativa
cctaacaagagatacttctctacttttctaacattctacgcatcttctaagatgcattagtaattaggagtatgcaattagcatcttacagtttcttcccactgtccatatttagcctgaaacagggtgaagcaaacaattttgatccgtttgtaatatctggtgaatatgtttcaggtcagaaaccaatcaggtgaatggatatatgccaaaccaatcccaggaaccttcgtctgcaacatcggtgacatgctgaaggttcttttcttcctttgcagtttcactgatatctttatggtcatcaaacatgagacgcttatcaattgtcttctttggttaggtttggtcaaacggaatatatcagccaacacttcatcgagttgttaacaactcccctcgctaccgtgtatctgttgcattcttctatgaggtatgtcttgcttaatctctagtctcaatcctacacatagtttatgtgaagttgatttctcatgttctttcttttctttctgaattttgaatgctacagtcaaacttcgatgctgccgtagagcctgttgagttctgccgggagagaacaggtggtgttgccaagtatgaaaaggttgtgtacggagaacacttggttcagaaagtcttg

SEQ ID NO: 14590 - DNA, 680 bp, Oryza sativa
acaggtatataaaaggtatagatagagcaattgatcaaaagaaacaaatatatctttgtttcacacacaataagataatcatattttagaccccctacaatcaaaaccaatatggtactcctcttagtgatacgagtaaaacattaatcatgaaaaaacaaacaaactcttaatttagtagcatacaccaaacttcaatagaaaatgtgagtgaagatgttttatggtattgcaagagctgtacgtcaacatccttcacaataacccataattcaccgtctcatcagaacttagatcagcaaatcgtttcacttcacatttgggacaaacaagaacatatgtgtattgtcaaggtaatacaatgactaaaatatatcatattttcttaatatatcaaacttcaagtaaaagatagatacccaccaataaaattatgaaagctttgcccaacaatgcaatacattatatcaatcacaatcaagtagaagtaaacactacaaatagatcagttgcatggacaaacaacatgtcatggtcgagatgacactatctgagaacaacatgtcatggtcgggaagtatagttagatgcagcaaaactaaaaacttacatcgctgcttgagctaatcccccaaaatgaacaattgaagctaacatgggccccatggtagatttgatat

SEQ ID NO: 14591 - DNA, 776 bp, Oryza sativa
atgcttcccccctcatgccaatgcatctttgtacaacactgccaaagcgaccactgagctgtcactgaagagatgtatcgagcagagaagagagggggaattaatgggctcgttgttagccattccgctgttgacatgttctcgatgacaatcattgagaattcaagacaccgtgatggttctatatatagaaataaggcctttgaaggacatttctgtatcactaaccgcgatgagagtaagtgatcaaaaccttctccttctttttctaatttgatatgatttgttttagtactaataaatataatatggattctggtaaccaaaatgccaagtaaatttgttactctaactacaatatgatttctttatattttcttctttcctactattgttttcattcgtatgtgcaatcaatccacttaggtgaaatccaaatattgttgtaattctagccgatcctgctgctcattatgtatatatctatggttcaaacataccatctattatgtaactgcctaagacgggtcatttaggtaccagttactggtcggcaggatattaatgtaaattaaaatttcaattcttaaatttaccaatcaaaagtttaaatttttggaggttaggagaccaatatttttgtgaataccagttttcaaaaccttagctgtactgcagcataaagcactaaagcatcattcatatctctccaaaaattatactgatccgacaaaacaccttacaaatataaaattaaaatgtaatagctaattagt

SEQ ID NO: 14592 - DNA, 674 bp, Oryza sativa
tacggtgagaaagatgaagttgtggagatcgtggatcctcccggaatcaacttgacatcattataaggaaaaaaatccatcttgcctccctcaacctcaactgtagcctgagttcgctttacatcccttaactataaaaccaagagactacctcaactattaaaaccaatgcatagtagatagtttgcataatgatttcatccgacatggcactttgacttgttcatggtgatgagtcagtttataggacccacctttcactgaaccctattcatatctctccatccctctcattgccctctctgtgcatgtccaccaccacaacctgcacatcgggcatgttcgttaccgacttaccgtgatcccttacatcaccggcaaagcagcctccaccccaaaagccacacaagaccatatcgcctagagaggaagactatgataacgaggatgacatgccaccgccgccagtgcgcatgagcctagagtcctcgttgtgtcagtcatcgccatcccctcctccaacgtcgccactacctccgcccactgaaccaatcactacatgtcgcgttgggtctagggaaattcactggcggagcagacactgtggtcgtgcatgtcttcctaatctacttcttttcgattttgctatatatttgtcgataaattttccccca

SEQ ID NO: 14593 - DNA, 1080 bp, Oryza sativa
ggtgaagtaatccgttgcaactacaacgaacctatgcccctttgatgacgaaggataaatttgaccaatgaaatccatagcccaacctcggaacggccatggtttgatagtaggattcacacggcggcaggcaccaattgaacattgccgaaccgttgacaagcctcacatcccctataatatttgaaacaatcttcaatcatcctcggccaatagaaccccgctcttctaagcaaccaattcatcttatgggccgattgatgagttccataaattccttcatgcacctctcccatagccactttagattgatcattatctaagcacttcaactgcaccccatctatatttcggcgatataaatcctcatcaagcaatgtatatttaaacatttgccgccaaatcttccgatcaaccttaagtgtagggtctttcaaatatttaatcaaaggaattctccaatcctcttctgtatcctgggcacaaatgtccgaaattacaattagttcggcctttgaatcaatcgggacgtgccccccaaccttctgtctagaatcggtcagaccggcggcatacggccggtcagaccgcccgggttggccggtcagaccggcggcatacggccggtcagaccacccctagtcaccggtcagaccagccgtgcaacgcaggttagaccgcccccggtctgcatttttgccaatttcacccaaaggtttgaaatcaagcaccggttcttctaatataaaaaatactcccttcttcacattataaccatatgcttgccatgctaaatgatgtgaccatggctatcattgataaaaccattgctcacatcatggataaacaagatgataacaagatcaagtccttcaattattggaattcaattcggccacctgctactgtgctgaatcaaatggccgccaaatgtgcatacgagctccggtttgggtccatgagtacttgatagaaagctcacggagtcgtctttgcaacggatctaccctcattgccaaattccttcttagtgggctgcaattgcagaaacaaggggttgcgtcacctataatgggccaa

SEQ ID NO: 14594 - DNA, 30303 bp, Oryza sativa
tacaactcaccgaaagatcgggccaacaacagccttgagtctctcgagtggagctcagggttcatcaggtggtatcagagcttttttttgctcagtgttctcaaatttggtcgttaacactactaccagaaaatagccatacaaaaaaattgcatcctatacctagccatatttgtgccattgcattgttcattcagtttttgctttgttgagttttgcgttgcattgtcgagtcatgttgctggtcttagcgtttagttcgtttagagtttcaggttctggtcacgttttgtaccactgtcgtcgtcgtcgtcgtgtacttgttatcgttgggacctacgaaaatggaaccgccatgctgccagggttctatttttctagttttcagaagtttttatcagtcggtcttagagttgctgagttgcatctggggtttgccgtctgcattcgcctgtgcttgttctgttcacacaaggaagaggatctgttgcgcgcggttaaggagaaaggaaggatagcatatcgctgttgcgtgcggttaaggagaaagaaaggatagcagatcggtttctggactttgtttccttccatgcgtgatttccaaatttatagccgattcccaccccctcgcgtgcggcttcacaccacctctacaagccgagtgactccccactctcctctcgatttcaatctacaccgtgagttgctagagagcttggtgacaagttttcgattgtcggattggagatccgtttgaaaaaaatggaaccagtataaattcagcattccatttttgtataattttaattttgggttcggacttttgcatttgagtccttgtaaatttttatatttacgtttgagtccctgtaacatcacattgaggtccttgagtctgtttttggtaaaaaaaatcaaaaaaagaaagaaaaaaaaggcaggaaggtgcataaaaaaagaaatgaaaagccgcaccataaaagaaaagaaaaataaaagaaaaaaaagaaagaagaaagatggaaaagagaaaaatgagctcttatatttgagtttgctttagtatatcagagtgtgcttgagttgtttctggagctatcttgtggtatcgtctgtgtctaggatcgcgtctctagtacgttctagcctaggaccagtacggtactgactttgaatgattattcaattttgtattatctgatttgagcatttgctattcctttgctacattttaagcctacccagagctccacatatttgattgcagccgtatagcaagtgtttgccaaggtatcgatacatccaaactccattgggatgcttggccgagttggtgtacgtcaccattccgcttgctttggtaagaacttggtaaaaagcttgagtgtgtgtgatatcggagcttccactacctagtagttgataggagcgtgcatattcttgtgtatgtttcttgtttgctattaaccatgccaggattgcgcaaggggatacgagatggtcatgctcaacatcggcttcttcaccatcgacgagagatgccaacttctcgacaagatgcatatgaggtacctgactataattttgcatgagttgaatctaagttaccattctacaatggtaaatacgattatgttgcttatattgattgggagctagcagtagacaatgaatttgataaatatgatttttctgatgctcaaatgattaaggctgctagtaataagtttacctctcctgctctcttttggtggagttatgtgagtaacaaacctgaaacttgggatgaatgcaaaaccttgataagaaaacattttgtaagttcttattacaaatgtcttcttcatgagaaattagaacatctgaaacacaaggtgagagtacattcatgaattcaaagtttgcattatctacagtggtctaaaagaatgcaatgaaaacacaatgcgtagatttttcaaagggcttagttctgaagttcaggttatgcttgctaatgtgaaatataatcatattggacacctattcatgtttgctcgtagcattgagagtcagatcatatcaaatgcgagaaagtatgaacaatgtgatttatctcctatttctgaatctcctatatcctgatgcaatgatgatgtgcaaacattggaggagcaatcttttgtctctcctgttactaacattttgcaggtaattcatcacattcaacaaaagagggagaatggtgtacttgagaagaaagaggatgaagcacctgtggtgtctgaagaaagtttgcaaggtaaattaaatggtactgagataaataaatgtgagtattctcaagctaagctacacatgtctatttttcatgctatagtagagcagccattagtggaaccaattgctgagatgcctttgtcacaagttgatttacttgttgttccttgtgataaagaagagtcgtgtgataatgcttcacttacatgttgtttctagtgtttctttgtgtgccgattttaagcatgtcgttcacattgctaatgaaatagaggaacgagaattgacatcttctttaaataattcgggctatgttcagtttgatgatttttgtgagctcgatgatttgaaggagaaggggaggatgatgtgaccatggctaccattgatacaaccattgctcacatcatggatgaacaagatgataacaagatcaagtcctccaattattggaatccaattcagccacctgctactgtattgaattcaaatggccgccaaatgtgcatacgagctccgttttgggtccatgagtacttgatggaaagctcacgtagtcatctttccaacggatccaacctcattgccaaattccttctcagtgggctgctattgcagaaataaggtgctacgtcacctataatgggccaaattgcttgtaacttcgtttgggacccggcctaagtggggcccatgtggggtgcgccccaatcagttggagcacgaccctagggtccccttggtcatcctcccacctccataaatagctaggtaccccttcaagatttcttgggttttgtttagattaaagtttagctttgatactttgccgtgtaatcccgtgatcggttagatcgctggtttgcctgttacggaatcccaacttatcatttgtattcaattcctatctgcaattcagattgcttttatcttgttcttgcttgtttattcgatttccttgcaggaataaggttgatctgcaccggcaagatcaacaacccacggagaggtgtatcgatcgctaaggcacaacacaacaacgttgtgtacggttgtagtcaggtcgtcaacgtttctctcaaatcgtagttatctacaactcaccgaaagatcgggccaacaacagccttgagtgtctcgagtggagctcagagttcatcactaaatcatttgctctagaattatcacgcctagcaacatgtctaatagcaaaattatataaattggcaataatatccaagcattgatcaagatacctatttaatgatccgtacaagcatttgtaagccccggcaacttgttgcaccaccaattccgaatcaccaaatgcttctatgtgtttggctccaatcatctccatcacttgtaagccgaataataaagcatcatactcagcttgattatttgtataataatatttcaaacgaaccgatgcctcataacacatgccattaggtgaaaataaaactacacctataacttgaccctatttgcaagaagaaccatcaaaataaatcttccaaggtataacttcaactaagcaaatctcttcatcataagcaatatcgacatgatggtctactataaaatgtactacaatttggcctttcatagatttcaacggttcataagccaaatcatattcaatcaaaacatatgcccacttgccaattcacccacttagaattggcctttgcaacatatgtctaataacatcggcttgacaagcaactatgcatatactagataacaaatagtgccgcaatttggtacaagcatagtatagacataaacaaagtctctctataaagacataccacatttcagcatccaaaagacgggactcggattcagtaacatcgctatggcatggcacggtgtgacattggagaaatctggagcgttgaaatctgatcgaacggtccgctgcgccagcccacctgcagcctccgttttcaacccaagatctccgttcctgccgcccgacgccccaatcccgcggctcgcctcaatccacacgctccactcccgccgccccgcacgcgcccgcaccggacgccgggccgtcgccgcgaatagggaggcggccaccgccgcgcgagctgggagcagggctgccggcgtagaggtcccagacggcgaccagcggagagcaaggcagccgccttgtcacttcgtctcccgtgcccacgtcagcccgccaccgcgccaggccggagagacgccaggctgtcgtgccgccgcgagtggggaggggaccgggtgaccgtgtcgtcgcttcgcctccctcgcccgcgtttggccgccgccgcgaactagatgggagccggcaaggcgccgctccgccgcaagtggggaggggaccaggcggcagccgtgcgaggccagggccggggccctgccctgccaccgtcatccttggcgatggaggcagccggccgtcggggtgccgatggaggcgatgggatttcatgctgtttagctatttgttttccaaaattgttgtttaggtgtttgttctctatctccaagattgcagcagcagtagtttagctgtttgtccttctgcttcatggtgtacctgaacctgattaccttaggctgtgcattgtcctgaaacaataatttgttgaggttgcactgtgttaaccattgtggttgataaggaagttgtcattgctgctgggagaatgattctgtaatttttttgtgagcagcaacacctgggaaaattgagagattggtttggttgtatgacctatgctgtaatttgaatgaatcaatggatgaataaatcagtaacttgtgtgatgttattttctgaaaaatttgacagcatgtccccataattggtggatggattgagacaacacagaaagagataaacagccatatagaagttgataaacagccatatagaaacttggagcattcagacatcacagatagcattaagacatctctcatataacattcagcccatttctctttcaccttgtaaatgctatctaaccatgtttgcttatgaactttggatctcataatctgaaatgcctcttcaaatgatgcctcatcttcatggccaaacatacaagcactaaaatcagagagaacatgcgattcctcttcaccttcgtcttcctcttcaccttcatcttcctctttacccttcactggagataaatgcttcacagcattctgcattatgtgaaaggtgcagagaccatgatatgattctgtgaatactatctttatggcttttcctattgctgcatcttgatccgtgtaaattgttttaggttgctttccattatgtgcaggtagaaaagtctcaaacaaccatgtaaatgatgcttctgtttcatcaaatagaagtgcagcaccaaaaatagtggtttctctaaactgattgagcccaagaaaaacaccgaatggcctatattctttgtttgtgccaaaagttgtgtcaaatgtgacaacactcacttgcaatcctcctctgcagatgcttggctcactctggcagccctcctccccgaaatcttggcggcagggcaggggcctcggcccccggcctcacggcggccggcctacctccccaatcacggcgaggggcacgcctgcctcccacctatccggtggcgacggcggggcaggcgctctggccccggcctcggctggttggcgtgctgcacttccccggcgccggcaaccctgctccaagcgggattgggaccttcgcgggattggaactctgccggcagccctgctccggtgcgggattgggacctccgcaggaccgggcgcgtgcgggacggcaggactggagcgcgcgtgtgggatttgggcgagccgcgggattgggcattgggcggcaggaaacggagcgcttgggggtgaaaatggaggctgcaggtgggccggcgcagcggaccgttcgatcagatttcaacgctccagattgctccaatgtcacactgtgccatgccatagcgatgtcaccgaatccgagtcccaaaagacggatatgtaatgatatattccttaccatcttcctcttgtgtcaaaacagcaccaatgactttgtcttcggaggcaatatataaccgaaacggtattccggctttaggcgcccgcaccacgggtggagtagacaaataccttttcaattcctcaaacgcctcttgttgttttgcccccaagtaaaattggcttcttttttcaagcgaagtatagggacaaaagcatcgattttaccagctaggttagatataaatctcctcaaataattcaccttacctagtaacttttgcacctctttcttgcatgtcggcgctttgaaatcacgaatcttttctatcttcttaggatcaatctcaactcctctctcatgcaccataaaccttaagatcctccctgccgacataccaaaagcacacatgagtaggttcacgttcaaaccataccggcgcatcctttcaaaagctaacttcaaatcggctatatgtccctccataccatccgatttgacaacaatatcatcaatatagacttctaagatgatacctagaaaatcatggaaaatcaaattcattaccctttgatatgttgcacaggcgttctttaatccaaaagtcataaccacccactgaaataaaccaacaaatcccgggcacctaaaagccgtcttgtacatatcctcctacgccataaagatttgattgtagccggcattaccatccaaaaagctaatcacctgatgacccgaggtatcattaatcattatgtcagctataggcataggatattcatcttttggagtagctttatttaaatctctaaagtctatgcaaactctaatcttaccactccctttcttctccaccgggactatactagatacccactccgcataacgacatggcctaataaaccccgctttcaataaccgataaatctcctccttgacccggtcatataacaaaggattgaaacgataaggtgcttgtttataaggcctaaaacccggtttaattggaagctgatgttcgacaagaccacggctaagacctggcatctcatgatactctcattcgaagcaatcaacatactccttaagtagctcgattattttaaccttataatcggctgtcatgtttttgtttacaaaagtcggccttggcttagttccatcacctatgtctatttcctccaatggatcggccgatgtaaacccttgaccaaccttttctacttcgtcaaaatcttcaatagtttcaccaatatcgttctttgtagatcgatattcttgcacccttttttgcaaccactctaaattagcttctttactcattacataaagtgatatggccttgtcgtgctatgttagccggctttacagaaataggtacaaatttgccatcagaaacactaatgaaatcatagctagaaagatccatccccgataagcattgaatattaccgtgacgccactcaaatgttgcatcggccattgcaacctcggccgatgtatccgcttgaacaatctcaacatcatcgtcgtcccattgaattaaacattgatccaaggtagaaggcgcacaataattggcatggatccaacaacgacccaaaataacattgtagttaccttgcacatagacgatgaagaaagcggttggacgtcttgtttcccacgataagctccaccgaaaagataccttttcgcctccgttggtcttctttagctcatcatctccacgccccaacttcttgaacaacgagtacggcatcaaattcacggcggcacctccatccaccaacatcctagagaccggcttcccatcaatatgacctttgagataaataggcttcatatgacagtttgactcatcgggcttctcaaaaaccgcatctttaggacctagtgaaaattgagcaacttctgcttcatccatagcacaaaaatccataggcaacatacacatcatgttgacatccatgtcttcctttggatatgattcatcaaccgattgttcttcctcctccttttgcacaacaaccaattcttcaatatctatggacttacgcctccacatctttgtaggcggtggtcgcaactcattgaaccttctatctctttgctcttcggcctctctctctctctcttaattcttgggcctgaagacgttgcaacctcctcttttgagcagctgtcaaatccttaggcatccaccttagtttcggctctgttccagaaggtaaataatgcccacttttgattttactcgaagacgatgaaacccccgaactaccctttgaaattctcccatcaaaccggcgctgaagcccggtcagaccggccagaaggcccggtcagaccggcctgcgacaggcggtcagaccggcctgaaggcccagtcagaccggcctaagaggttggtcagaccggctgactgcgatgagttggttctggcttcgaatttgttgcttgaagactctccaacctcatgtccagaaggtattagcacatcatgagaccccactttgatagtaatcacttctgaagtccttgtctccaccttgatgcgctttccttccctctttccttcattgacctgatttttagcataaaactaaccattatttggtgaagataaacgctcacgagctggcctccttggtcctccccatccttggttgtattacattggaggcatatgattgaacattggcggtattgccccccatggcacgtagtaaggaaaaggataacccggcggcggcattggataaggcccccatgacatgtcttgagaacgatgatatgtaggtgattccgaacgtcttggtgaatgaccaaatcgctccctaggagatgatcttggtctctttcctttattgcgagttttctcaccaccttgcttctcatacttgttcaaaagcataatgaaggtcatcttagtcttcttaggagctttggaacttgaagcctcactcctattctccttccaaacaccaacttctggattctttggcacaatcatctttggcctaggctcttcactgaccattcctttccccttagtagattcggcttgcttcggccaaatcaacaccttcttatcattgaaattaattgtattcgccggaaaagcatcatgatcaagcttcatcttggaaccatcggaaaatttcaatcgttcttcatctatggccgattgaacctatcgtcgaaacacatagcaatcattgtagaatgagaacgagaatcaatttgtttttcttgtaaaagataatcaaaaatcttatcacatttggccacatcaaagctatacttaatctcactttgtcgatctttacaaggagtcggcattaaattagaacaaacaaaaggcttatttttattagttcatgaccactcggcaacatacatatcatgatcaccctcattattagaatcactagcttcagggtaatcaatcaaattaacatatgatctaacaaatttcttactatctttaattcggctttcctgagccggagctttttccatgagttgactaacatcaagaaattgttggccaactaatctttccttaataggagcaattaaaccattaaaagcaagatcagccaaatctctatcagttatattcaagctataacatcggtttctaacatccctaaatcccttaccataatcaatgacagattcattgtatttttgcctaaccgatgtcaaatcacttagcctaagttcagtttcacccttatagaaataatcataaaatctttgctctaattgaggccaagtatgaatagaatttaccggtaaagaactaaaccatgtaaaagcagtaccggacaaagaaaaagaaaacaagcgcaattaaaaagtatcggaactactagcctctccacattgcgctaagaattgacctacatgctcccacgtggtcctactatcctcaccactaaatttggtaaatttgggaactctatacccatgaggatataggatattgtcatagtaatcaggaggaggcttttggtaaaccttagcaggattcccagcttcaatcccgaatttatccctaatgataccactaattaattcctctatattctcaagcctatgctggtttggtggtgggtttggtggtctaataggttgtgtttgcggcgcaatataattatattagctatatctagtatcgggaggacatcccctagtaggatcgttgtaagcattagggatatgtgggggaatttggggactaacagtagatacggggggattaggtgctggaatatggtataaaaacccattgtttgtcattggatctaccccctgtataggaataattgcgccggtctgaccggtctaggacccagtctgaccggcgtccagaggcgcggtcagactggtctgaccgccaggataaaacccggtctgaccagccgttggcccggttgaatcggctgtgtgcgtagcccacccttcgcaggttgtttgcatattcgctccatcggttttactatatatttgatctacaggaggcttgctagtactggtagaggctttatctttgaatacaaaatcggctatgacagaaccgagtttgttccttatataatcatcaaaacgagattcaatagatgcatctaatttagtatttaaagtagcaatggatgaatctattgtactcgctatttgttgttggatagaagttgatacctcttcagtacttaccacatcgaaattaggtttaggcaaccatcccggcttgagaaccacaccttgacgggtcctagtgcacgtcttcatcaacatttcctgggtatacgccttgagatgttcctccatggccttgagtgctccctcatcaagctccttcaatgtgattggtatgacattggatggttccacctccgccttagttgatggaggctttgttatggcgacgtcaaagctgagatgacgttgagcagatttccccagtggagtcacaaaaaatcgtgttggcaactttttgtgacaagttgacaaacatgatcacagcacctaaagctttgcggtgatagtagagtcgccaaccacctcaatctagtcaaagctaaatcaagatgggttttgataactaaaccggcttgcagagccaattctaaatagaacgatagataactacccatctcgtgggaaaaacggaaggttttcaggacaaacttaaaaagaggtgtcgcactttcgcagcggcggcggacgatttacagcgcaaatcgacaaagatggacaaactaagcaaaaaactaaaagcaatatgaaaaacgattcgattgattgtttgtagaatgaaccggccatgtcccttatataggggttggtcttgccctctacaggccctcctccacgtccaactagggatagaatccaaaggaaacccgaaacatgccttcccgagtaaggaaacctcgagacccgatgaaacagtcccagactcagactctgccggtcagaccggccacacactgccggtctgaccggcctatacatggcggtcaaaccggcccaaccagagaaaaaccggcagacttccaaactggtaattttccctattttatcccttggtgccaaatttgggggtaaacaccttctttcctctcttcccctgattccccgtccaaatctctctatacagcttctctccttggtcatccatgcccaaccttattcatcgggggggatttacaattatgacactgcaaacattaacttttgctataatgacactggacccacatttttatagacacagatggacccatttatcatccactcggagtgtcaaaacagcgaagccccaatgtttgcagtcctagctcctctcccatcgatgccgtcgtcggctgctgctcccaacgacgacgacgccaaccgaaaatcccaggttgggaattccccaaccccagcgcccttgagtgaagcatggctcgcaccagctgtgtctccccaagctcctcctctctgatccccttctctacctacttctgtaatgtgatttgaatggtgttcttctgtgtggtaacatgctgtgaatttttattcttgaactagtcctaatgaccaactagatagtgttatactcaggattatactgctggctctagggttctaaatcaattgatttactatagttggatgatgactatatgccatggatgaatacatggatgcatgctcaaatgaatcaaggatgtgtatttattttttttagtacagatattaatatcataataacaggattgatccttttatatacttatgcaatggttatcaagatattgaattttttttacatgctactgcactagagaatcagatccttatgtccttgtgctgagtagtaattcagataattaatatgaattcctgtataccaaatgcatcatagtaatataactaaagtgatcaaatgacaaaaaaaaattatgaatcttgattttgatatcaaaatgtactgattacttaagtaacttgtaattaattgtgttctatggtattggtcttagcaaggttatgttgatcacctaccatcgttctaaaactgatatatgttcttctaggacttgtgataaagactcgtagattcctgcatatgtatctgcacctaaactaaatatgtacgtttacacttgctatccatattaattctgcagattcggtattacttatatgaagaactaaatacattggttgatttttgaaacagtttcagttcactgtgggataaaatttgtacaaaactacactgatgaaagctaatagatgcatgccctagtctaaatatcatttactctaactaccctgttataagtaaatatacctactctgttattataccatatattcagaataattcttgtactgaacatgctgctacatgttctactggatactaatataaactacttatttctctaaagtattattggaactagagtctgatttgtttaggttataactaattctaattaaatatgcacatgtcaatgttatgccctgtttagatgactagaatctgaaagcttataagttacatgcatgatttggttcttctatatatgctctattcctaaataatttatgtcatgaacactagttgattttattaaaaaattatagctacagacgcttattgttactattcagatttcttctatgataatttatatatgtcaggatttaaagacatgaacttatctttaactttatcatcaacttttgttacttttattcatttagaattgctaaggttttaggtcaggatggatggtatatatctgcatgaaactctagctctaacaaatgctgttactataaatgcaggatctactctcctcccctattttagtttttggttacctctgatgattctacagtgattgaaaaatgtgtggttcagctcctccttcagaaatccaagtcttctcttctactgctgctcttttagatctaaggtgattttgctagaactgagcttctccaccttgagcttggttgattgttccccttcttgaactgaaccccctactctacttggaactcaggtaattctcctccttggctcttaccctactggtaatgcttgactacttcctgacatctttcttgatctgctactggtgattctcttcctcctcttgagactgatcctcttgcttgatttttcgctccatcttgcttcttgacctaagtttcatctcctcctatagttggagttcatccaagaactgaacacctctacttttcctttagatttggttcaccgctctctgattgcttggccatggttactactactgttggttcatgtattggtttgagctggacttcagttgagctatttctctctgggtggagctaacactctagctgattttcctatagcttggttctatggttgtaactactactgccgcagctgctgcttgtgttgttttgcacgaccaaaacgagacttgggttggaaatgattcacacaaattattttatccctggtggatcttgtactggtgattcacctgcttgcatggctattcccattctgtacctgtgacacctcaacatggcttgtgttggcaacttttttgacaagttgacaagcacgatcgcagcactttaagccttgcggtgatcctagagtcgccaaccacctcgatctagcaaagagctaaacctagatgggttttgtaaagatggacaaactaagagaaaaactaaaagcaatatgaaaaacgattcgattgattgatagtagattgatttttacaatgaaccggccatgtcccttatataggggttggtcttgccctctacaggccctcctccacgtccaactcggggtagaaaccaaaggaaacccgaaacatgccttaccgagcaaggaaactttgagacccgacgaaacaaagtcggactcggacctgccggtcagaccggccacacaccgccggtctgaccggccctcaaccggcggtctgaccgcccaacacacagcggttagaccggcccacttcggaggaaaccggtagactttcaaattttggtaatattttctattttaatcctaggtatcaaatttaggtgtaaacagcttgttcggtggaataaccagacctatttgttaatttccctaattattggagaattggtagtctgatgtgtttgatcttttgcacttgaatccctcaagtatggtaaaattgtaaattactacaaatttagggactgatatgcaattgccctagagcttaagagtttttctgaaaaataaataattattgaatctttgactgagatgattcagtttatgataatctataagcaccatgtatatgcacaatatatgtgatgcatgctgtataagatttctattgtacaattatatgcatatatgtatgcagacctgtcgtggtaaattgtaaataaagaattgtgatttctactgtgcacatgtgtacctcgtgacaactaatctacgctacaaaactaaattatcccactcctcaccaggtttactctaactataaataaatcaatgatccatatggatatggacgacttgataaataaatgacaaggaaacgatcaaaaaattatttgatccataatagaacaacaatcaacatatttataggtcctagccagcatcgtggctccatcgacaccgctctcaactagtgtgaccaagtcattagcgtgaccaggactacagctaaaacccgggatgttatagtatgaggaataagagatggaccaaaattagcaaatacatatgtatcgggtcgggcatggattatctgctggcaaaaaacaatacccggctactcccgctatgttctcgagtctcggacgggcatgctcacgggaaaaaaattacacccatgcccgtgcccatcaggccgggtatctaaggatatctggacccgtgtatgtctaatagcaaaccttcttagatatatgtttatatagtatcctaataagcccctacattaataagattagccatgtggtgtcctttttccttcctccacacgcaccagataagttcatgcaccaaaacgagcattttacaaattcgtcaactagattgcacctcgtgtaccagcgatgcaatttactattcatttatttatagcttgacaaatctattgatctggttttgctgataatattaattgtatgaatcatttttatttagataaaatatatatttttttaaaattactagtacgacacaaacacttacaacgcacgtacactcacctgtatgaacgcacgcacgcaaactaggaataaaaatagaatggatatagtgttcgtagaaaaagataaaaaaaccgagcaatgatataagggttagaaatatataaaattcatcacttccatgataaaggataattaaagtagagaccaaatttataaatattacatatcttagtatactcgctacacgtatgcacgtcacatcctaatcaatatcagttcataaaattaacattgtcaagctattttggtccttgttcgcacgaactagataaattcatgtatcaaaactatcatttcacaagtttatacagtaagttacaccgagcatcaccaacagtctacctatatgattcccaaaactaattttgagagattttagtccaaaagtcagctccaacagatctcctacgcttctacccgagttttggagttcccttcccccggttcctcgctccgtttatatgcgggcgcgaaagtcgctcccaatcacgcaatcccgcctctctccttcgttcccacgcgtgggagatagcgatctttctgcgcgtgaaagaaaaaaaacggaattttctcttggtagtttaacgtaagggcccacttttaagttttgaagattgaatttaggctatctcttgaagagaggagttttttcacttcttattttcagtttaggaaaccaaaaataaatttttaggagaaaattatagataatctgttgatgatgctctaaacagtactatcaatgcaatttactcgtaaatgaacaaaccctatgtctcacaaaattttcttcccaaaaggcctacaggaacgcgctagctcttgattctggagcgattcccgcagcctaaccagaagccccatccaatccaggtcgaccagcgcggcggatccagagccgtagctcctcggagtccctgtctctgtggacgctctcaccctaatccgacgccgggcctctccgatcttccttcgccttgtgctgtggcttctcttccccctctatatatccctatcagcgagatgctccactcatggcggcatctacaacgggcttcccggtgagttcttccgtttccctacttctgtagctcgttctgctgattttttttcttttgaatctggattgggcgaactatgaatctagagtgtttaaaatcaaattcggacaaagttttcttaattccacattaaatctaaccggaagaaaaattgaaattgatatatattcgaagaaattaagttctcaatctgatacatcagcttatttaggtttacaattatttatttagcaggcttcatttgtagagtagaaagagattactgctgcgaaggttgtagcggtgctcgacggggaggcctcgccctccccggagccgtggtgtaagaaaggaaggaagtttgtagattaattttttcttgatttattccatcacgaactggccttctataggtgattacaatctgctaatgaataggaactaactgaaacaaacctcaaacattaaggataattcttatctaatgcgagcaacacatgatggcgagaacaccgctgtggcgcaccatgcgcacttactggtctctcgcattcctgcgacgttccaagggaattccccacatagcagatgatgatatatggtagtatcttatttgacccatacactagtcatttgtgctccttggtactaggttttcgtatggatcaacaacaaccagcattggagggaaaggggagaacaaatggggcaagccatttcggagcagatgcttcccccctcatgccaatgcatctttgtacaacactgcccaaggcgaccactgagctgtcactgaagagatgtatcgagcagagaagagagggggaattaatgggctcgttgttagccattccgctgttgacatgttctcgatgacaatcattgagaattcaagacaccgtgatggttctatatatagaaataaggcctttgaaggacatttctgtatcactaaccgcgatgagagtaagtgatcaaaaccttctccttctttttctaatttgatatgatttgttttagtactaataaatataatatggattctggtaaccaaaatgccaagtaaatttgttactctaactacaatatgatttctttatattttcttctttcctactattgttttcattcgtatgtgcaatcaatccacttaggtgaaatccaaatattgttgtaattctagccgatcctgctgctcattatgtatatatctatggttcaaacataccatctattatgtaactgcctaagacgggtcatttaggtaccagttactggtcggcaggatattaatgtaaattaaaatttcaattcttaaatttaccaatcaaaagtttaaatttttggaggttaggagaccaatatttttgtgaataccagttttcaaaaccttagctgtactgcagcataaagcactaaagcatcattcatatctctccaaaaattatactgatccgacaaaacaccttacaaatataaaattaaaatgtaatagctaattagttgttctcaatcataaaacacatatacatgattatgttagaaagctctacctacgtactcatatgcaaacatgcattgtttttctaaaatttcacaaataacacacatgcctaaatatttatggccatgaaatgttcccagcattaccacatatgtataagtagccataaagtgtaataagaaaagcctacatattcttgtcctaaccaatgtggctattagacctagagagtgtatttggtggtgccggacttattattctcttaattctgcgtacttacttaagaactcatgttattttattagaatagtcccagaaaaaacctatgcttgacctatgctgcagacatgggaaacgatctacttattggcaatatggaagtttagcatgctctaacaaaagacaatttggtcaacttcaatgtccctttaaatattttccacacaaaattcggtacttagcacataatagggaaagcataattatcactttgtaataagcattgtctattgttataatttgtgagttgatatcttttggtgaagctcggttggagccaatgatgttctcggagccaacagattgccgacctagttgggaaacttgcagtatgcattcagcatgtgccatgatgcaaattttctcactaaagttggctaaaattcctattgacaatgactgcatacaattatatggatacatagcagtgcgggatgatttggataaattgcttaattatgttgtcaactatagcagggataatcccatcattatgcggcaggtacacattttgttcatgttctgttgatatggcttctaaaatatgcttggaggtgattaaatatatccaaaagtaggacatgggaactttcgatttgaagtcattatgatattagacaagtctactgctatggtgaatgacaattataattttcttagacattaaactacataaataccctttcgacttcttgtttccaataaatatttaagttcgcaaatcttctccaccttcaaaatcttacctggattgtttcgtgaatacatgagccttagaggatctgcaaattatgctttcatttttatttgtactctggaaaaaaaatattcactcatgccatgattttatatgcgatccgcatattgatggttttttgtttgcatgataaattttgttgggtttcataaccctttaaaatttactttgtggacaacttatgtttattggagaaattatatattagtttcgaattaggcaaaagtgcctatattttgcatcttttgttgtgagacaataaaatgtggtgcaatgctctcgtgtgctttcaagaaaaaaattgtggctcaaccaaggggcgctctagttttgtggctatttggataacacacgctggcaattatcgtaatatgcatgtgtgacttaaaccagagataaaccgaaagaaacttttgaccttaatttgtttgctagaccaaatggatgacttaagcctgaccagttctggatccatccatttgcggatcaaaagtatgacttctttcattgtcaactgaactgttgaattgtctcggactgttatgaacactggttaggccatacagtagtttagttaggaaagatgaggcgcacatggtctgttctaggtaacgtagagaaaaacactcaaatcaagggtaaatttacctcttgtttagattctctatcctgttttggtaagatgtataatagtggccacagatagttgcaaaattatgcggcatagccatagctgcgccaatgattttagtgtcctacagcacatgctacaaagtacaaactatcttgtcacatggccaaatttgcctataatttatgttactgttatttgagatctgcctatgctttgctagaaaagaaatcaagctttgcattcagtttactatgagatgctattaaataattttaatgatgttttagggagatctgattgaaatgactggccccaagcgaggcatatcaatgtgttgctctgttctattggagtttgacatgaggataaaaaaaggagagcaagaaaaagatgacctacagttaattgatggagcaatagattatatcgggctaattacagcaacgtttccattcacaaaacgcattaatggtgattgtggtgcagttgatatcactttagcacgtgtttactgggccgtagaggccaccatacaagttatcatatcagatgtgcaaagtggtttcaatttatatctcagttccttgtgttttgttagtgatgtatggaaagaaattcaactcttcaatggccctattggtgagtcatgtggcttaagaagatatgtggttgctgtatccttggacacttggatgcatttgaagttgaaggtaggccaaaaaggctctaaccattatgttgaacgctattgttctttcaaagcaatcaaccatggatgttccagtcaacaaatattgggtgagcttgcatctatctcgatgaaggtgacctggtcaactttactagattaaactcctggaatgtgtttcttaccaaccgtcacaaataagtgatgtttttatgatgcatgcagtcaagatgttaaactttgaccactaatatctctttgaatatttagattcaacttttagaaatattacggctagatttggcttcaataattgttttaatatattatatttcctctatttcatatcataagccgtttttagtttttttcttactcaaatttctttagctttggctaagttttttgtctaagtttatagataaatttagcaatatttacaacactaaataagtctcattaaatacaacattgaatatatattttgataatatgttgtattgtattgaaagtattgttatatttttctattaacttgatcaaacttttaaaaaattgattaggaaaaagtcaaacgacttatgtgattataattggaggtagtacttaccagtaagtatgcacgtgcaccacacgtctctacaaatattaagcagccatgtttttgctgattaattttcctctcctccgctataggccatgcttacatgtgttgtatgcctgtatatacatacatgttgttactttcaagtgtatgagtagggctaaccataaaatttcaagtgtatgagtagggccaaaaaaaaaataaaagtgatccaaaaatttagtactccctccgtactcgtttaggacaactgtttaagtcaaacctttggaatataaatcatgaataactcttaagttgttgagtttgtaattgtaaaaattatatgaataaatttgtcttgaaaaataatttcataaagagtgaattgcatattgggctagttattatgaccaaagtttcactttggaccatggcacatccaacatttttagtttagaccagagtcttttaccttgggttgcacattagaccaccctatccatttccacatcccctgtttccactcagccactgcttgctcctacatcaagatgctgctggctgccaatcgtttgtaactttggcagtgacattgggtcaagccggcaggtgagcacaacaccaccagcctgaggtattgagagctgcggggaattaatggccttgaagagaggagctttgtctacattgcccctgatctcgagctcgagctccatctgtggccacctttgccagctgcgtgcttgagctcgacctccgcctaacatgccacgtgctcgagctccacttgcaccgctgtggcgcctcaactgccctgccctgaagctactcttttttctcccatgtgttctgctgattgctcttgcaacggtagcggcagcaggatctggtttagtgcttgatctagtcatcaagctcctaatctagatgctcaagctcgacggaaacaacagatgggcagcgagactactataggcagactggaaaggtaagtggagggagcgatagtggggatggggatgacttttctggaggaggaagagagaaggggaagagggagagacacacctggtctggttgacatgtgagcgtctagtccaaattgcatgctcaagtaactatagctggttgaaaataaaaatgtttgataacacctagatcattgtgaaacaagggtaagaaaatatagtccaacatgcagttcactctttcataaaagtatacatatatcacttttcaataaatatttttagagaaacaagaagtcaaggttgtattttggagaccgtgtcgctgtccaaaacgattttctttacgagtacctttacgagtacggagggagtacactatagcgaaaatcttgttgtccatttctccagaaaattcattttagttgtcgatgattcttcatctgaaatctgaaaaagaaggaacatactgaaattattaactggaaaaaaggaacatctgacatcactacatatttcgtcctggattgccaaacaataccagaattgaacactgtagggatcaatattaatgatccacgaaactgcagaaaagcccatcatgcaaacattttgcctcccaaaatctatgttgtgaattacaaattatgaccagaacaatggtagtgttgtcgaacctgacattgccggcaatgcattgtaacatcctgaaaaatcctgacaataaaagtcactaaaattttgaattttttaaaacttttgcatcatgttggatgttatggttgctattgcttgccaaacttttgcatcaatgtaactaatcaatctacaaacaatcaatcgaatcgtttttcatattgcttttagttttttgcttagtttgtccatctttgtcgatttgcgctgtaaatcgtccgcagccgctgcgaaagtgcgacacctctttttaagtttgtcctgaaaaccttccgtttttcccacgagatgggtagttgtctatcgttctatctagaattggctccgcaagccggtttagttatcaaaacccatcttgatttagctttgactagattgaggtggttggcgactctactatcaccgcaaagctttaggtgctgtgaaaagaacatctgaaattattaactggaaaaaaggaacatctgacatcactacatatttcgtcctggattgccaaacaataccagaattgaacactgtagggatcaatattaatgatccacgaaactgcagaaaagcccatcatgcaaacattttgcctcccaaaatctatgttgtgaattacaaattatgaccagaacaatggtagtgttgtcgaacctaacattgctggcaatgcattgtaacatcctgaaaattcctgacaataaaaatcactaaaattttgaactttttaaaacttttgcatcatgttggatgttatggttgctattgcttgccaaactataaattgtcacgattgaagattaagctaaagctatacaactacgtaacaattataaaaataagatatttattatgaaccctatagatatttacgcacaacacaacaaagccatataaagagaaggttaattactaatttaatttataggtcaaatattaatattgtgactgtgtcatggcatccactcatataaaataattgatcacataaaataaattgatctttatatatagagattgaatgatgggagtatataattaaatatttagatcaatattgtgccaagtctcaatttcttttgtgaaataaatagattaaacctatccgtgtgtaaatacattgttaatacaaataaactcgaccaatgtgccattgtattaatatggtgatattagtatattataattaataattgtccaagcctacaagttatataggataattatgttaaaccaacacatggtgaaaacgaataaataccaaaatcccaaaagtataggaaatcataaaaggtatagtacaatttaaaaatttggacaatattaattttgaacaaaattcacatttgaatacttcatattgtcgttaaaatgcattggtgaaaatataaattgaaatagacctttttcctcaatttataaaatcaatcaaaaaccctaaatttacagcctggctctgttcattgtgcgccaggtgttcgactcggttctaacccggccaaacacccagcgcagcatccgccttcccgtgcacgcgcacgcgccttctctgctcgtgcgccgcattgggcgtgcccgtgcgccacaccgcgtgggcccgccgccgaccgagccaccgaaaacccgcgccaaagccgcgccgccacgggagcgcgcatcagcaacgtcgcgtcgcccatcgtctcggagccgaggggtaacggccgcgacgtcacccccacaccacccctaaaccctatccaaccgccctacacccgaaaacccgccctcaccaagccgccgctctgccatcgccatgtgcgcgcatcgccgtcgccacgtccgccaccttatccgaatgcggatgccgggtccctcctccattgtaaccagcgggtaaaacggagccttcctctctagctagggctagaacacacagtataggggtcatagatgcaatgatctgctacagaactttaatggaaaaggaggaggaaacatagccgcgtcaacctccctaatctaggccgtatagacagccattgagtgcaccagctgccgatcctatcctccacgccatcctggcttatccccaagccaatcccccccataaaaactccatccctatctgccttttcctcgaatacatttcatcgaacaccttgtgagcatgcttcatcatcactggttggagccgaagccggcgtagctgaccgcgggagctgtggctcgggccgcctctacttcttctgctgccttgcatcaacgccgggagccgctggacgtcggggagagtgcgtcgaacacctgcgtgcgctgccgacgtcgattcgcccctgcttcacccgcaccgtgccgcgcatcaccgacctatgccgttgctccaccgcacggtaaatacttgcgctcttagcaccctctactgacctagaaacatttggccccctcgatttgaggtgtgtgtgccgctgctagcctgccgacgggccgccattgcgccaccgttgagctcaccgtggacggcactagttccaaactaacctaggccatattattgcatgaattagttcactagagaccctagatggtgaatttaggctcggttaggtttaattcgtcctctcccgcgccatggccgagctcgccgtgagctccgtgccacccgtccgtcgcgtcatgccccttgtagccgccgcgcctcgttgctgccggcggtgggtctccggtggtgcgccgccgcttccctcaccacggccgagccgtcccggctcgggctggtcgcattagccgtgcgcccgcgccgctgccctgcgcgtcgggaggaggaagacgaccgagggagagaaagaaaggaagagagagagagaagctgtgggccccacatagagattagtgcacagtaatcacctattaatccaatgcaaattaatctattacacgtgggattggatgattagaaaaatcaaagaaaaattgattatgaagttactgtcaatggcatgcgggacccaccgggattaaagggctggtttggacccaggtcaaatagggccggtcccacttgtcaatgactctctgcattttctatgggaaaataaaaacaaaggaaaaagaaatggggtgaccctacatgtcagccactgtaatcatgcccctctcggctgcacagtgccatttcacaactgtttgaattaattcaaatttgaatctttaaacaagcatagctcactcattttagctcggatttaaatgaaacttgaacctaaattcatctaaaatcaagatatagctgatggaatcacttttgctatttatttttgtactgttgaattttggtgatttaatttgaattctaattgaattcaaatcgaatctttcgcacgtacatatagattccgagggagtggttgagttgactgcaaaacaaggacagcaagacagtgagcaaggcaagtcatcactaatctttgagcatattggacctattgcgaacttattttgatttaaataaagtttgcatgctatttatatgtgaatgtcctactttgttatatgccatacctttgatattgattatccatacaatctttgtaatccataatatcgtgtgtttttagtcaatgcttgaccaaagcatgggtatgatttgactgataaacctgatgttttattattttttttctttttacttctaacttgattgccattttttttgagaattccttcgtaaatcccacagcaaagcacggggaatcacctagtcaatactccctccttccaaaagtctcagtcgtatttggttttcttgtttttccagatgagatgggcgcattccactctgcatgcatgcatgcaggctttaaatgtgtagctggtctcttcgttaaacatgcatggatttaattcctctcagcaaccgaacagtattcttttgcatgcatgcaaatccatccgttgcctattcgcgagcggtgggcgcggacggttgcggtgttgcacacacgcgtatcgtgcatcaaccgaagcgtcgcttcctctaaatccatgcagatgtagcgatggttaaatgcgtcggagagttccttggtcttggagcaaaacgtaatacgactgagacttttggaaggagggagtatatatgagtgagaccaatgtttacttgaactttatcttatttagtcttctttacattgagaacatcaacataatgaaggtttgtatttatgtgtctttattattgctacatgcgttctccatgtgtagggaacaaaccccattggtttttctctaattatgcatatatttgtctccattatatattccattatatgcatatatttgggggagcatatcttatacatatatcgtgcatgttctagatccatgttgttcacctattatcctacactacaacaaatctgggcttctgtgacgattacctaatgacagaacacatatatgtcataaacagagaggctgtttatgacgactgttcataggatgataactgtttatgaccaaactgtgtatttgtcataatcatcatcatagtatactttgcatgggctctgtgaagatagcacgatgacaatagtggatcgtcataaaatatagaactattatatttttaaaaaacaaaaaaaatcttgttatactacattgctgctagatcacaaatcgtttgtcctaggtggactcttcttgtctctcattttagtattttaggattgaagtcatcgctagtcttattttatgaataaaaaaatcagaattatggcgtttcattttatgattgaatgaaaaaactttaaaatggctataagttggtttgaacctacattactacaagaaatatgaccttctatgacgaatttctcgtaacatcggagctattcgtcattagcacattccattttatgacgattaattagtatgagatggggaggcttagtgacgaaaaattttgctttaaaaatcatggctggaaatatatttgtaatattctacgtggtctaaattattctctgaaatttttttgtgaattttcggagctcaataactaattttcataccacaaagttcattttaacctattataataaatggaaaacaaattaaaattcctctctatgtacttgggccattttcggcccaagtattactctcaccctccctcagcctgcagcccctctctctcttcctccctcttcaggccaccggcccagtccttttgctcctcccttgcaaggaagtctattttcctccctcctctcaattcaaataatttttcggtagtaaatgatttcaattgaaaaaattgtcaacaaaaaagttgtataacttattaagatctacaacttttgttttggtcattttgctatatgactttggttcaataatttgaatttgaatttcaaattatgataacttcaaacaacattttcaaatactaaataatttcaactgaaaaagtcatcaacaacaaagttgtataagtcatcaatatctacaacttttgttttggtcattttgctatatggctttgtttcaataatttgaatttgaatttcaaattatgacaacttcaaacaacatttttgaaatactaaatgatttcaactgaaaaaatcatcaacaacaaagttgtataaatcatcaatatctataacttttattttggtcatttcttcatccgataaagtgatggtaacattgttcacaaaatttacacatctcttatatagtttataaactataagagagatatataaattttgtgaacaatgttactatcactttatcggatgaagaaaaaaccaaaataaaagttatagatattgatgttataactttgtttttgatgacttttttatttgaagtcgttcactaataaaaaattatatttgaagttctcaaactttgaatttttcaaatttcaaattattcaaatagagtcagatggagaaatgaccaaaataaaaattttgcatctcgataagttctacaactttggttttggtgacttttccatttaaaattatttattaaacccaatttttgtttgaagttgttaaattttgaaaatttaaaatttgaattgttcaaatgaacttatttgtaaaaaggaccaatacaatagttgtagatctcgatgagttctacaattttgttgtttatgatttttgcatttgaaacataaaaatcagtctaaaattaaatttaaagttctcataaattaaaattaaaaagtacaagatattatttgtatttttttttgaaaaaaaagttaatgctggagaggcgccaaaattttggtgtggctggaaccaaatttttaggcgccaatcttggcggtcatgccaaaaataaaatttaaggtgaaatgttcgttttatccatacaatttggtaaatactgttaagggtgtgtttggttgagcttttcaacctgcttttgcttttgcaaaagctaaaagccaaccaaagggctcaaaagccacagctacttttgccaaaagccagcttttggtgtagtacaactcaaaagcacctctacccctgctttcacctgcttttggggaaaaaaaattacccacctataccattaaaaaaaacggttcgcttcttttctctcccatccttctccctcctcctcacttcgccgtcgctgccgctcctcctcgcccgaggccgacgccgccaccgccgaggactccgacgacgccacagccgactccgtcgtcgctcctcctcaccatcgaggccgactccgccgatgcccgaggccgataccgccgccgccgccgactccgccgccgcccgcgtctacctcccctccaccgccgccgccgaggactcctccgccgccgtgcgatctgcctccccgccgccgcccgaggcctccgccgccgccgccgatgtctccgacgacgccgcggcggactccgccgcccgggtttacctcccctccaccgccgccgccgaggactcctccgccgcggtgcgatctgcctccccgcaaccgcccgaggcctccgccgccgccgccgaagtctccgacgacgccgcggccgactccgccgccgcccgtgt

SEQ ID NO: 14595 - DNA, 9357 bp, Oryza sativa
ctacctcagcgtcccccggaggtcggcggcctatgggtacggggtgctcgtcgcctcgtcccgcaccacgggcgggaagccactcacctacatcccgtaggcggcggcaggccggcctcagggccaccagatctggcctcccgccggccagatccagcgaggagcatggggcagggcactcccggaggcatgggcaagcagggtggcacccccggtgagcgcaagtctggcggcgacggcgacaagaaggagcgcaagttcgagccccccccccccccccccccgcggcgccctccggcgaaaaagttaccggtggcggcggcgtccaccatgcaatggagcaccgaccatgacagggctctccgctcccgccaccccagtcagtacactagacaagtcccttcacttcatctccctcactcttaaatctcaatctcccccaacccccgcgacgtaagtgaggtcaaaaccctggtctccggagcggagttgctagatctggggggtttgattttatttgttttactcgtgtgagagctcgtgtagttggcgattcctccgcgtgggaagcttagattagtgtgtggtctagtcgcgtctcgcagatacgatcgaacactacgatgaattcgtgtttctggtgttcctttacggatgaaattgatcgaagtgtttctggctatgaactgcttcgtgccaaaattcctgcctctgtttagctgtaatttgaactgtgtgtgtaaccctagcagtctagccccctagaactcattcattcattcattcatgctgttaccttttcagtaagagctaaagctaattcctaaatttgtccggggaccaagctagtcctgttttatgtagcagctcctattttcatagcttccagctgattcctgctagtataatactataatttataatatgaatatgccatggactgttttattgtggctggctgttttcgtctgcacaagtattgtgtctcactgcttgcctttctttcctccgttgattttattgttctatgttatattggaatctagtaagctaacacagtgcaccgacttttataatagcatcttgtatataggatgagctcataggtaaaaatgtgatgatactctcgatgctatctgtcgactttatgttctgaaattgaacttaccaataaagctggctaatgttctgaaatggagtagtagaacataagggactaatgatatattttgctttatacatcgatcttagctggatgctctgcattgtttttttttcttccagttgttttcaccacattggtaagtgttggcaacttttttgacaagtcgacaagcacgatcgcaacacctaaatgccttgcggtggtatggagtcgccaaccacctcaatctagccaaacggccaaatcaagatgggttttgaggaaaaacagctaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggtggatggtttacggcgcaaaccgacaaagatggactaaactggggtaaaatagaaaaacatagtaaaaaaaacaattcaagtaaattctattcaggggttttacaatgaaccggcattgtccgttaaataggggttggtcttgccctctacaggccctcctctatgtccaactcgggatagaaaccaatggaaacacgaaacatgccttcccgagcaaggaaacccgagacccgacgaaaacagactcggactcggaccctgccggtctgaccacccacatacctgcagtcagatcgcccatacacctgcggtctgaccggccctgtgaaggaaaaccggtactttccaaactttggcaattttcctctatttcgtccataggtgccaaatttgggtgtaaacacatacccccgtctttttggtgaacatacgtgaacctaaaagcatagaacatgttatctcagggcgataatctaattaccggccataggacttcctaagcatcttgccaaatgctcgggaagtatttcttcaagtatttcccattgattgctctctgaaaacaccgtcttgaagtatcttcatctcctcaaagtcttcaaacgcttgttgatgacgtcttcaaaattgccttctatcaaaggtattgtaatcttcaatcaacaagtcgtcttgcttgaaatactgaagaaagccaagatttacctcaaccgacaaaacagctttttgtctataaaccaactcaaaaggagtgactttagtagcatcatgtttaaatatcccatgaacccataatgcctctgaaagcacctcatatcacttctttgagtgttcttcaattttcctttcgactaatttcaacaatattttattacccgactcggcttatccattagcctgagcgtagtaaagagaagaactcaacaacttaaaatcataaaattcggcaaaacttctcacctccttggacataaaagaagatcttcgatcaaagtttaaggaataccgaatctatgaacaatatgctttaaaaataaagtcaattacctccgtgtaagtaatattctcgagcggcacagcttcggcccacttagtgaagtaacccattgcaactagcacgaaccaatgcccttttgatgacgaaggataaacttgaccaatgaaatctaaagcccaacctcggaacggccatagtttaatgataggattcaacacagcggtaggcgctaattgaacattgccgatccgttaacaagcttcactccctctatagcatttgaaacaatcatcaattattttcggccaatgaaaccccactctcctaagcaaccaatttatcctatgggccgattgatgaattccacaaatccctacgtgaacttctcccatagcaactctagattgatcattatccaatcactttaatagcactccatctatatttcggcgatataactctccatcaagcaaagtgtatttgaactcttgccgctgaatttttgatcaaccttaagactaggatctttcaaatattctattcaaaggaattctccaagctatttctaactcatgggcacaaatgtccgaattcacaattaattcggccttttaatcaattgtaacgtgccccccagcccctgtccgggatcggtcagaccggccacacaataccggtcagaccgccctatctacccggtcagaccggtcatgcagagctggtcagaccgccggtaccaccggtcagaccggccgtgcaatgccggtcagaccgcccctggtctatgactttgctaatttcgtccaaacttttgaaatcaagcatcggcctttagtatataattttttttcacataatagccagatgcttggtgtatcaaattattggaccaaaattccttctctctagacatatgaaaaactataacatccaactaacatgtctagatgaatactaattcaaatggcttttgaaacaataatcatcatggcatcaaaacacttagccaattgaagtatgatcaataatgaatcaccaaaatcatatgtgtcacatgcatagattcgaataaactacaaatgtaagtaatcggcttgagcatgtatgcaaaatattaataatcccaatgttcctaaagaaaaccactctagagcaaatcatcatattcaccattgacattagcggaattactaagcaaaattttcatggtgcaataaatatgaaatctatatattatatggcgatccataaaaacatccataatttggcttcaaataaatatcaaagactcatgagccaaatcatacattcaaacaaattatatgccaacttaccaattccactaattagaactggtatttgcaacatgtatgtataatatcaatttgataagcaaaaacacacatgtgctagatagtaagcaatgttctaacatggcataggcatataatatgatgatgaacacaataaacccatacattgccttagcatccaacaaacgacagctcaaagatgtgatgttgtatctatcgccgttcatcctctcttggttccttcataagcataataatgtcttgccccccaagcaaaatcggctttctcgactgcacgatttcaaaggcaagacgaacaccgcaccaacatccacagcatcatgtgaaggagacttattttttaagggaaaatttgaaccatgccacacaaattttgcaaaatttgtaatatgccatcctgacccacatgtcattgactcatgtgggtcctacatgtcattgagatacgggtggcatatctcaaattttgcaaaattagggtggcatggttccaacaaaccctttttttaatgaccgatgattcttctctcatcaaattgaatccatcactactccatgaaatcaccgatcttttaacttttacttctttaggtctccacactcgcttaggtgtcgttcgaggctctaaattattacatgttttattctctacatcttcggcgtctttttctttttgacctatggctcgaagacgctgtagcctcctcttttgagagcgagataagccagaaggtatccacttcggctgtggttgttttccaggagctaaacaatgattcttaatagttttgggcgaagtagaagctcctgtgttgctctcaattttcccgctcacctttaatgcccctcggtctgatcggcctctgggcccggtcagaccggctgcaagccgtcggttagaccggccaggagggttggtcagaccggccgtagtctggcgatcagaccggccagacgcctcggtcagaccgccgatgtggacagtaacggtatcggcttcaatcttctccgcttgtatagttttcgccgcatctcgagtaggcatagttattaagaccggaccggtaattgaaccggtgaggctctcggttcaatggttcactggttcaaccggttaggccgttggtctaatccggttcaatacgtgttaaatatattaatcattctgtccaaacacaaggcgcttggtagcgtggtggttcggtgagttagcttcctcccatgtggtcctgggttctaattcaccctagcgcgtattttcactcatttttctcccccaccagcgcgtgcccatgcggccatgcacgcgcttcgtcgccagccgtcaagagcccggttcaaagcggtttttattcccggtttaatagcggtttttctccgaaaccgggcggtctagccggttcatagccggctcaattgcataccggtcttttacctggaccggaccggcgggggctctggttccggttttttccggtccgaccaccggtccggtccggtcttaataactgtgccagtaggtacttgaacatcttttacctggaccggaccggcgggggctctggttccggttttttccggtctgaccaccggtccggtccggtcttaataactgtgccagtaggtacttgaacatcttgagattcctccttaatagtgacgacctccggagctttggcttcttttctcacccacaccttctttacctttttcacctttgatccaccggaccgattcttttgtgggaaacggtcttgactagagttaaatgaatgagttggtactgacctaggtgattccttccactcttgataatacggcataggtggttgatgcatccacagcatataatacataaaaggataaccaaatggtgacattggatatggataccatggcatcactaccggaggtttgtatggagttggtatagttgatggctccgattgctttggtgtttgaccaaatctttttctacaagatgatcttggtctttttgaatcactagtttgattatcaaatcattgaccggctaatcctttattgtacttagccataagcatctcaaaagtgagcttcggctttttggtcttttgggaactagatgactcaccctttgcaactttatgatcttcggccttcgcattttttatcctattcttgggccgaggatccccaataataacacttttccctttctttttgccaacatcaataaaactaacagggagaggatcactaacaattccggtcttaggcatagatgtaaccgaaatagtttcacaagtgaccgatgaagtatcaatcggtctttgctccatcaagcttgcatctttaaaataatcatgaaactcatgctccatttatgaccatgtagaaattgaattaggagcaagtaaactataccatgtagatgcaaagtttgacaaagaaagaggaaacaattttaacttaagcaaatcattactaccgaccttaccacattgatcaataaattggccgatatgctccattgtagtcatagcattctcacctgtgaatttcatgaagttgggcacctcaaatccttacggatatgggaccgaatctacatgttcaagatacatgcataactattttagattctatctcactactatcccgcaagacattatcattatcttttccaacatccacatgactgatttgtgattcggtcttaggtgacaatgctatttcactttcgcttgtgatataatccaaaccgtcacttggttcggctatattttcaatgatgtcattgtctaaactagcaacacaatccgaaccatcacttggttcggctattccattattgtctaatttagtaacacaatctgaaccaacacttggttcggctataatggttgttgcattatcatccaagctagtaagacaatccgaaccaacatttggttcggctataatcgctatggcatcattgcaaaaattattaacacaattcgaaccgtcgcttggttcggctacacatgatattgcactatcatctaaactagcatttaagctattatcatccacccggctttcctgagccagtgcttcatgcaacacataacacatgatcaacattaagaaatatttggccattcaacctctctttaatagaatcaagcaatccatcatatgcaatgttggccaaatcttgtcagttattttcaaactaaaacatcggcttttaatatctctaaacctttcaatataatcaatgacagattcattttatttttgcctaaccgatgttaaatcagacaacctaagctcagttttaccagtgcaaaaatgatcatgaattttttgttctaattgagcccaagtataaatataatttgccggtaaagaagtaaaccatgtaaatgcggtaccggacaaagataaagaaaacaagcgcaatttaaaagtatcactattagcctcaccacattgcgctaaaaattgacctacatgctcccatgtggtcctactatcttcaccactaaacttggtaaattcgggaactctataattacgaggaaatggcacattatcataatagtcaggatacggcttttggtaaaccttagcacaattcctagtttcaatcccgaatttatccctaataatcccactagttatttcctccatattatcaggcctatgttgatttggtggtggatttggtggcctaataggttgtgtttgcggcgcaatatgattatattggccttgcctagtatcgggatgataccccctagcaacatcattataagcattaggaacatgtgggggaacttggggattagtcgcagcagtagatacaggaggattaaatgttctaagatgatacaaataactagaattggtcattggatctatcccctgaatcggtatgattgcgtcggtctgaccggtctagggcccggtctgagcgacatccagaggcgcggtcagaccggcctgagtcccggtctgactgccgggataatacccggtcggaccggccgtttggctggtcggaccgacggtgaagtcgcggtttgaccggccatcaggcccggtcagaccggctatatgcgccactccattggttccactacttgtttgatctataggagcttggctagcagtggtagaggctttatcttttaccataaaatcggccaagagagggccgactttaaatcttaaaaactcatcaaatttaccctcaaaagttgcatctaacctatctttaaaaacagtcatagatgaatctattgtagatgctacttgttggatagattgtgttaccccttcattgcttacaaaatcggaagcgaacttaggacgtggcccgggcttggtcatcacgccttgacgagtcctagtgcacgccctcatcaacgcctcctgtgtgatctccttgatgtactcctccatggacttgcggtcttctccttcgaaatcatccaatgtgatcggcatgatctcgttctcgctcatcatggttgatgaagaaattccttgattaatttcggccatatagctcatagccgaaatatttgactaaataaattaatatacggtgttgatttttcctttgaatataacaagcgtgtgtgcaactaaaatagaattgcttctgtctcctcgtgtgtaagcaaaaattcagaaattcgatctcacaataacagccgaaacaatatgaatcggctttgatttttttttaattctcttcagtagatgtgctaatgtatgtgctaacagattgatgttgcttctgctgcttgtgacccggtagatcggctctagtagcctgatcttttctctgttgccgtgtgaaacaataaggaaacgttgctaagccgtctgctgcttcctgataatgattttcgatacacacggcaagtgcttatatgaatttgatgacgaccaaatagcttcgccgccgaatagattaatccagcgataagaacagtgcagcgactaattaaggtatagattaatttcggccgtttggccgaaacaaactattcgacgagatgactagattaaacaaaattcggccgtgatatggccggttacatcgttccccagcggagtcgtcaaaaatcgtgttgacttttttgacaagtcgacaagcacgatcgcaacacctaaacgccttgcggtcgtatggagtcgccaaccatctcaatctagccaaacggccaaatcaagatgggttttgaggaaaaacagctaaaccggctagcggagccgatttagagatcaaaatcagcctctaggccgatttagatcgatatgaggataactacccgtctcgtgggcaaaacggaaggttttcaggacaaacctacaaagagatgtcgcactctcgcagtggcggcggacggtttacggcgcaaaccgacgaagatggactaaactggggtaaaatagaaaaac

SEQ ID NO: 14596 - DNA, 3438 bp, Oryza sativa
aaacatgtaagattgaccaagctgattccttttttttaagggcttttacagtgatctcctttagtagtataaatctaagacattgatttataagttctactgctagtggttaaggtggtagtataaatagatatagtccatcggatgagaaaatatgaaaggtctagattgattctgctactcctagatccgctgtaaaacttgtcttttcttttatacatttggaatctccaaggacacagttgtgtagtgaggtaagatgtgctattttttttaattaataagatgtgataaatcgtaatgaacctttatttatataataatgcaaaactgaaaccttgctttaattgctaggaggatatgcatgcccgggaatccctcacttcaccatcaggacctccttcgacaaataatagcatttggacaaggtcagatcaatcctccctaagctagttgtatgctcaggtacatagctttaacttgtttcttgtgcatttgcatccatatcaagcctattgtactgtttcattggtggctgaattttttgttcatggtgtgtatcaaaattgcctatttcaatttacttgatggattatttatagttgttgttactgtgaaattagatattgtttagttgtgactggaaaagagccatttcattgattaatctagatactctattttttctggattattagctgcaaaagagccatttgtttggatttagttgtgactagaaaagagccatttgtttggacttgctggaaaagagccatatcaatatattgttattactcaatttacctgctggattattactctctaaacactgtttgctcatttgtttgcctccaaatccaaacaaaatggactttttattcatcagcaactgaaaacatgcaccttttgatggcaggaatgaggtgtctgagcttggaatttgatggctcgtgttaatgtagtggctgctaggtggaattttttggtgcaagaacttggcactacctataggaactttgtagtcggctgggacttgtgtagttggatggtggatggatcattttgtaatcatgttttgtgcttttgtatggaacatgttgcaaactgaatgctggaacttgcttttgtatgagctgggaaattaattatggctggaatgtgattataatataattattcaaatggttgtggtttatattctgtgattgctttttaattggattggcccataaaagcaaatttgtagctgggtcaaaaaaaatatttgggccaattgtaattgagaataaaaaagcccatgtatatgggccgaatgtgaattgccatgtcatttgctacatcacctgccttgtcatctgtatcacatgtcatcatacacgtggtgttattcggttcaatttgttatgacgaatttgtctcgtcattcatcaatgacaggagaactatcgtcattgtatcaatgacgatgtcctttggtggtcacagaagctggttagtgacccaccttttgtgatgacagccatttcatcactgctggcaggcagtgacacgaaacaggctgatatcgtcataatgtaatcgtcacagaagcctagaattcatgtagtgctatatacctatacaagtcatccccactaattttattttcctgctctctcgctttgccacatcatcttaattgttttggaccattagattggaattgtgtggtttgatcagcgttaaacgtcatgtccctaggcttctagtggacgggcctacaatgaagcccattgaagtccaccacaccagtccagccatcatgcaaaacagatcgttcttttcccgtagtcatcaattggaacggcaggaaaagaaaacgtcgcgatcgttatcgctcccccaaatcattgagattccacggcgtgatgccttcatgcctttttcatgtatggcaaaactaggaaaccctcatctacgtttcatggctgtcatgacacccacctttaaatcatagtgtaacccatcaaacaccagctgagattcgtagtaattgaactactacgaatcaaccatgatgtccttcagcgacattgttccattacaaacaccagctgagatttgtttttgtgtttctgcacggtctcaacttttcgttttctgtcctcatcaatcttcaagttggataaggtacattcttctcttccctcattctttcatgttgagttaattggcttaccaaattaaaacaaaagttttttttttgttgagttcactgggtgtgctttccgtctgcctgtccattggtgacaccatgtatcacttattttatcctttatgaaattttatgttacattccccctcctttcatattggagtagatcatattaagcgtgccaatacattatatgcttcaccaattgggaatgtaaatctgatcactaatatgtaccttcatatttcacttatgttatgattcagaagagaattcagttttcctcttcaattaaagtgattattttagaaatttcaaggttgtatcccgtaacttagtttctttcttattgcagtataatttatttcagtcaaataatgtaacccatctctatcaatcaaccatatatatcaagatgaaaagaatattacaggtggtcatttatagcaaggtgcaacaaacaggtttatgatcattacacatttttagaccttttatatccgacagtaatactcaaaactttcatgatctctcagtgaatttctacttattgagttattatttccaaaatttgttgtcatgaaattctttttcctatagttgatcaaataagataaaataaaaaatcctaaaaaagagggaacatttgttgttgcgtaattcctttttctatagttgatcaaatgagataaaatcaaaaaccctaaaaagaggggcaagaacgcaatttcacttatttgttaaatgtgatagatcaaatattctcatagaattttgttacatgtattgtgatggatcaaatgttctcattgaattttccctctttcgttggtatgcactatgtcccgctgcaacgtgcggggtattatctagtttatattggatctttgcacttaagcttacatgcaagtatttggcacttgtggtcttgatgagtactcaactattgtattcatatatttcatatgcaaccgattagtcatctatggaaggatacaactgatttgtcaggactaatgttttcctttgagttatgtattgtcgtgatgagactaatggatgacaccatgtgttgatggtcatcaagacatgaacatcatgttgacaaggatgagttcaagcttgtaaagacttgacaaaggttggttaggaccttggcgtaaatatggtccgatcagatggtcacaactgttgatccaagctcaacatttgaccccgagttggatagagcaaggcaaaggtat

SEQ ID NO: 14597 - DNA, 4439 bp, Oryza sativa
tatttattagtaaaaagttaagaacatatttctacaacaaacatgtgtcatcaatgtttgataacaaaattactacatcaattcagaatgtcagttgaaggaccactggattcccatgctagatgacaacaattacaaagaatttctaggaaagagccaatgcaatttagagacaggttacaagaaatgcatgtaagggaaaagtgcacagtactcattggctaggataccctgatatgtccctaaaacgacgtattcgtctcagatacgtgaggggatacgaatatgtatcgaatacgctccgatacgtatcccgtacgtatccttcgctccatcccgcgagagcagcgatcgatcctagcatgccgcgcgccatcgtagctgagtacagcaaaaaaaaaaaagaaccaccactgccataaagcgagtgaacggcctcggcgccggacggctggaggtgtaccagctccacgcctccactgttgcgcgccgcgccgccgtggtccctcggcgcaaagctatcgccagtggccgattgcttctttcatgcctaatgaggtagtaagatattggctgttgagtttcttccgtcgaacaattcatcttgtttcatctatgttctcctcacttattttcttgggacaaacaatgccaaatttcatagatttgatggattttagagttggtaactagctgcatctattcctaatgctactgcggctggaggttcaaggtaaaacaagcaagggaaagaacattatattttgtgattttgaggacttcttgttgtcttacactaatttatactatctttgttctttgctgtgtggacgtcggtgatagtatacaagactacaaactagaagggatattggaggtcatgtgctagcttagtactcaccgatctggtatacatttgcaagcatgatttagctacaaatatgcatggactaattttcttaaagaagttcaacatttttttgtatttttattaaatttccaaattcatcaaatttctatattttattaaatttctatatatatagatgtatctccgtatccttgttttctaaaaagtgccatatcctcgtatccccgtatcacgtatctgtatctatatccccgtatctaggtaacataggtaattggcctcatgagccatcttcttccatggtccaatcttttcgctctatgtctagatcaagcttctcatttaattctctttctttgacatcgatctattggaaagacaatggttaagcattgtgtgatgaaatattggataagagaagattgattggagagctatgccacaaaccgcatcatatatttcaccatttttctcaaaatctcctttctttctgggatgatatggatgtggacatgtggaaccgtttgactagcttgtgggccatcctgataagcattgtactggtgagcaaatagctaaatatttttatccaaagaatacaataagaaacaaaattctacaacaggtatataaaaggtatagatagagcaattgatcaaaagaaacaaatatatctttgtttcacacacaataagataatcatattttagaccccctacaatcaaaaccaatatggtactcctcttagtgatacgagtaaaacattaatcatgaaaaaacaaacaaactcttaatttagtagcatacaccaaacttcaatagaaaatgtgagtgaagatgttttatggtattgcaagagctgtacgtcaacatccttcacaataacccataattcaccgtctcatcagaacttagatcagcaaatcgtttcacttcacatttgggacaaacaagaacatatgtgtattgtcaaggtaatacaatgactaaaatatatcatattttcttaatatatcaaacttcaagtaaaagatagatacccaccaataaaattatgaaagctttgcccaacaatgcaatacattatatcaatcacaatcaagtagaagtaaacactacaaatagatcagttgcatggacaaacaacatgtcatggtcgagatgacactatctgagaacaacatgtcatggtcgggaagtatagttagatgcagcaaaactaaaaacttacatcgctgcttgagctaatcccccaaaatgaacaattgaagctaacatggtccccatggtagatttgatatttatcaagtataaaagaagagtaaagtaccgcattcttttcatgaataaaaaagttccacacgtctatttcttttgtattatctctcttttttaaaaaaataacttcttttatattagtttaaacagccttgatgaacttcaccaaagcacaaaacaacaaaagcaaacacattctatgaacaatcccattgggactagcagtgcgggcatatgactagtactagcttgaaattgatgtgggtttcaccttccaaggcccatttcagccatcttgttgtctggacaggtgggcctaaagcattaaaatgaggaggaagtccatttttttcatccctcaactatagcctgagtccgatttacgtccctcaaccaaaaagccaaaatagaaactctctcaactatcaaaaccagtgtaaagtaactcccttagcattgcaaagtggttttatctgatgtttcaatacaatcattagaaaaagaataacaataggacaccatgtaaataatacaccaaatctcttttgatctccaacaactcctcacctcccctcatgctccgtcgtggcatcaagcttgggacaagccacggaggtgcagaatgaggggtaggcagtggcggtctgtcacacccagaaattcacgaaccagaatttctaaggtgaatgtgcattaaacctctgtccaagaccagccagggtacacaaacgacaattgttgacatacagatccacgtcttacaaaaatataaaagattacaaatgcagcggaaaagataaaagcgagttaagcctgaaaacttgactcctgtagcgggcgactccattccacaggcatccttatcggaagcgacgaaaccaacttcttcgagacagctccaactgagaagaatttcaactctggtgtggggggggggggagagagagcaagactgagtactacccactgtactcagcaagtcataccggaagagaaggtatgatgcaagatataaccaaaggaggctagaggttcatttgcaataaagcaggcatttaaaagcagtagttgaaagcagtaaaacagttgtagtaattaatcaatattaaccaaccactgtccaacgctacaccacattgcaacaggcccaaccaaccacctgaactacaccagttcattagctaattaggggtgagactaatcacggtaaatccggttgaccgcccataacggcgggcacgactattcgaataattttgctctgatcagaggtgtacaaccgtatccacaagacatagccccatgacacgtttccgtgtgccgacatgccaccacgtcataccggaaagaggccgtgacaggatccttcgcataaccccctctaaccaatcgcaccacacctcaggtttcacccccactcctcgtaaggtagtgggcaatcccctctcgtgccacggtgaatccggaagccgatcaaccggacacccaggccgacccaactccatcacgcccaccctagcctgggtacgtcagctagaggaaagctacactacaagcccagccgttgcccacgctggcttgtggtaagcacgataaattcttccagggtttcccgcgaaccggtccttaatcgccatgggcacgactagcaaaaccatgcacccacagcccaccatgtggtgtattttaattaactaacaccattgcggtggcactaatccaaaactatgccaataaacaaagtctatgcattaatgtgattccccatttgtgtgctagttgaactaagcacggctaagcatctcctaaaccaacatctagtcattttaatacccacgttatcaatggcgtaagggaaacaacatatagctgagtaataggacccatcccacatgatatcgtataagaatgcaacgtttagcagaaaatacaggatatttgtaaattgggtacaatatgatcaattgtaatgtatgacttgccttgctctcgcactgatgagaccacagcaacgtcttcaagaaaccgcagattgacgaaacggccaaaatctacgcgacaaacaacgcacacaagcaaaacatgctataagtctactgaaacaggaaacaaccatttttaatggattctatgcatttttatgaatttattgagacttgaatggacttaatcggaactcggatgaattagttatgatttttagaagataatctgtgttttaactaataaagaaaaggccttaattgatttattgcgcaataatacccagggctgacgtcatccaaggggg

SEQ ID NO: 14598 - DNA, 1454 bp, Oryza sativa
  unsure (1)..(1454): unsure at all n locations
cggggaggggcccaatttgccgccgacatgaagaggtggagagagagagaaagagttgggaaaggtgggcgcgcgcgccatatgcggcatttgcgggcgcgcgcacttgcggaaggtgtgggaaaggtggccggctacgtgaagggcgtgtagtggggtacgaaagccgaagaaggtggccgccaacggcggttggggcagccgacggcggttgccggctagaggaggaataaggggccgacaggtgggccccacctgtcggtgacccggagggaggagggaggggacgtgggccggcccagcaagaaggagggcggcgcgggaggagtgggccgacggcccaataagaggaaaaagagaaaatggaaaatgaattaccagggacttaaatattgcttagaattgattttaaatgggttaaaattattttcgaggctctgaaaattccactaaaaatcctgttaatgtattatgacatgtggaacccaagaaaaatcccacaatgccatttcccattattgattgcatttattaaataaagaattagctctaggttaatttgaaccaatttcttcaagcgatttattaaacaaaaatttaaaactagcaaggggaactttagggcgtgacacagtccgagcaggcgactttggctcctagcagtgggctcctccacagcgtcgatctagtggcttaagaggtgtcagtctcggtcctcatctgaagttggttggcctcgctaccacctcacacccatgtcaatgcagcgttccatgcggtagttctcagaggcgcgagatggagctagtgttcatgcaataggatgggcttccatcaggcaacaatctgagctggctggggacaaaccagaaagctccaattagatatgttagcaagcacgggtatcaaaatgtacacaagcaaattggaattagcatgttgcatgtaccggatataaaagaagtgggactgcctatatatttgtcgataaattttcccccaaaaatttgacagatgtaattacagtacaatcgtagtgtagttacactgtaacttatatgtaattacactgtaacttgcatgtaactatagtataacttatatgtaagtttcacataattttgaatcgttagatctattacaagatttgttttggtgaggaaaaaaacaaatcatagcacacacatatatgaaagaatttgttctcacgacctccattttaccgaaataacatgttacggagagatttttgaaagttacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14599 - DNA, 22060 bp, Oryza sativa
  unsure (1)..(22060): unsure at all n locations
aagatggatttttttccttataatgatgtcaagttgattccgggaggatccacgatctccacaacttcatctttctcaccgtagcgttgtcgtcgaacttaggtcacacagttcataattactccttccgttttcaagactagaatatggccatgtccctaattgcttagttttaatttcaacatttagtgttagtgttagagacagatctagcctcatcaatcgtgtattacttacttattaattcctcgaatgacatgaactgtataaattgtgtaaggtaattagttttgacttattttttttaacctttctatgtttaattaagagataatctattctatcacattaagtttgctctagttcaataatttaccatcaggatatttctatactttttacaatatgccatttggccgaatactttttcaaaaatactgaaaatgccattgtggactcaaagagttataatgattggccatactagaagttttatatagttatttttttctctatcctggaataacataaaagttagtctatacatttcaatatttttggccttttgcatgtatttttttctgaaatacttatctattcatgtgataaacaactatatggataccacatacctaatagtagttgactaaatctcggcaggacccaccacataccatgtcttatacgaaaactgacttcggatatggagggagttccggagaagggaagacaaccagagttctacatggaaacgacaaggactactcttggacaaggggacacttatgggtataaaatacaaggccccctaggaggagaggggacacagaacaatagatcaagacacaagatcaacatacaagccaatatacgccaagacacaccgccggatatcgacatcagagaaatgcctggactgaccctatccggtacctacagaggccgggtatagggatctagcgctgtctctgatctcgccgggcacgaactcgaggaggaagactaccctgttgtcgacaacagttagataggctactccaaatattatactggtgtgattatggtgaataagagcaacgatcggcttcggccaacaggatgtagggctattacctgacaattcaggggcccgaacctatataaaaatcctcatctccgtctcttttaccttaatctcgcatatatcctggtaccaaacgatccccatactgtgcaaataccggaatcgcgacatcaaacgtcgacaagtccttactttttaatatgattaacctaaaactattgtttattataaaaaaatattataaaaaataaatattactccctccgtttcacaatgtaagtcattctagcatttcccacattcatattgatgctaatgaatctagacatatatacctatctagattcattagtatcaatatgaatgtggaaaatgctagaatgacttatattgtgaaacggaggaagtattgtatactcgaactgaacttgagcgagcctacttaaaagctcaaggtggtatagatttggctcgagcttttctcaagctcgagcctatgtagcctggctcggtcgagctgatcagctcgttgacattcctaattgttttgattgtcatccactaccaacaatcgatatactcgattatatcgtatactgattgatctcctaatataatcactgcttggcgcatgatctacttgctcactacatgatctcatctaaaaggacaaaaaaaaaattctaaaacttttgatgttgtttggattttaaatttcgtaaaaaaaataatcacctcatgaataatattattaagaaatcttgaactaagccacatttgtcacttgtcagcagagagccagagatgaggtttggcttgcctgaggggttagaatgtaacaaatccgaagcaagaagggtataattacaatattacatgttgtttaacgaagatgagaaggccaaaaaaatctgagcccctaaacccctcaagatcaaccacccaggtgccacgagggtttaagcgaaagcccccgcatcgaaccaaacaccggttcccccaaccgcacccccctccttccgttggcggcggcggcggcggcgcggcgccattccccttcctccgccaccctcctgttgatgccctcctccccaactccggccaccgcaccaatctcgtgttcgccatctcctcctctccacctccacctcaccgcccgccgccaaaccctagcgccccccatgtggcgccgcctccccgcccgccgcctcgcctccgccctcctctcctcctccgccccgctgccccaccctctccaccgcagcctcctcctcctcctccctgccgcctcacagcgtctcgcgccgtcgcagacgctgccgcggttcgcgtcctcctccgccgccgtcgccgccgagtccgtctcctccgaggaggtcgacgagttgcaccacgcgatcggggagatcgcccgcggggacccgagcgtctccgccccggctccggcggcggggcaggaggggcataggaggaggtccgggagagggaagcactcggccgaggctatggcggttccggcggcggggcaggaggggcataggaggaggtccgggagagggaagcactcggccgaggctatggcggtgcacggggtcgggtaccacaagtatgcgatgctgcgccggcggcagatccagattgagacggaggcgtgggagcaggccgccgaggagtaccgcgagctgcttgctgacatgtgccagcagaagctggcgcccaacctgccctatgtcaagtcgctctttcttggctggttcgagccactgcgagaccagatcattgccgagcaggagctcgtgggtgagcgcggcgcgcgggcctcccatgcccgctatttcaacatgctcccggctgatatgatggccgtcatcaccatgcacaagctcatgggtctactcatgaccggtagcggcgatggaagtgtccgagtcatccaggctgcgtgccagatcggcgaggcaatagaacatgaggtttgtcggctgtggctgagttctggatcttcttgtttgttttacttttcaactctgcgctccattcaagaatagttattggttaatgatagcttttaggaatgagaacaaaacataattcaggggtatcagtccttgggtcacaaaatattttacacgcatcacgacatgccacggtaggtgcggagatatgatatgaccataggccattggacctttaggatgaacgctggcagaattcaaaatgttctatatttcaatactattaagttaaatatatttcttcctgcagttttcagcgcttaacatcattagagcttatcatgattgcattaccaatttatttttcttttggagacgtatggttgtatgaaattattggagaagtatgtgtgtatgagttcaactattattgaaccatggttgaaataaagatcaagagcctcctaatataggcctcatcagaagcctatatgatttggttagttccttagaattgtgctttgctagcagtggggctccttcaaataacctcaggtaaaaatatttgtcaaatatgcagaattttttctaccataactgagaatagtgttcgtgtttttcagatataatttggtagtattcttgcagagctttgattatctagctagttcatgtttccctctgaacccaccaatttagttaaaaaaattccaactattgtccaaacaaagttatgccatgaaattatacctttattggctctcattcgtctattattttcttaaatattttgagaatatgttaattttcaattttcaatattttgtttcgactaaactattattgttgccagtgcaccaattatggcgacagtaatttatgcaataacattgctgctgctaatgaataaatgtatatgtctttgccctttgttcctgtataggttcgaatccacaaatttctagagaagacaaagaaaaaaagcaataaagaaatggataatgaagaagaaggaggtgattcagacattgccaaagaacaagagcgtctaagaaagaaagtcactgatctgatgaaaaagcaaaaaatacggcaagtaagaaatatagtaaagaagcaagataactccaagccatggggtcaagatgctcatgcaaaagtacgtgtctcttgctgaatctggttaatataatgtttcattacaacactattttgactgatgatagtttctatgtcttgctgcttaggttggtagtcgtttaattgagcttatgattgagacagcctacatacaaccacctgctagccaatcagcagatggtccacctgatatccgtcctgctttcacacatgaaatgagaactgtggcaagagagcaacagtaataatggcaactctaattttatatcttcttttacaaaagcagtttggtgtttcgtcctaactcatcattgtaatcaaacaggaagagtagtcggcgatatggtgtgatcaagtgtgatccgctggtccggcaagggcttgatagaacagtgagtggatccttctgctatcgtcttgattctgtcaaaagactcttctgatcttgcattccttgatttcctcatgaataatgtttttcctttgacaggcaaagcatatggtcataccttatatgcctatgttaattccgcctatcagttggactgggttggtaccttttgcttatctatgtttcttggagttctttggctgctatactatccattttaacaaattagatatgtggtatattttaaataatatgttattgcacctaatagtcgagatatttttttctagtcctatctgattagttcagtgcaagttggtgctgtttggtgaggccattgttgcattgacactctgaatatgaagcagactgctctctattgacatcatgcaaatattctataggtatgacaagggtgcacatttatttttaccatcctatgtgatgcgcacccatggagctagacaacagagagatgctgtcagaagagctccaagggaacaaatgcaatctgtgtttgaggtattcatttaacttgctcataatttttatgcaaattatattaataatttttaagatacaatcataagatatttgagcacacctgttgttatgttacagttgcttctattgttcatatgctcttggacattgacatgttgatgcctttttatgaagagaaaattctctatactctacatatccactctgttaacatgaattgccataagtgtactgggtgtctgggtcataaccctaaatacaaccccccctcccccccacccaaatccccatccccacgatacattccacatgctgctcgcttctgcttgcctctgcatctcatgactatgattggctgttcgcctctgtttgcaactgccattgacaccacccaccttctcaccctggcaatgctcgcctccacccactgttccacccctgaccgcacccaatgccagcctcctccccagctcggcctctgcaccctgtcggcaacgttctccacccccagggacgcacctccagctcctcccaggaaccctagttctgtttttcggaacacaataatattatcatttgcagctttgattaaaagaaaagcaatttttaaacaccaaaacctctaaaacagctgcaccaaatgagatctatcataatccacctaaatgccaagaggagcttttgtggttcaaccatttaatgcattattggtcacaggccttaaatactcttgggagcaccaagtggagggttaacaaaagagttcttagtattgtcgacagaatatggtcaagtggtggccggcttgctgacttggtcgatcgcactgatgtgagttgtcatttattctcataataatgctgtgagcatgtgactcagattcaatggtggtggttttatcaagatactttagttttagatatcaactaaaaagtttcatgtactctaggttgctttaccagagaagcctgacacagaagatgaagacaagttgaagaaatggagatggaccttgagagcagccaagaaggaaaatagtgaaaggcactcccagagatgtgatgtagaactaaaacttgccgtaagagactataacgggtaaccatcatttactcacttcattgcttcatctaatgaatactcatgttggtaacaggtagctcgcaaaatgaaggatgaagatggtttctactatccacacaaccttgattttagaggccgtgcttatccaatgcatccttacctgaaccacttgggttcagatctttgccgtggagttttggagtttgcagaaggtcgtccgcttggtaaatcaggcttgcgctggctaaagatacatctagcaaatttatatgctggtggtgttgacaagttatcgtatgatggccgaattgcattcacggagaatcacttggaggacatatttgactcagctgatagacctcttgaaggcaaacgatggtggcttggagctgaggatccattccaatgccttgcagtgtgcataaatctcactgaagctttaagaagcccctcaccagaaacgatgatctcacatattcctgtgcatcaggtaccttaactttctctcatttgctttagagagcaatgatcaattggtaaattccttatttatgcaatatagctatgtagtgatcatttgatggggctcttgttctcataaatatggtttttttgctactgatacatttttcatatggcactgcacgcccatttcctatggttcatctcagttgttatcatctatttgtattaatagagtttgttgtgagttataactttccaatacttgaatcattgttgcaagttatttcctaatcataattggttggtcgactaggtaggtaactgatgcagtctaacatatctcatgcatattgtaggcattccatatctgctttcgaaccacaagtagttggttgactagttgctcacttcgctgaattggtcttatactgacttgactcaacgtgataaacagacttaaaaatgatgtctaacattgcttccttcttttttagtttgttgagtaaattatatatttttttccagttggagagggagaataacattcatgtgatagtgaaaactcgcacatggctcacttgccagcctcacactggattctgttttccaccactaatttcctagacagaatagcaaaatctagtgtgttgttaaatttgtttatgttttaatccttctaaatgcagtctactcgcaacacagttttgattttcgctaagattcacttccatgtttaatcataactacaataacattttcctttttcaggatggttcttgtaatggcctgcagcactatgctgctcttggaagggataaggtcagtttgtgtttgaatagttttggtgttttcataaggattatttagtcaggcatggatcatcatcatcattttttttttggctagtagagttaatgattttcttatcaatttcatgtagttgggagccattgctgtgaacttagttgccggggagaagcctgcagatgtttatactggaatagctaccaggtatgtttggatggcattgtgtttagcattgcaccttgtttatggtaggatgcaatgctccattgcaacatactgggcatgtttggttgtctgcattttcccagcctggttcacatgtctcatcctggctagccttggcctggcttcgcagataaaaaatggcttgtttggttgcctgtatcctttgggccttgattaagatttgagatgtttggttggctaggaaaggagggtggtcagatttttgcatgcataaaattttgattggttggttggttgcatgaacattgaatttggttgccttgtcacttgggtggtgagattacccactttgctcatgggaattagctattgtatattcgttaacaatatattaacacctgtagttacctgtactaattaattgttatgggtctgaatacacagaagaaagacaatgatgatatacctgccactggttcttggtcccacatttacatgtcttgagaatacttttgagttttgactggctcattagcactaactacatagtacacacacattttattagccatctagtgttggatagcctttgtagcagtagttcttgtaggaaaaaacatgattgtggcaaccttctccagctgcatatcaccaccagcttgcttggattcaaaaaagaaaaaaaatatcagatacacagcaagcagtagtaactacaagacatagtatggttaattgaagtaacaaatcaaattggtacatgagataaatccaagaggaatcaaacaaatatgccaccaattgctagatccatgcagttcttagcttcggtgcaaaaatttcaatcacttacttcctccgtttcataatgtaagtctttctagtattgcccacattcatatagatgttaatgaatctagacatatatatgtgtctagattcattaacatctatatgaatatgagcaatgctagaaagtcttacattatgaaacggagggagtagtttttaatgtcaaattccaaccattatgcataattaacagatctagccaagattgatctcaaataaacccaaaaagctaggagaattgaccattagcaactttactccgcccagactaggtacatgataaatcaaacgctagagcgaaaaaaatcacaagaggggaaaaccagaaaggaacgcaaggaggcatgcactgcctccttgataccagtttccaccatgagcagatccaaatagcacacttctgacgtagacatcaagctctgcctctcttcctatccccagattactaggtttgcctcaagtacaagagcacatgcacagatgatactgttgacgggagcacatgtgcggtagtgacaacatggatctggagtggaagaaccgggaatcgcttctgtggtgactggtgctgagattccctggttttcggcagtcgattggcaagctcaatcaggatgaccgaggagagggggaaagagaaagatgaacgcaaatgaggaaggggaggtgagtggagcctagaggagagagaatgtttccatcaggccttggcttggtgagccgtttacatgagatgggcctggctgggagcatagatcaggcaaccaaacagtccagttttacatccgctcatgcaagccaatcctgaccaggcaaccaaacagacccatagcatatgctgtacccgtacctatttgcattctgtgcatcatgcacactgaattcctcatttttggtgaattccaaattattgcgtgaatgcaatattacaagctaattctagattagttcaaagatgtagtgtgttattttaatccatggcttagcagaaagaattttgtttctgcaggttacaacacttcccattgagtaagcaagtattccagtattattctaatttttagaactatataaccaaattgggtcctaccagatcatagagatgcatgagaatttggtttgttatcatgatgtacaatattggatataagttttaatccttgattagaaaatgtactcactgatacaattcatgctcactattatttatctgtaacaaggtcactggaataggccaatattctaatgtacagtatcatacacaatcaaaattgatatttagttgaggtccttcttagtcattttaaactagtgcctaaaaattgattaaatctagatttgaggatcatcaggtctagtttatcaatcttgatgcaactgatgccatatcttagaattaagatggcgagtggttcatagtttctgtacttgtgctagggtggtggaaattatgaagaacgatgcgctaaaagatcctgctacagatcctgatgcagcacgcgcacgtctgctacttgatcaggtagttcttcatatattttttagttcctgttgtatttgctcacatgactagcaggatggatgttctcaaaatcgaagagatttggttttcagatgaatataggcctgaaaacattagtcctcaagaaaatcgccatctgatgttttgctacaatctattaaattctctaatgctatttacgataactatatgttaaaaatggctaattaggttcctaaacaacactttatttcatatttttgaatgataagtaccgattcatcatccaattttgcccaaaatggttcacagtgagttgtcttattagccattttggaaatttgttaaatcagtgctcagggaatgaaagaagaaattacttcgggattcttttctttcacttaattgatctgtttatgtaaaagtttgctgcctatgaaatagtgatagaagggtgttttggtgcttgatgctgttcggttgatacataaccttgctgttgagaggtccatggattagagtttaccctttaatcttttacctgcttgattatcaattgcaggttgacaggaaattggtaaagcaaactgtgatgacatctgtgtatggtgtcacttatgttggagcacgtgagcaaataaaaagaagattaaaggagagagacatgatttgtgatgattcagaactttttagtgcatcatgctatgctgctaaggtcgaatgtcttattcagtggaactgttttatttcattatcctacataagtgtaattaaattgaccatataatatttatttatttatttatttttgatgcttgataggttactctgacagcacttggtgagatgttccaagctgcccgcagcattatgaactggcttggtgactgtgccaaggtacgatagttatcctaagacagctgcattataccaatttgatgctgtaaatacattttgcagcaataaaattcatgtctatatcaatttttgcatcaacaaaatccatgtctatgtcacttttctacagtggcatcctacctctttaattggtattgcaatttaggaaagacgcaagttgtgaattacctcacctgttctttatgacaggtaattgcttgtgaaaatgaacctgtgagatggacaacccctcttggactcccagttgttcaaccatatcgcaagcttgggaggcatcttgtaagtgttataagtatttattttattgttgccaacttgcaatatgcctcagacatgatgtaataaggcaacatgtgccttctgttgttctgatattaaagtggcattcttgatgttctctttgcagattaaaacatcattacaagtcctgactcttcaacgtgaaacagataaggtattatcaatttggactatattccacattctgacaatatcgctatcagctggttgctggtcgaagtgtgtgtgatgatgacatgtagtagtgtagtgcactttttgattaaggaatggaccagatttcccatcaatgggtcatctaatgaattgtgtcacggctttattcctgatatttcattcatcgtggacatatgttaagatcggatgaactaggattaacccatatcctttcctcaaagtaaacacctcacttggtttctattttattttttataaaaacattccaccagtcactgactaccgggtgctagtgccttttttcagatttcccgcttagaacttagttttgtttagcacatgtgttatgagaaaacaagcttttgagtccacaagtatgctcttgttaagtgtctggtttgaacttttgacattaccaaatcaaggtgaacagccattatatttttatattttgcacatctgcttaaacaagctgaggccggcaactgcaatttattagctcatcgcatcaactgtggtactccaatcatcattcaacatcagcactatgtacaatctgcaaagactgatgccatgttttgctcatttgcttactgatcagttcactgcctgtgcaatccctgtggtaattgtgcagaaaatgggttattgaactgtggacgcaaatggattattttcctcatcacttgctgttgtatcttggaatctaatagatctttagaatacttgatactttacactaaaattcactcaaccaggttatggtgaagcggcagaggactgcttttcctccaaatttcgtgcactcccttgacggttctcatatgatgatgaccgctgttgcttgcaaaaggcaaggactaaattttgcaggtaccagttttactgtgttctgggaagtgtttatattatcccttgcattaagcgcttaaggagaagtacattagtcgcaacatttttttaaaatcaatgcaggagtgcatgattnnnnnnnnnnnnnnnnnnnnnnnnnnnnnnnnntgatacaatgaacaaaatactacgagagaagtttgtggaactctatgatacgcctatcctcgaaaatgtgtgtattttcttatcccggttattatcacagatatttaacaaccattctatcttgttcagaatatcacttaagaaaaatcagatttttttttctggcatacttttcttgctccttaagtaattttgcttggattatttttcaagttccccaacaaatatatggattaatatgagaatgagaccatcgaaatatgtgagttatgtgcacctcctagcataattagggcattcccaatagatagttactatagtttaaataactaataaaagagaggaagagaatgcctctaataacaattgcgttagtttgttgctaagcatgttaccaggtgagagtattgggtaaattaatttgtttctgcttgtatctctcctcagaaagcattttttcagtgtgaaatatttgtctaatggtgcaattgagaataataaatgtgtgtttcccttgtcttcccatgcttctaaagttgttgagtgttaagcatttccatttatttgctatgtagggtagctgaaagatagtctgagataagtgttctctttcataatatcctagaaatatcagtattaatacagtttttctttgcagtgcatgatttgcatgtttaccgtgttggcatttgctggtttttctgtgttattctttgtgtgatagtgagtgttgaagtgacaggttgcataactgacagtatttttttggtgcagttgttggagagctttgagaaatctttccctgaattaaaatttcctccattgccagagaggggagattttgatctcacggatgtcctgggatccccatatttcttcaactaagtcaagctgtggtggaaagcatgttattctaccttgctttgctgcccacctgtggcctggagttctattgaagtatatgagcggcccagcagtctcagatgacgaaactaattcttttgctagctgactgaaaaattcgtggatgtcttgcgtgaaagctgaaggtatacctagaaaaaagcattttaaacagagctggccaaggagatagttgaggggatgtcttcaagcaacagtcaaataagtgggaaccgatcaagaaaagctctgggagtaggttttgttgcgtttaggcttactgtagtttatatattagtgactttcttgctattcttttttttttaatatcaggctcacgtttagcacggatacatcttggaagatgttctggtccatgtaaatgtaattatgtaattttttgccctcttaagtttttttctttttttcttttgtgcaatttatagagggggtgaatctgatgactaaataccggcaaaacactaatttatactagttatcattgcggttgtaaggtaacatcttaaataataaagtgatataggttggcttcctcatcatttcagacgtgtatgtttcgggcttgctgaccttgaagatatcatgctttcacaattctgtccaacgtctcaaatgtgttgtataaccgagtgagtgttcattttggcgcatctcatttttgttaaattagaatgattccaatatgttttcaatggtttgtgtttgctatgatttccgatttcttatataccccaccagtccatcaaagttttcttgagtttggttgtgaaataattgtacccattattttatttataataattaattatccggaaattaaataaccagtaaatcagcagtgatattttttttactattttcataatttgtacaatatttactaaatatttaatttcgtgataattaattattatatatatataaattttggggtatcgtaactaaaatgcatggcatcaacccgaagacttagttagcatttggtggtaagtctaaggactgtttaaaaatattttgattgtcttaactcctaaatgtattctccgataaaaacctacgaaacgtatatctaaaaatatatgtataaaaacagaaaagtaactaagcggagatgtccttttatttcaccgcgcgtctgtacgctccacatgtgaccggatcgaattttatcgtcagttatctttctagcgaatctctaattatatataggtctggtcagttaccttcctagcaaatctctaattatataggtttggtctttttgggtacacgtgtatgatacatggtctagcctaaggcaattccttggatctactagtacaaactacaccacgatcatatggaagccctaggcactgagaaaataagttctttgcatagctaatcgtacaaaaatagagtatggacatcagaccgactcgcaacacgtggatggcaaaataatgcctactgcccgctggcctctttgccggcataccatggagacaggcctacacctcatggcggaatgtggatacaccagaaggtttggagtttgatttcttacgatcaaatcgaaccaacaaattggaggaaccctgtgacgatccacgagtgatggtcgaacctggctttcaccccgtaggtaccaaaaaaaaggcttgcgtagccttatccttctgacttcttagaaactatggaaatggtgaaatcaatcggtgttcgaactcaaaaagctatcggcaacaaatcgggtaccgagatcgaataggaggcaaaaacttggaccttggcaggagcaaagggtctttgtagcatagtaccttaggactcacgcttttcccctttttgtaaatattccataaacactgtacagtttttctcatgctttcttttgggggaaagaatgctttattgatcactcattgatataattacagtcattagcgagtgcctcaagaatacatgaaggggcctgcaagcgccaaactgctgagtgatttgttcgcatagctaacttggccagattatgagctacgctattgcattctctcctagtcttctggattctaaaatccggtaaaacagccaacaaagactttatgctatgaagtgtatggcacagcttcgatctatcagttccctggttcttcagcaaacataccaaatttgcacagtctgtttcaaggatcaaaggttgtttcacccattcagctgacaggtttacaccctcccaagacgcaatcgtttccgcttcctcagccgagctacagtgattaatgaccctccatggggtaagcagaaccgaaccagtgctatcacggatgacaatccccgcaggtcgcgcagcctgaactctggacgaacgaaccgtccacattagcctttgtctagcccgtcggtggtggagtccatctatcattaatggcaggggtttggttacagttctccttcagaacactctgttgcagaataagggaccttttcctttctcatctaacttcccaccaatcctggtcattgttaaggactcccattagctctgaaggaaaattgagcttccctgcactgatgctttcccatagccatgcacacaatcattccggagaaaccatgatctccagagaagcaggaggaactttgcccggccctccggattgatggaatcaagaatgattaagagccaatccggtccactcctgatcagacaactctcctttggcatctcccatacctcccgtaacagtgatctcagggcaacagctcgggtacaggagatggcagcatgaaagcagtcttcatcttcatatccacatatacggcaagttgcattcacctccaacttgcgcttcttccgattaaccattgtagtaagaccttccctggctaatctcctagcaaagattttaatcttttgcggcactagtgtagtccatatgcttgcccaaatttttcgttctccgcttgtctcggagctagaagaacccaactcagatatattcatatgatttgtcaaggctagtcggtaagcactgtggactgagaaaaatcctgtcttctcatagtgccaagctagcaaatcctctgttctgacttgcggcaatttaatcttcaaaattttcattggcatcatactgggagcaaacatgatggatgagatttgtattccaggtgtttgtctcctgattgatcagttgataaacccacctgaggcggcatctcccactctggcgtgatagtccaaagctggattctctaggaatccactggtccttccaaattccatctccgattctccaaattaagcctttcttaagtaactcaaggccatgttcaacagctttccatgtaggtgaggtatccgatgggaaaacagcatcaatgagatcacagttcggataatatttggcctttagaattctcgctcaaagactgtcaggatactgaataagacgccaagcttgccttcttagtaaagcctgattgaacagttgtaagtcccgaaaacctaatccccccatatattttggtaagatcaggttctcccaggctgtccagtgaatcttccttttgttttcgtcatctccccaccaaaagtctcttatcattttgtatattcatcacacacagtagcaggcaatttaaatactcccataacatatgtcgggatagcctgtgcgactgatttgattagaatctctttagccccagacgacatatatttttcagaccagtcagtgagcctcttagcaaaacgttgcttcaaagttttgaactttccagccttcatcctaccctccagagtaggtaatcccagatatttcgtctcaaaaacagttgattcaacctgcaaagcctgtcttatattctcccgtagctcatccgggacatctgcactaaacaacagagaacatttttgaaagggtcaattagccctagaaggggagtgaataggctaatttaaaaacttaagtaaagcggaagcaagaattttcggaactaagcaagaatttttggaacttccgaaaatactcagagcagtcgaacaaaagaggataactctagatcaatagcggcacaagcaagcaaagctagaggagagggatgaagaaatatcaccaagatgaagctcacaaagttgttcccggagttcaaatccttaaggggattctactctctattgaagagctcactaagagccgggtcttagctaaccctttcctcaagaggttgcactaagcacccctccttccactaagaggtatctctttccttgcggaggcgagatctggcattcacaaacttctcccggccaaccacacgtagatcagtggctcgggagcaacacctagccgtctaggagtcctcaacctccaagagtaaaagatgatgcaaggaactcctggagatgatgcaagtgctcacaaatctttacgaagaccacaagaagcacccacacaaactcgaatccacactctcacacacacacctgtaggatcgagatgtcgactagagggggaggggggggggtgaataggcgatttaaaactaaatgacacctaatcaaaactaacataagttgctaggcttggtgagggtcaactctaactaagtaactaagttatgttttgcaaacctagggtgacagtggctcaattatatctctaggaaagtaaatcacactcctatgtcaatgtttagcaatcctagggtgatatgatctcaagaatgtctctaaaaatataaattgtacaaatgtaaatgtgacaatcaaatgagacaaggagacagagatttttcaccgaggttcggaaacttgccggtttcctactccccgttgaagcgagcccaactccgccgctcaaccacgaagccaccgcacgccccctttgtcaaggggtgggcaaggcgggagccggcccatggagaggactacccaagcctcgatcactagggtagttcttccttcactccgaaggtggtgaactccaaaccactcacaaccggcaccggacctcctccacaatcttctcggagagatcaccgggcaactcctccacaagccgtctaggaggcggcaacctccaagaataacaagcaatgacccggcgtggagatgatcaatcaagtgccacactagctctacaaatggaagcaatgcacttgactcttggctaattaaccctctaacacactagatgtatgaacacaaaactcaagtgggtgtgagagaggtgcaaggggtgtatgcaattgaattgggtgccaagagagtccccttgctgctggagggggggtatttatactcccaccaaccaaaactagccgttgggggcgaaatcccccaactctgtgctctgccggtttgaccggaggtatgtggccggtcaaactgtgctactctacaacggctgtcattgggccccacagccgtagccggtcagaccgacatggggtggccggtcagaccggcctcggcttggtcagaccgccatcagctcggtctgaccgaatatggctccggcggctcgggatcagcacaccgagacggcaccatcccggccatatggctggtcggtcagaccggcccgcacccgccggtcagaccggcctagaccctgcggtcagaccggctgccctggccggtcagaccggcacttgggccgcggtcagaccggccctggtcaggccgaaaacagtgagataaatgattgtgtgtgtgtgatgaaatgaaagcacaagtctaaatgcataatgacctaatgtggcaattaaaatcatctctttgctaggtcattacccctcttaatagtacgacaaagctattaataaactagcacaattttgatcgcccaacgcctcgataaatttaaaatgaaaacactagtctaccatcttctcttccttttgctttgcgccgtcaattttaatccatcaatgatcatccatgtgcacacaattaagtgaacctaactcaaacaaatagctcaaacacaatggttagtccacaattagtgcttgtcattaattaccaaaattaataccgtgggcctagatgcttcaatctccccctttttggtaattgatgacaaacaccacaaatatatataattaaacacagagcacatggagatatattgcaatgacaagcaaaagctccccctaaacatatgcataacaacaatagcaaatatggagccaatttcaatttcacatttcaacatatcacaaacacaagagcaatatctcaatatgaacttcaagaaatattcattcatgagcataagatggtcacatatatatcaatatcacatataccatccatcatcgcacaagttcacatcacttaaccattcaactcacataagtcacacatcatcctaaaagggctcacaaataaacataggctattacaagaccatgaagggtccaaatgacatagagttcaacaaaacgataaagaacacacaatatagagtaatagcccatacccatacaaaatatggcccaacacaccttaacctattagatatgagatcttcatcaaaatgttgcttcatggtgacaatcgtatcaatcccaacgggtcagaacatctcttgcaaatccacaaactccggtgtctcaccaatgtgcctccaagaaatccacttgtgttcggcgaaggctttgttggcatacacttgctcatacacggacttttggaaccgtgtatggaaccttggatcattacaatcattaggcctccggaattgatcatgatgtcggaggatagtgtattgctgagcattcctcaaagttagcataaattggatggtgggatcgagaggactcccatcatcacttgcctcatcatcctcaccatcaccaccgccattgttgtcacgaccgggaaaattgccttttcccgaacgctagtgtattaatccccgtcccaggaaaagccggggtacaccacacaaacatgatataacaggcacatctttattatatcgataatatttacattattacaaaggcgcttcaggcctggcaatcaaaaataaacagcagcggactagcgggcctacggctccatcttcacaggcgctcaactggggtataagccaagactccacctaagacttcttctccaaagcttctcttactgaagggggggagaaagatagagcaagaatgagtacaaccacagtactcagcaagccacaccggagatgaataattaatgcaagggggtacaaggggtaataatataggggttaagttttgcagtaaacagcatttacaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctgcggccggaacctccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatgttacctaattaatcagcgaagcatctacctaaattcatactagtggaaccataaatagagtacccactagttggggttttattttcctagggtgaacaaggtaataatatcaataacaataatattaaggtcataacaaaggtaaataggcatggctaaataaaacagtgatcacgcgggaatttaaataaagcgataatgcaataatttaaagcaacataattttataaactgggattcaatatgttcaaggatgatgggacttgccttgctcagagagaacggccttccgaaccttcggcgacgaccgcaaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaagaaggctgcgccgttgacatgaggaccccacatgtcaacctaaagg

SEQ ID NO: 14600 - DNA, 1698 bp, Oryza sativa
  unsure (1)..(1698): unsure at all n locations
aaacggactccactagacaccacacggggngcacacggggaaaccacgcgtttttccgagcggacacactaacacggggaccacacgcacaagcgaacgactgccgacaccgatacacgggtaccggggccgacaaccgcacaacgggcacgggcgacaccgaaaggacagggacggggcaacgagggagagagaaccttaccaccacgcgacgaggcgtgggaacgacaacgacgaacggcgcggtggaaacggacggcgagggaacgacttccgcggcgatccttgaacgaaggcgagacacggccggcacgagacttgacgacgcggagccgaggacgaagacgatgatggggctgcggtggctttgtttgacgaacgcggacgacggacgagaacggctcgacggagggacgaacgccacgacgaccgggaacgacgagaggacgacgaacgactactacgaccgggaccggcgaggaggcgacgaggacagccggcaggggctgcacggggacgaggacggcgaggaccacgccgctgcggtgcccacgacggagctggcgccgcgagacgactagccgggcgaccgatgggacgtcgacgacgagaacgatcggagacgacgatgatggaccgcggaggggtttggatggaggggaaacgatgccgaggacgaccttgccgctgcgatgccggaggtggtggaggtgtggccgaccggtgcacgggcgaggagggaccggcggccaaacaactccggcgaggcggacgaagatgttcgcggcgacgttccggtgaaaccgagggcaggccggggtggagggcgacgctgcgacgtcaacggaggagacggcgacgtcggtcggcgtaccggcgacgaacagcagccggccggagacggagaagtggtggcgacgccactggacgccggcgaggaggccactccggcgagcttcgggcgaggaggaggtgatgccggggatgagggcggcgtcgcggagccgagggaggtggtggcgacgttgaccggcgctcaggcagggagatagaggcggctggaggcggccggtgcggaggaaagggaagggcgacggcggaaacgtagctccgggggtctccgcgggaaacggagggcaggccggggtggagggggtagcggcgacgctggaggaggcgacggcgcggccggccggcgcacggtcgaggcggcacaggcggctggaggcggccggcagcgtgggagagagaggagggcggcggggagagagctagggaccacggggaggctcgggatggggctaaaacgagataacgggggatgaggatcccattttataggatgggggagagagccggccacgggaggagcgggaacggcggcgggaaccacggccggcggcaatggagggcggccgaggaagacgcgggcgttcccggcgattgggggcgccattcaagggggaaattgggggggattgaagaggattcaatggggattaatttcccctatttaattttggaatcccatgagcgaatcacacggatttgagggagggaaggagtagggttcacgggagagagggaagccgggcggcggctggaggaagaaggcgacggcggcctgacgcgtgggccccacgcggtcgggcgcgcgtcgtcagcgcgagcacgtgcgcagcacgggcgggggggggg

SEQ ID NO: 14601 - DNA, 3334 bp, Oryza sativa
agggagtgggccgggagggggaggggaggcccgggagaggagggaaagagagggaggagagggagacttcggccgcgggccgaaagagagagaggggagactttgagctgggcttggcccaaaggaggaagaggattatttttaggttttctttttattgaactttgataattgttgttgttgtttaataaatatttccggtgctctgaaaattcaagtaaaatttgagggctcattttagaccaaggagaatttaacaaaaattctccaggccacattcgaatttttcttgtacgtattttagtgtttgccaatttctttccgaattttaattaattctattattccttttagaaaatgaattttatttcgggatgaatttatcaggacgtgacaattgtcatcaccaccatcactaccattgtcatcactacttacttccacctcatccccctcaacattttccatattttcatcctcactttgaacatactcatctccgcttgattcctcattctcactgacgggatcgggcgtgggctcacgacgatcacgacgagtgcggggaggcatagctgaaaaacaggagcaaaggatggataagcaacaattttagaaggcacttggcaagatggaagtaaggtgtgcactgcctgtcaggggcggtcagaccggatgacataagccggtcagaccggggtgtacctgctggttagaccgcaagatgcacgctggtcagaccggcggctcgagcccagttagactgccgggaacaagccggtcagaccgcctccttgttcccggtcagaccgccactgacaagtctcatgccacaaaatttccacaccacacaaatgattctaaacatactaggacaaaatttgcacatgatttgagcatggatatcaaggtgtaggtctatttcatcaagattggaacaaagggggaaaagtacccttaaccctagagattaaaatagaccgattgagagcaatgcacaagagggagagtgatttactggttgaaggagttgaatcacaccaagaaactaccctctattggtgcaaatcgaagaacacctcttccttcacctagggttccatgccatggatcacaaactcaataaaaactcaaatcagtccatggaatagagagagaaagaggaggagattcacttacggtgtaaccggagagaaatctatggtcaaaccgaatggattttgatggagggaggtggctagggtttgggagaggagagaggagaagaaaattcgagatggagaagtgaggggatgagaaggagagagagggagtcgggttggagaagaaagggtaaaaaccctgggcccacctgctaggccggtcagaccggccctatgtggctggtcagctccaggccggtcagaccgggcctatatggccggtcagaccgcccgctccagccgactgtgcacaacccttgcacagttcggctacccccacacaataaaaaacaacaaaaatttgatttttggagcaaatttgaaatgtgtgagttgaaatatttccaactatttataacatttgaaaattatgaagatttgcaacaaaactcacttgagtgctaggaggtgaccttttatggtctataggggtttttgggcgaatttgatgttcaaacaactttcgaaatgtttgatttttgagataggtttgaataccaaaaacatttcaaatcctcttctctaccaactttgttttgaaacttttctcaaattccttctcaatctcattttggccaaaactaagaatctagtttcttcaaaagcgggcaaaaatggcattttcattcaaaaaaacatttttcttgcaatatgaggcttggaaaacatataggaaaccttttgaaacattttctaagagatagttttcaaattacattgattttgtaaaagttttgacttatgttgacttgggcattttgaaaatactactagcaccactagttgatttgctcacatataaaaggaagtagagcacatgcaagagtgcaaaactcccccttaatgtgacatgcttcattttcgtaatgaagaaccaaatggcagtaaatccaaagcataagcgtgaatgagagcaaatatacacaatgcaaaagaagcaaccatggtgcaccatctcaagccacattagagaaatctatgacatttaactcattcctcaacctgcaaaagcgggtttcatcaagaggcttggtaaatatgtcggctagttgatcctcggttcttatgcggctaatgactatgtcacacttggcaacatggtctcttaggaagtgatggcgaatatcaatatgcttagttctagaatattggactgggttattggctatctttatggcactatcattgccacatagaagtggagttttggtgaaggatataccatagtccaacaatatttgtttcatccaaagcaattgagcacaacaactacctgccgaaacatattccgcctcggcggtagagagggctacggagttttgtttcttggatgaccatgacacaagggatctaccaagcatttggcaactaccggatgtgctctttctatccactttgcaaccggcatagtccgaattggaatagccaacaaatttaaacttagcaccttttgggtaccacaagccaatagtagaggaatgttttaaatatcttaaaatccttttcacggccactaagtgacactccttaggagcggcttgaaaccgtgcacacatgcaaacactaaacatgatatccggcctagatgcggtaaggtaaagcaagctaccaatcatagaacgataaagctttaaatctaccggtttacctccctcatgaaggtcgagatgcccattggttgtcataggtgtcttgatgggcttcgcatcctccaagctaaaccttttaagtagatccttgatgtacttggtttggctcacgaacgtcccatccttgagttgcttgatttgaagtccaaggaagaagctcaactctccaatcatggacatctcaaatttcctagacatcatatcaccaaatttcttgcaaaatacctcattagtaaaaccgaatatgatgtcatcaacataaatttgacacacaaagaaatcatcaccaatgatctttgtaaaaagggtggtgtcaactttttcaattttgaaaacctttgacaaaagaaaatctctcaatctttcataccaagccctagtgagcttgttttaaaccataaagagcttttgagagtttgtaaacgtgggtaggatttttaggatcttcaaaaccgggaagttgttcaacaaagacaaggtcgg

SEQ ID NO: 14602 - DNA, 11461 bp, Oryza sativa
cccttactaatgtcacccaacacttggtcaattgggtgatccttggaaagagcggtgtgtatccttggtggcataggtggattttgtgccttctcctcctccacctcaacttgagcttgacttggcgtagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttattgtagacccggtatgccttgctatttgaggcataacctagaagaaacccttcatcaacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattggttgcatggcaagcggtgtttatggctttgttgacataaaacacgaggcctgggagatctgcttaactccagtgcaggtccaaaactcgccttcgggtatgcaagtgtgctagttgatttgatcctgcaatcaacaagaaataaagacaaagaaatcatggttaaatccataaacgatagccgatcggctaggtgccgatgacatatcatttatcttcgggccgatgtcatatgtaaatcgatcggcagttataaatagataataaagaactaaatctactcgatcggctgtagatattaacaatatataatcctgatgtcgatatatatttaaatcaagtgattgggatagatcggtcgtcgtgccgagacagtataaatcacttagaccgaaatatatattaacaacaaagctatatatgttcatagcatagccgatcagatagatctagcatgtatcggctaatactccgatacaactccatgttaagatattaaaacaagcagaatataccaaacaaaagcttaatatacttagatgcaataagatcttaatataaagggcaggtttaacatgtcaacgaaacatatagagcaaatataattaaaccagataagatcagttgaaaccccgatactaccctaatcggcaaccagaaggcaggctagagattgatattctaagcacgacttaatagatcaaactcaactgatgcagcattaagtatgaaaagaagaacaatatctacacaatcaagccgctggaaatttcatagagtggtagatatcttatataatctaaatcaacgtcgacatctaacctaatcggttgccctctgccaacagatgttagccgattgtgggttagatggcggtattgctagagattatgtaagatatatgataactcgacgaattacataaacaagattagagtatcataaagatggaagcactaatcccgagaatgcaagccatcataacaagttttacctcttgttgaagatcgaaaccgatgcagctcaacttgaaagcaagaactcgtcgaaataaaacaaaagcaaaagggtggcgatgcgccgaaattgtattgaacgtgtgtgttaactgattacatggggttcggggtctatttattcccgaaaacaacaaactatgtccatatcggacacgactcttatctctaacaaactctaagataccataagtctttgcggcagacttttgcccaaacatatctctaaggaatttacataaaatatcctaatcaatagatacaattgccttctcaggactctatccatgcgtggtaatcatcttgaagcttatcaactcaactcgatgtcgtacacaagtcattttgccggaatcggctgtatcacttaacccagtctgactcggacttagccgatccaatcatagccgatccggactccagccgattcctactctgtttctgcaacgatcttcatctttggttccacttcgatcttatcctcatctccgatactgatataaccaaatttggttgttaacacatgccccccaagtccggaatatttggtaatgtttcggatttgccatataccactccgagcaagattcgcaatctgtcgtttcccaaccgttatcctcagcgctttaaatactaaccgtcgccctaaaaaatcttcaccccgttacttccgttttcaccgccgaagccaaccttctcctttctctctccggccatttctccgacgctcgaggcgatccccaagtgatttcgtctccggttagacctccgcccgcgccatcggcatagtatgctgagataagttctcaccggctagatcccttttcctcgcatgaaatcgatttccccttttctcatcttgttttcttcttcttgattcctttggatttgcagcacctttccaacctagttgctattcccagcctgtcacatgaaaaccactactttcttggtccaatcggcaatcttgaccccactgattttatcatcggtgaaaccagcataatcccctttagattagccaaccctaatctgggtaactagaagaatactttcaagtcttggccatctcttgagaaaaccacccctgagaagagttggaccaaatggtaccagcacgtatcgcctagtaagaaagttcactgggatgagattgggatcggccaagcgcttgccctcaccatagccaattctgctaaggatgaacctctgatggctgccgccacctatttctggtccaacaccatcaacgccttcttgttcaaccaagggccaatgactccaactttgatcaacattaccatgatcatcggtttagatgtaacttcatcggctaatcctatgagtatgaacaccaagaatcaattcgatttcaggacaaaaagcataggtggttggtctggctatgtggcagcatatatgggccaaggatctgttactcctcgagaacatgtggcctttttactcatgtggctagaaaagtttcttttctgtggatccagttgcagccctacgaacaactggcaatttgtagccgaagccctagaatcaaagagacaatttcctttgggcagaatccttctcggctatctataccaaatgctgaatgatgcatcagccaagatagctgttggctcagtagttggagcaggtggaccatggtggctattgcagacttggctaaatctgatggttatgaaagttatcaatcgaccatctgtgacagaagctgaatttctaaggttagagctgattgtagacgatgatggagagtaacgtactcatcgtagatgcatgacatatgaagaatatgcatccacaccagctgatgctggtgcaaaactatcggctgaactactcaaggattggttctgcagcttttatgaaggctttcaaaaagatgcccgagtctggtttccttatgaatattcagcagacctcaaactaccatcagacttcagatttgaagacatcaaccatgaaagataccaaaaagtccgagaagttttcacagctgcaatcagcccatgcatcttacccgtcggcattcaccaagggagaaacatacaagtcttctatgaattgtaccacccaatgagttcagctaggcaacttggattgggccaactcccaatcggcttattctttgccgacaagatccagtgccgaggagaaatctcatcaactctgatgatggatcggctgcttaacctccaaggacctcctctgggtagtattgaaaatatcgaattggcaggattcaagagcagaaactttgacagatggtgggggtgaatggaagctgcatctatttcatcaaacggcctcgatatacatgacagatctattccttgatgtcataccccaggtaaactttgtcattactaaactacataaatgtcagccgattcattacttgactaatcttttgttcctgttttgcagacaacagaatcttcccctccacatcaaagcaatagtggtataaatattcaatatgccccaggtttaattcctaatggaggtggaccatcccctcctgtcattggctataatgcccccaagacctcaactcttcttcaaggattcatcagagaaccagccgatacaggtaagaagagaagaacgaggttatcggccgcagatacattaactctagccccaaagaagaaggccaaactcaagaaacctaaaccaaccgatgatctgcctgtcctggatccatctattgagcaagctctggatgaagaagacattgaggataatgttgatcaggctgcagccgaagtgagtgacacagaaagaacaccatcggcttcacccaagcagacaacgccgactccttctgcccccactcatctcttaagagtaagcagctcccttcaatatcttttgtaattatttcactttttggccgattactcatagactttgtagctgcagaagaagaaaattgttgtaaagaagaaatcggcagcaccaattttcaaaccagctccaccagtaagttattcttaaatttactagttgatttcagcggattttgtataacacttgtttcttttactgcttcatcctcctccttcttcccctgtacaacaatcgtcgagtgaccgaactccatcggctgtggggagtcatcatattgaggcagaagtacaaccaactgctcctgctatcccagtacttttcctcctgatgcaaaaaattagatcgactatatctacttagctctcaatcttcctgaaattgtttctgcaggttttagccgatctcttctcttttgacattagagattatcttaacgaagaaacagaagaagacaccaccagcaaatctttggttctcttgcccgatgacgtgaagaaaacactcgaagacatatctcatcggctggaagcatcgtcactagacaacttggtggtaaactgtgggccaattaggactcgctacatgaaatccgagctctaatcccagatgagctagccgatgttcttactccagcagtctatcttgaacaacatcaattcaagctggagaaggccaagctaagactagccgaacgtcgggagcgcaaggacattgaagccacaatccaagccaatcgacagcttgttcatgaagagaagaccaaacttgatcagctatctaagggtccgattaagtccaatattgatcggctcgaagctcgcaagattgagctcttggcacaacttgaagaatgcaatgccgagctggatatggaacatagaaagttggccgatctcccaaagtctatcgaagagcagaaagtgagactcaaatcggctatcaagaatgttgccgatctgaccaagtctttgaaaatcatccgtggaaccgatgctcaagacgcccaagccattgaagaagtagaacaaattaggcaaagggccatttcggctatccaacaattcttgtctcgatgactttatttgtaatagacctcataaatttttgtaatcggtcaagatactctagtactttactatcctgataatccttcgtgccaattaatataacttctaaattcgctcaaaaatttgcaattttccatatatgtgcccccctaattttacaatgtcaaaagcattgataaaattataaaaaatgactaagggcgatataacaatatcagccatttgtacatcggcaaaccacaaccgattacaatatgaaaacaactaaggacgatataaccatattggccactgtacatcggcaaatcacaaccgattacaatatgaaaacatctaagggcgatataaccatatcggccatctcaaggcgatgtaaacacattggctatcatgtatcggcaacatgggggatgctaattggcgcgtacgcgccgcaacgtaaagtcgcgcgcacctgctccctggaatacggctcagccttgcgttgaatgccgctaatctatagagattagcactaatcccttttgtttagcactaattagatttttttatagaatgataaataaatagttgagttgaaaattttaaatatgaattggaaggtttgaaaattaagtttaatgtttgaaaaataagagagaaaatttcagatttagagttgaaagtttcaaaattgagttaaaaatattttcaaatcttgagttagaaagtttttaaatttaagttaagagttctcaaatcttggcttgaaagttttcaaatataagttgaaaattttcaaatcttgcattgaaagttttcgaatattgagtcgaaagttttcaaatctaagttgaaagttttgaaatcttgagttgaaagatttcaatctcgagttgaaagttttcaaatatcaagttgaaaatttttaaatctgagttgaaagtttttaaaatttaacttacaaatttgaattttgagttaaaatttttttcaaagttttaagttaaaagttttcaaattttgaccttaaaatttaaattttaactcgaaagttttcaaatctaacttaaaaatttcaattaaaaaaatcttctgttaattctataattatccttaactaaacgaattagttacgttaacacgttgaaaaaaaatctggaaaaaaaaaatctgcgcggcgtgcacctcgccggcgcgtacacgccggctagcttttctgcggcaaccttagccgatcatgcgttaacccaaaaacttgggtaatatttcttcaagtatttgccatttagtgctctgccataaacttctccatcaagtccttgcagtatgtaagctcctttggatacaactttatgaatttggaacggtccttcccaattcagcgaccacttgccgaatttgctatctcgagttccaatcggcaaaatcaactttcatacaagttcaccttccgaaaaatctttgggtactaccttcttgttgtaatgccgagcaactcgtactttatctttagtaacctttgcaagggctcgcaaacgtgactgaaccagatcttccctctcatcggccataaggttataatactcatcggctgttaaatcattttgtaattccgttctcctggagccaattctaacttcccatggcaaaacagcctcatgcccataaacaagtttataaggagggacttggatcgatccatgacaaaccatccgataagaccacaatgctttggccaaccgagtatgccattgccgaggataatcagaaatcttccttttaatcaacttaatcaagcttttgttagatgcctcggcttacccgttagcttgtgcataatatggtgaagaattcaataatttgatacccatgctatcggcaaactgaacaaactcatcggacacaaagatcgaaccttgatcggttgtaattgttttaggaataccaaatcggtagattacatgctcctaaacaaactgtatcgcatccccataatcaaccttcttcaaaggaatcacctctacccatttggtgaaataatcggtcgccaccaatataaacttatgtcctttactcgatggtggatttatcatgccgatcatatcaattccccaacctctgaatggccatggcttaatgataggatgtcacgccctgaaaatcgcctattttaataattcattctttaattcatttttagaaattattttaaaagcttacaagttgaactctaataatctaggaaaaatttcaacataaaattgagctagataaaatttcagtaaatactttgcttgtttatctattttctagatttttctgggaattatttgagcaaggaaagtatttttaataaatgaaacatcattccactaattattttaattgaaaaagtctttaaaaccctcccgtaggccgttgggccgtttccggcccaactcctctctcctcgcgcgcgccatgcagtccaagtcggccaaagccgagccgccgccccactcctcccctcagccgccgacatatggggcccacatgtcagggttgtcttcaacctccggccggccaagccgagaccgagccgccaccgttccctaccaaatccgccgcctccggccatctccgagtccgattggttgaggggtttttttgtccctttgttgtcctctatcttttccccccaagaatcggagctaattgctttcttttttatccgaatcaaattcgttttcgagtttatctctccaaactaaccctcagattttccggctcaaatcctctcgtttggagtccgatctctctaatccaagcctatataaagcatcccctagtcgtcctcttccatttgcctcaagttttagccgcagccgtcgcccgtagcaccgccgccgccgacgccgtttcagccgcgcctcgccgctgctgtggccgtcgccgccgccttccgtcgctgccatcgggttcacacggtggaggagcaccccgtccgccccttcgcagccgccgaagaccgccgccgtcggacctcgtcgccggccgtcgttcgtcgtcgtccgtcattgtgctttgtaccggtgagttcgcgtcgtcgtcctcttcgcagaggtgtcctcggatagcccggccaagcactctatcgccggtggttgcgtggagccgagctatggccggcgatgatgccatcgatgatgtcataactcttcttattattttttctttagtagattaaaatcgattaaacttagaaaattcataactaaatcatcataactcggattcaagtggttcaagttgctaaattcataaaaaatcgagatctacatgttaaaaatatccacatgtactgtttatgcttgtttttgtactgttttgttgattttgttcatttgctagtttccgacgttctggaggagagcgtttacgttgaggaaggttcagaagcatttgaggaagctcaatgcaagtcacatagatcccaaacaaccctttgagcatgttgaaccagtttaaagctaatgttttatttcaacttatgcattattttcgaatgtcatcaggtggtgagcctttcccaattaattatggccgaagatgactttattttcctatgggttataatttgattagctagaaccttatatattggtttggttcagctaaatgctatatatataattgcttagtcatgcttagaaacattagctcattaatgggatgaatcatactacattattaattatggttatatttaatggtaactcacgatggttaatcgtgttatgataattaattaataattaaaacctgattaaaggtgggttgtgagcacatggttttgatggtcgcgctcatgacaattaaggaccggttcacgagctactgttgtgaaacatttaccgtgccaaccacaagccagcgtgggcaacggctttaccttttgtatagcatggttcattatggggtgccagactgagaagcagcgagaagtccgtgggggtcgctggggagtccatgcctctggttgtagagggattgattatgatcgaggtgtggtgcactgtggtgagttgtgttgtgcgaggggtattgtcacagttcctttccgaggtatcgtggtggtattgaggcgcatggtaacatgttgtggagctatgtcttgtgggtacagtggtacatctctggccagagtaaaactattcgaatagccgtgcccgcggttatgggcgggtctaacaatgtttttcgtgattagtctcaccctactcattactggtgataacttgtgataattaaattgactcctggtttggaatggtatattcctggtatggaggtttgatttgtacaactggggttggctgttcagatgaggttgggcctatgcaacataggtgtgttgtatagtgtttatttaatattgcttaattacttaactgttttactattctctcaaatgtttattaattgctgtttatgcaaataagctttattatgccatcctttgttatcctgtgcacttgcatatctgctgtgtggcatgttgagtatgtcatatgctcattcttgcaatattcattcatcagaggaggagtacttcagtgaaggtgatggtccggaggattaggctttgttcgggtcaagttgcttgtggagtggagtcgccattgtggagtggagtcgccatagctgttcagtcttttgtttttatttccgctgcgtagaattctattcttttgagaggaactatccaccactgtaaaaatttattattttgcgaatattaattaactgtttgatagtactctattatcaatttgttattgtgtgcctcggctgattcctggaggtggatttaacacgcatgtaagcgtttggaattttggatagaaattctgggcgtgacataggattcatagctgacgccggtgctcgctgaattgctccaaatttctgacaatcttgacatcctttgtaatatctaaaacaatcctccagcattgtcggccaaaaatatcttgcacgctgaagtaaccacttcatcttatgagccgattgatgagtaccacaaattccttcatgaacttcaccgattgcaactttagcctgatcggcactcaaacacttaagcaacaccccatcaattgtccgataataaagctcatcatccaataaagtgtacttcaatgccttatatcttaatttcctagaagccgattgagatggattcagtaaatattgatgcacatcatacctccaatcatcagctgttattgctgcgacttcgaccttaacatctttgatcatcggcttataccccgacgccccttgcgccaaatcattagcttcaatattctgttctcgggacacatgctttaaagtaaccagcctaaattctttcatcaattcttggcacttctcattacaaaccattaatgtatcatttttgcattcatattctcttgccaattgaatgattactagcaaagaatcccccattatttcaatagcatcggcttcaacttccttgagtaattgcaaccctttgagcactgcctcatactcagcttgattattagttgcataaggtttgatagtataagcaaactcgaaacatgtcctcctaggggaaattataactaatccgataccacaaccatgagtacacactgatccatcaaagaataaagtccatggcacaatttcaactgagccgattgaatcatcacgatgttccacaataaaatcggctatagcttgccctttaattgccttcggcgactcatatcgaagatcaaactcagttaaggaaaatatccactttccaacccttcctttcaaaatcggagccaataacatatacttgacaacatcggccttacatatgacagtgcactcattggatagcagataatgcctcaaccttgtacatgaaaaatataagcacaagcataacttctccacaggggaatatctaatttctgcatccaa

SEQ ID NO: 14603 - DNA, 1712 bp, Oryza sativa
aaaatataagcacaagcataacttctccacaggggaatatctaatttctgcatccaagagccgacgactgatatagaatataactctttcttttgcttcaagctcctgaatcaaaactaagccgattgacttctcaccggccgatagatataatctaaaaggtattcccttctgtggaggaattaaaacaagaggagagttaagatattccttaatattatccaaagccttttgttgctctgccccccaagtaaactgctgattggctttcaatctcaacaatggtgtaataggctctaaccttccagacaaattagaaataaaccttctaacaaaatttatcttgccgatcatctcttgtagttctgtcttgttctctggaggctgaatcttcttgatcgcattaacactcctctgagtcacctcgatccccctctcatgaacaagaaatctcaaaaactggccagccgatacaccaaaagcacattttgtcgggttcatcttcaggccatattttctggttctctcaaagactttccttaaatcagctatatggtcttctatttccttagatttaacaaccacatcatcaatgtggacctcaaccaaccagccgattagatcatggtatatataattcatggctcgttgatatgtagctcctgcactcttcaagccgaaagtcatcacaacccattcaaataagccgattgcaccaggacatctaaaagctgtcttatgaatgtcttcttcggccataaaaatctgattatatcctgcgtttccatccataaaactcaaaatcttgtgccctgacacagcatcaaccagctgatcggctactggcattggttattcatccttcggggtagctttattcaagtttcggaaatcaatgcacaccctgaccttaccgtttttcttatatgaggaactatactagaaacccactcagcatatcggcaaggacgaataaaaccagcatcatataattgtttaatctcagccttgacaggttcaagcatatcagctttgcatctcctcggaggttgttggtgtggcctaacccctggtttgataggtagccgatgttcaacaatcgatcggctgagtccaggcatttcataatactcccaagcgaagcaatctatgaattctctcaacagctctatcaacttggttctaaattctgcagataaattcttactaataaatgtcggcctaggtcgatcacctggacctatatcaatttcttcccaatcatcggccgacataaaaccctgtccttgtttgtcatcgagatcatctactgtgtccttgttgtagacatctgaaccctccacaatgccctcaaaataatagcttgggttctccatcttcaattggctatatatcagaatcagacacttttaaaaaatctccatcccaaacttttccagataaacaatcaagaccatccatctcccaaagagctaaatcggcactggcaacattgactgacctgtcggctagcacaatttcaatcttgtcaccttgccactgaatcaagccttgatgcatggttgaatgaatgcaacaattagcatgaatccaatcccttccaagcaacaagctataagaacccttcccatcgatgacaaagaacattgtagggatggttttgttgccgactgtcagctccacattcaaaactcccttggtttctgatggat

SEQ ID NO: 14604 - DNA, 1148 bp, Oryza sativa
gtgtccttgttgtagacatctaaaccctccacaatgccctcaaaataatagcttgggttctccatcttcaatggcctatatatcagaatcagacacttttaaaaaatctccatcccaaacttttccagataaacaatcaagaccatccatctcccaaagagctaaatcggcactggcaacattgactgacctgtcggctagcacaatttcaatcttgtcaccttgccactgaatcaagccttgatgcatggttgaatgaatgcaacaattagcatgaatccaatcccttccaagcaacaagctataagaacccttcccatcgatgacaaagaacattgtagggatggttttgttgccgactgtcagctccacattcaaaactcccttggtttctgatggattgccgccaaagtctttgagcaccatgtttgtcttgatgagatcttcagcatttctgcccaacttcctaaacgtagtgtaaggcatcaaatttactgcagccccaccatcgaccatcaccttggacatcggcttcccattgacataaccatttatatacaatggcttaagatgccgattctccgtcccctctggcttctcgaaaactgcctgctctggtgaaaaaatcaacttagccgattcttcttcaacttcgtcaatatcttcttgcttaatcccagattcggcaggcaatgtgaaaaccatgatgaccgaagcagctacaacactttttcctttggccaacctttttgcttcatcggctgtggcttcctcagctacaggaacttgattcttaacacgccactcctgcttcggctttgtcttcttcaaccgatggttgatttcctgctcgacttcctgaaagtgctccctgctcctcaatctttgaacccttctcttttgattctccgtaaagataccggaaggacaccattgagttttcctattttcatcgtcctcctagccatgatcttggttcactagacccaacctttgatgaacaggaagtcttgtctgctttagccgattgcccctactatatgatcggcttgagctcttcgcaacataactgcacccaggacagtcctcaatagacggcagcctcatacgttcattccagcaaaatctaaagaactccaaccccaatg

SEQ ID NO: 14605 - DNA, 1464 bp, Oryza sativa
  unsure (1)..(1464): unsure at all n locations
cnnnnnnnnnnnnnnnnnnnnnnnnnnnnnnnnnnnnnnnnnnnnnnnnnnnnnnncttagccgaatttacctgaaaacctcttgcacgacccctatcggttgttcggccagctgtatgcaccatattaacaggaaaggattgccatcaaccttcatcggcctcttagagtcatcaaatttgattttgcccccttcaatagccgcttggatctgctgcctgaagaccttgcaatcattagtcgtatgagacccagaattatgccacttgcaatatcttttcttgcccaattcctcagccgatggaattgtgtgaccagtaggaagttgaatctgcttcttccggagtaacaagtcaaaaatcttgtcagccttagtgatatcaaagtcatacctctcctcttttctagagttctttacccattggcatggtataatctttttgctccttacccattcggctgcagctatctcagaatcatcatcctcatcgtccgacccatacatgtaaggacatacatgattaaccttcctagaattcttcctagcctctgcaaatctttgttcatgcaaggttaccttctgtgtgagatgggacaagctttcaaaatcctcagatgagaatttctccctaattggagcaatcataccctgaaaagctaaatcggctaactgggcatcagtcaaacttaagctgtagcacttattcctcatctccctgaatctctgaatatactcatgcacaggctcatcatgtctctacttgatcgatgtcagatcggacaatttcatctcgtgaaccccactataaaaatagttgtgaaactatttttctagatcggcccaactgttaattgatccatatggtaaagaagaaaaccaaataaaggccgatccagacaaagataaccggaacaacctaaccctcagggcatccacagccgatgcttcaccacactgggctaaaaatcggctaatgtgctcgtaagtcgatgtactatcttgtcctgaaaattttgaaaattctggtgccttaaaccgattgggtagtggaaccctctcaaaccattcaggatagggttgtcgatacaaatttccagcatctttcggcctaagcccaaactgctccttcatgacatctgcaatcaaatctgcccatggtcgttgttgaggtgttccttgaggttgctgtggcatagcctcccatacatgtcattcacactctcatgaggcaacatggagaatgtctcatattggatcttgaggaaatgaagcttggcatccttgtactcgcttctggcctcatggatctccgccaacttgttccaaatctcatatgcgatctcaaggttgctcactctatcgaactacttttggctcaaagagttgaacaaagcattcatggcttgggcattgagttggaggttccggtgatcaatcaacgtcaagggcgtgtcggtgatagc

SEQ ID NO: 14606 - DNA, 3118 bp, Oryza sativa
agggggggtatttatactcccaccaaccaaaactagccgttgggggcgaaatcccccaactctgtgctctgccggtctgaccggaggtatgtggtcggtcagaccgtgctactctacaatggctagttttctagccgttgtagggatgtcattgggccccacagccgtagccggtcagaccgacatggggtggccggtcaaaccggcctcggctcggtcagaccgccatcagctcggtctgaccgaatacggctccggcggctcgggatcggcacaccgggatggcaccatcctggccatatggccggccggttagaccggcattgaggcggcgatcagaccggcctagaccctgcggtcagactagtgcccttgccggtcaaaccggcacttgggccgtggtcagaccggccctggtcaggccgaaaacagtgagataaatgattgtgtgtgtgatgaaatgagaggacaagtctaaatgcataatgacctaatgtggcaattaaaatcatctctttgctaggtcattacccctcttaatagtacggcaaagctataaataaactagcacaattttgatcgcccaacgcctcgagcaatttaaaatgaaaacacttgtttaccgtcttctcttccttttgctttgcgccatcaattttaatccatcaatgatcatccatgtgcacacaaataactgaacctaactcaaacaaatagctcaaacacaacggttagtccacaattagtgcttgtcattaattaccaaaattaacaccggggcctagatgcttcaatctcctcctttttggtaaatgatgacaaacaccacaaatatatataatcaaacatagagcacatggacatatattgtaatgacaagcaaaagctccccctaaacatatgcataacaacaatagcaaatatggagccaatttcaatttcacatttcaacatatcacaaagacaagagcaatatctcaatgtgaacttcaagaaatattcatccatgagcataagatggtcacatatatatcaatatcacatacaccatccatcatcgcacaagttcacatcacttaaccattcaactcacataagtcacacatcatcctaaaagggctcacaaataaacataggctattacaagaccatgaagggtccaaatgacatagagtttaacaaaacgataaagaacacacaatatagagtaatagcccatacccatacaaaatatagcccaacacaccttaacctattagatatgaggtgactaacctcactaccactagtcctaacccacaagacataaagcacacctaaggacatttttctcccccttttggcatcaagtaccaaaaatgtcttcattcttgaggaggagaaggaggatgcaccgaagaggaaggatgaggagcatcacggtggcagtgatatacaaaagcatgggtgctctccaacatttggactcgagaatgcaatgcacccaccctagtttgcaaccttcccactgaagtattcaagttgccaacatcggtacgcaagccacgaacatcctcatgaaaagcttcatgcccggtagacaagcgttggatgctttcacttagggtattaatagccttaagtaccggattgaagtattcattgggttgcgttccaaagtaggcatattgtggatgaaagaaagcacatggatcatacccatgaggaggaaggggggttgcacttgaacaccaaatccgaatcaaacccgggttgaaagagaaatcgagaaagtaatggctcaaatgactagagagaggagcaagccaagggcacacatgtttgcaatgagagcagcagccctcacaagtgaggggagtgggctatttatacccacagctccaaatctgcccattggagcgcaataattctgattatcgaaactttcaaaaaattccagatctgaaaaattcgaagtcaacgcacttttcggaacttctgaaaatacatccgaaagtacatctgaaaatttctagaagcatatttggttcgcagacattttcggaacttatgaaagaacttccgaaaatttccagaagcttaaaatcggttatgtgtatttttggaacttccaaaaatacttccgaaataacttccaaaaatttccagaagcttaaaatcggttctgtgtattttcggaacttctgaaagaacttctgaaaatttccagaagcttaaaattagttctgtgtattttcggaaattccaaaaatagctttcggaacttccaaaaatttccaaaacccaagagagaaatgcttcgaagaaaaatagattttgagcacatgcatcaccccttatatgtctatgcatcatcccccttaatagtacggctttcctatgactcaatgcaaggtaaaagatacaatatatcatttgatcattgctgtattgcatcgtggcatcgcattcaatggggtatacatcacattacaagacgtcgaggacataacgaccttcacatttgcttgaataaaaaagttagacctctctaatcgcattgtaatcaatcatcaaaatcattaggggcctagatgcactttcaattttgttgggctcaacaactatcaagtgcatctctgatacttaacgatatactaacaaatagtcaccgattactgcaaataagctttaaagaacagcaaactatcatcagcaaacaacaagtgtgacactcccagcgcacgacgacagactttcaactcatttagttgtccctcctctaccacctgacataaaatacgagaagggccatccgccacaaataagaacagataagggaacaagggatccccttaccttagtacctgtgaaggagagagaatccagtaaggaaccattaaaacaaacctagtatttcaccgttgttacacattccataatccaattcacccgctgctcgcaaaaaccaagtttcatcagggcgtagcttcagaaagtcccaatcaactatgtcatatgcttttgctagatccagtttataggcacaaaactgactaccattccctgaagctctttgcatagagtgaatacactcaaaagcaattagtgcattatctgtaatcatacgtctcgaatg

SEQ ID NO: 14607 - DNA, 10910 bp, Oryza sativa
attgaccagacacttagataccactttataaatgacactacataaactgattggactgaaatttttcaactcaaccggctgatttatctttggaatcagaacaatgtatgtattattcacccctccaggcagaagtccatatgagaaaaacgtcctaacaccagcagcaatctcctccttcagcacaccccaagttcgctgaaaaaaccgggccaggaacccatctggtccaggtgccttcaacggtccaatctgaaaaagcacatctgaaatttcgtcatctgaaaactctttgcagaggacctcattcatggcgtcatctactgctggatttatgagatcaattagttcatccgataccactgaatcatctttggtatgtaacttttggcaaaaagaggtagccatcttttccatttcccccttattctccacatatctatcatcccaatcttttaatttcttgatcttgttcttcctcggacgccaagctgcttgccggtggaaatatttggtattgcgatccccatcctttaaccaggaaactcgtgatcgctgcaaccacatcatttcctccatgtacagtagttcatccatatgtctgaatagaccattgatttcctctgcattgcccaatggatcaccgactgaaagtccttccactttcttcctaattccatccagttccttagtggcagagccaaacgatttgcggctccattctctaagtgttccaaaactgagttaagcttttttgcaacctctcccagatcatgcgctttgattctctgctcccatgcaagttgtatcacctcaggcagagtttcctccctttcccacatgatctcgtacctcaaacaacgattgcttgaaggagtttgctctttctctaccctaaggaggatcgggcaatgatttgatcttggggagaacaaatgtgtcaattttgcatccgagaaatggttcatccaactgagcgacgctactgcacgatctagccgtactcatacattttgatcacctttttgcttgttattataagtccatggtgtgccggaaaaaccaacatcatgcaagtcacaatgagctagcacttcccaaaaatttgccatcatcttttccgaccttcttcttaaagaaaaatgttcaaaagactacattatctcattgaaatcacccatcatcaaccatggtgcattcgaggatggttggatttgcagaatcagttcccacattaaatgtcggtcttgtgcttttggttcaccatagatgaaggttcccctccactgaactgcatctcctgattccttgattaagacatcaacatgtgcgtggctcatggacaggagatctaccagcaagccttcttcccagagaagagcaataccacctcctgacccatcactcatcatagccaaacagttccttaaacctagtctccacctcaacttactaatccttggttcatcttgtctagtttcagataagaacacaagcttaggcctatacttctgcataaggcagataagttcgtgaactgtttgaggctgcccaagtccccggcaattccaagccaaagcattcattgctcctggtggggctcgccatgagctcccaccagatcttccttcgccttgcaagaattctctaccttatcacggcaactagcctcatagtaggaggtgttcaaacttgggtgttcctgttgatgattaaaatccacaacggtagacttgagcgctatcatggctcttggtgaaagtttgatggagcccttctttgatttcccaatatcacgcccccaattggccacctttggccttgatatcttccctccttctttaatggctaatcctttcttcttcttctgaagccaatctggagactttttgctggctacattgagattagtctcagcagtactgatcttgattgagttttcttcactaagctcataattagagcttaaagacacatattctctactacaaggtcctctggcctacaagttcagattagaaggcaccccgtctacctgcatatgctgcgcccctttttcaagggccaaagaaaccattggtgcaagagtttcctgggccatcttctcttcatttgcatgcccaactttagtaacttctgggtctaaagattgtcgtcttgggcttgcaaggttagaggcgctcccagccgataaaaccttgtctttctgagcaccacagaagtttaaaactctagcaaccttttggggagctgcaggaattgaaagcagtcgaagcgcagaccatttagttggtgaagctctgagttctttcccaaaacgcaccctattcaggttggattaatcctccaggcattctctctccacatgtccaaaacggccacaagaaaagcagaaaaacggaacattctcatactttaaagggaatatcattaatcctcttcccttcccacgtgctttgagctaaactttgagagcctcagctaatggatagtccactcttacccgtaggtaatctctcacagcaccacccacctccaaaactttacctagcttttcacccagatggtgagcaaaacccgttatcatcattgcctctagaagatcataaattcggacctaaatcgctaaagattcaatgacaacttcagaagggcgacataggccatcataagagacaataatgagagcatcacccttgtgtttccaggggcctccattcatgacacgataaaaatcaacctcatgatcaaaatcaattaggaatctattttcacctagatcccttgcagttctaaggttttgcaaaccccaagctgtgctcatctcatcaaacagacccttgacattataacgctgcgctgaataaaatcttgcaagagccaggaatttacatttcatctcctcctcaactttgccagatccacataaaaaacattatcttcttcctcaacgatatcctcatcatggttctcctcgaacaaaatgtcacgcccggaaattcactagtaatttccgaactaatttgtgcattaaatcctcgtccaggaatcagccgaggtacacaaactgacaatttaatatacaaattcatcaatataataacgttacatacttacaaaagaaaagaaaactgcagcggaattacggtctagcgaagctccggctccactcccataggcagctcaactggggtataagccaaacgtcttctccttcgcaacttgtcttcaactgaggtttgattgattattgcaaggtgagcatatgacatactcagcaagccacacagcaaatatacaagtgcacaaggataccaaagaatggcataatatagggctcatttgcaaaagaagcatttagcaaacagtaagaattgtaaaacagtagagtaattaatcatcaatattaatcaacactgaacagcacacccatgctacacaggcccaaccatcctgaacaaccatacccggctgcacagatctatctccaaaccaggaatataccattccaaaccaggagctaaattaattagcatcaattaccacattattattaatgaatagtgtgggactaatcacgaaagacattgttcgacctgcccataaccgcgggcatggctattcgaatagttttactctggccagaggtgtaccactgtacccacaagacacaacccaccgtcatggcaccgtgtccgcgcagacacgtcaccatgatgagtgattgtgacaagacccctcgcataactcaacctaaagcagtgcaccgttcctggatcataatcacccccttataaacaaggcatggactccccagcgacccccgtgggcttatctccaccacttctcagtctggtgttccgcaatgagccttcttatacaaaaggtaaagtcgttgcccatgctggcttgtggttggcacggttaatgtttcacaaccgaaactcgtgaaccggtccttaattgtcatgagcacgaccatcaaaaccatgtgctcacaacccaccattatcaagttttagtaagcacattaattaattaaccaatcacgattgaccatcgtgagctatcattaaatatccatcattaagtaatagtgaaacattagttatcccaattatgtgctaatgtttctaagcatggctaagcaatgatgtctaacatctagctgaaccaatatataaagctcaactaatcaaattataataacccaaggtatcaaggaatatagagtaatcaatgcaaacaggccataacaaaggaataagttcacaccacccggtgacattcgaaaataaatacacagttgaaataaatagagaatttaaatataggatcaacatgctcaaaggaactgtgtttgggatctgtgtgacttgccttgcaataaagggtcttcaattaatcttcttgaatacttccaacgcactcacgaaccttcgaaacgacggaaacgacaagctaacacgcaaaacgagaaaaaagactaagaaactccaaataaatagtacatataaagtaaacaaacatgtagatcatgattttagatgaatttagagacttgaacgacctcattccgatttcatatgaattaattacaaattttacaagattaaattccaattaaatctattaaagaaaagactattccaaattaattaaataatttacaaatgatttataactgagataaaagattaaaacaacctccggaaaagattagattatatttggtagatgacatatattaaaaagaaataatatgccactgaaaagagaggaaatgatttatattgattttggatggctaagattaatcttgacatagagttgaccaagattggatggcttggattgatctggcaagcgggcctcacgagataccaactcaacgagtcaattctacgtgacacgggatcactctaatgatcaaccgaaaccggcgaacggaatcggcggctctgaacggctctaaattaaaggacgactcaacacggacaaacgaacgaagcacggggaacacctcgttcgaacgaacgagcgaacgactcaacaacggctgtggctaaactggtggggtaaacacgattcacggtaaagcccaggtacggcaaacgataggctggtaggaacctagggttgcacctacggctagacaactcgactactgagcaacgagctaaagcggtggctaggtttaagtgacacacagctgcgacatagcggcactaaggtgacttggctcggctaggcggcggctcggcggaaacgcaaagctagggttagggtgacggcacagccgatagcgatgcacgacagcggcgcggcgactgcagtacgtgcactagggcagtggctacgcggtggctagcagcggacaacagcgggtgcggtgcacggcaatgaccggctcgacgctagggcggcgacgcggtggtagcaagcggatgcggcaaagcggcggcaacgctgcacggcgtgcaggcgcaacacgggtgacgcagcaaaggcgacgcaacagcagcggaacaacaagcgacacggccgacgtgggagcatgcaacagcgacacggcacgcggtatagcagcagcttggcagagccagcgcagcaagcagcggcacgatggcagcaagcggcggcgcaaggcggcggcttggacagcagcggcgatgcaactagggcagcgacggcgcatgggtcggctgcggtggctaggcacacacggctacgcacgggctaaggctgcacaacagcgactacacgaagacacgattgcagctacacaaagattaaacctagggaacagaaaagaggcctcaccggggaagaccgaagaggaagaggcaacggcgacgccagcgacaacacacggagacgacgacgacgctagggccaaacaagattagattaaattaaggccctagggaaaaacctacaccggtgaacggtatgggagcggcggttgccggtgaaccacggcacaaatatgcaaacggagggcaccaggagaaagagcgcgaggcgacggtccttaccaacacttacgcgacgacggacggcgacagaagatagccggtgaccagcttggaagggcggcgaggtactgtacacggcggtgacgactttccggcgatgagagacgacaaccgaggggtggacaggcttcacttcgcagctgcgaatccaatggaggcgacggcgaagcttggcgatgacgggaggagcagcagggcttcgccggagatcaaaacgcgacggcgaacttcgggttgacggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagagctcgacgttgcggagccgatggaggtggcggcgctgatcggcgacggccggggcgatggcgagatgcggctggagcggcgccggcgcttggagagagaaggagagcgcggggagaaggtttcggcggcggcagaagaaggaggaggtggcggccgaaagagaagagggagggggctctatatatagccatgggaggccgggatcgagcccacaacgacgggaaaaactcgggaaagtctagggttctcgccggaaaaaggaaagattgaaccgcgaaattggaaaggatctccatagaaacttttggggattttttggggaaaagaaagaggagattgagaggattccattcccgcaactaatttggaaaaaggagcaacgaggtggccggattttggaaggggatcggcgacactgtgcacggcacgggagacagtcggctggaggaggaagatggagtactgtagcgaggggggggggcaaaacaaactttcggccgggctgagaggaagggagggaatgggctgaattcggcccaagactaggaaggatgattttattgcttttccaaataaattaaccaatgaaatgatctttcaattgttaaaaatacttccaatgctcaaataattccaagaaaactcttgaacatacttggacactcaaagtatttaatataataatatccagataatttaatgattaatttattatttaaataattactgaaatgttctttgtataattaaaattaggaattgagctccgaaaaatatgagaaaatttcagagaatataattattcatggagaatttaataaaaattaaatccagccatgctttatatttaggaaattttatttcccacatttaacttcacttgtaaattaataaacatttaatataaattctattaataatttattaaataatttataaattctgaaatggaaaattaggctgtgacacaaaactatcgcaccgttatgattatcttccggtttagatgcatgaccgaaagaaacaagtcaagcatcctccttctccacttgatccttgtccaccatatgcacttcgcccttgccggcgtcttcatggtttgacatggaagcccacgtcctgcctgtcgacgatgatcaagaaacacagatgttcctgagtaaacatcgtcctaccctagacgtcccactaacaaacggcttcgggcgggtagaatcctcaccggaatccccttgatcgcccacaccgatgttagacggcgacaccaacgcagaacaggttacaagaaacaaagaagcaacaatacgtagagttagggttaccacgtcacttgcacagaaatttgtcgtcaaccagaatcttccaagaatcaatcttggcagtagcagattaaaacaacccgagtcgctcccgtcaagatacgtagcagtagttgcaatccaaaacagattaagagaacttaacacctacgaatcacaaccaaagatcaaacgagaaaccacgttgatcttggctaggacttgtcagcgcttcagattagagatgagcttccaagatcgcctcctagtcaccttccgtagattgcggacacgttgttagctgatgttgtcgttctattagtttttctcgggaaatttaactatttaccactcttgtgacatggcaattaacgatttgccacatcctgtcaatgacatgtgggcccttatgtgtctatgacatgtgggtctagtggcaaatcgttaagcaacatccgtaagagtggcaaatagttaaaagccccgtttttctcctgctctattcaattaaattggcactgtcttgtgctggttcattaaaaaaaagggaacaattgagagcgccttgtggcctgatggaggcggagtgcgagcaccgggagtcgcgcaaggagcgagggactggcgagtaggggtcacagtgcgatggtgatgctacttgctgtcacgcccagaaattcacgaaccagaatttctaagctgaatgtgcattaaacctctatccaggaccagccagggtacacaaacgataattgttgacatatatatccacgacttacaaaaaaaatataaaagattacaaatgcagcggaaaagataaaagcgagctaagcctgacgacttgactcctgcagcgggcgactccattccacaggcacccttgatggcagcgacgaaaccaacttcctcgaaacagctccaactgagaagaacttcaactctgatgtggggaacagagagcaagactgagtactacccactgcaattagcaagtcataccagaaggggaggtatgatgcaagatatatccaaaggaggctaaaggttcttttgcataaaacatgcatttaaaagcagtagttgaaagcagtaaaacagttgtagtaattaattaatattaaccaatcactgctcaacgctacaccacgttgagacaggcccaaaccaccacctaaactaaccagttccattagctaactaggggtgagactaatcacggtgaatctgattgaccgcccataaccgcgggcacggctattcgaatagttttactctgatcagagatgtacaactgtacccacaagacacagccccacaacacgtttctgtgcgccggcatgccaccacgacataccagaaagagaccgtgacaggacccttcgcattaccccctctaaccaaacacaccacacctcaggtttcacccccactcctcgcaagacagcgggcagtcccctctcatgcctaggtgaatccgaaagccacataggccatcgcagggcccatccgaactccatcacgctcacccttgcctggatgcgtcagctagaggaaagccatactacatgcccagccgttgcccacgctagcttgtggtaagtacagtaagttcttcaaggacatcccgcgaactggtccttaattgccatgggtgcgactcaaaaccatgcacccacagcccaccatttagtatattttagttaaccaacactagagcggtggctctagtccaacaccaatattagaatttgaaatctatgcattaatgtagttctcccattgtgtgctagttgagctaagcattgctaagcaatccctaaccgaacatctaatcttgttatatccccaagctaacaaaggaacaagataaccaatagtatggctgagacaataggtaattatcccatagtaacattataaaacaatgcagtatttaaggaaaataatagagcatttgcaatatgggaccaatatgtttaagtgacaagcatgacttgccttgctctgcggctggagggacctcggcgactatctcgaagtacaccggagcgtcgggagagcaggaatctatgcgacatacaaagcaaacatgtcacgccctgaagctttcccccctttttcttgctttaaaaattggttaaataaattgcccgaagaaattatcttaattaacctagagctgatttcctatctaatgaatgcaattaataattggaaatggcattgtggaatttttcttgggttccccatgctccaatacattaacaggatttttagtggaattttcagagccttggaaataattttaaccaattaaaaatgagcaagggcaattttaaatcccaggaaaaatcctttcttctttttctttttctttttcctcctttttcctcttcttgggccgtcgacccacctttctcctcccgcgtgccccttgctgggccggcccgctcctcccttcccctccccgaagtcctccctcacgccctctttctccgggacgccgacaggtgggccccacctgtcggggtcgtccccttcctccagccgtcgaaaccaccgcgcccacctcctccgctcctcccgcgcccacaccgcgccgctcccgcgtcctccccacatcgccgccctctctcccgcgtctcccggcccgcacgcgcgctcgcaaggggcgggattcgaatttgaatccccccattctctctctccaccccacgtcgccggcgaaatcggaggctttcccggccacgacggcttccccctccacctataaattgctcccccgagcctcctcttccccttcccgctctcgccgccccctcccgtgcctcctaccgagcccgcgccgctcgccgctagcgccgccgcttgccgccgcctccggccgcacgccgccgtcgcaagagccgtcgcctcgccgcgcaatcactgccgctagcttcgccgccgtgagagctacctcggccgccgctcgctttccgttcgccaccgccgtaccgctctccctacacgccgctgcctactaccgcctccggccgcgcgccaccaccgataaagccgccgccgcgccgtgaaaccgttgccgtcgcgctcgccagtgtcgcccgcacctcggtc

SEQ ID NO: 14608 - DNA, 8718 bp, Oryza sativa
gcgcaataaatttaattaagaattttttcttttgttagtaaaacatagtttaccctctaaatttcataagtaattcatccgagctccgtttaagtccatcaagtctcagtaaattcataaaaatgcaaagaatccattaaaaatggttttgttccctgttccagtagtcttatagtatgttttgcttgtgtgctttgtttgtcgtgtagatttcggccgtttcgtcgatccgcagtttctcgaagacgttgctgaggtctcattagtgcgagagcaaggcatgtcatgcattatatttgatcatattgtaccctatttacaaatatcccgcatttctattaaatgttgcattctttttcaatgttatgtgggatgggtcctattactcagccatatattgtttaccatatgccattgataactggggtatcaaaatgattagatgttggtttaggaaatgcttagccatgcttagttcaactagtacacaaaaggggatcacattattacatagactctgactatgagcatagttttggtttggtgccaccgcaatggtgttagttaattaaaatacaccgaatggtgggttgtgggtgcatggttttgctggtcgcacccatggcaattaaggaccggttcacgggaaaccctgggagacttaccgtgcttaccacaagcaggagtgggtaactgcttgatctgaagtatagctcgaccctttcctaggcaccagtggcgagggtgggcgtgatggagttgggtcggccggggtgtccggttgtccaactgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttctgggtacagttgtacacctctggccagagtaaaactattcgaatagccgtgcccacagttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactgcttttaaatgctagctttatgcaaaagaacccctagcctgctttggttatatcctgcatcataccacctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcaccccgctactgaagtcaagcttctcggtttagctcgcttttatcttttccgctgcatttgtaatcttttctatttttgtaagacgtggatttgtatgtcaacagttgtcgtttgtgtaccctggctggtcctggacagggatttaatgcacattcagcttagaaattctggttcgtgaatttctgggcgtgataaaataatacaaacaggctataagactactgaaacagagaacaaaaccatttttaatggattctttgcatttttcttgatttactgagacttgaatgggcttaaacggagctcggatgaattttctatgaattttagaagattcactgcgtttttactataaacaaaaaaaatccttaattgatttattgcgcaataattaaaccctggagagagagagggtggcacgggcccggctcaagccggctcggcggccatggcgcgcggcggcgcggtttgacgcagcggcggcacaaggcggcgaccggcggcggagagcggcggcgacacggcagtgcgggcaacgctagcggcggaaaatgagcggctaggcagcggcgcggcggctaagtggcgcgggagagagagagagaggaaggtgaggagttcctcaccggtgacgatcaatgatggtgagcggcgggatgatgatggcgatgagtggccgagcttcgggatcacctaaggaacacaatgggaaagattagagagggagagagagatcatagaggacggggacgccggccgaaggcggcggccatggcgaaactcaccggcgtgcggtgcgaacggggctccagcggtggaggggctgacggcgtggccctcgggctcgcgaatccgatggcggcgatggcgcggctcagcgcagcggctagtggcgaccgaagctacggcggcggcggcggagaggagggcgactgtgctagggcgaaggagggcacgggggagctcggcgaaatggggaaaaagagagagggaggggcggtggtgcttaaataggggaagagggggctcggggaggctgggagtgggctgatttcaccggagtagtggggaggtggagagagggagcggggcgcggggaaggcggcgacgccggcggcgtggcccgggaggtgcgggagaggcaggagcagcgatttcgggcacgggcggcgccagccagaggttggggacgggcccacctgtcggtgacccgaggggaggaggggctcgggcggccggctgatgggccttggacttcggccggcccaactggtagggggagggggaaagagaatgggccagcggcccattaggaaaaaggaggggaaaaagaaaaagaaaaagaaaaaggagaaatgaattttcagggattaaataattgctcgtgctcatttttatttggttaaaattatttctaaagctctgaaaattccactaaaaatcctgttagcgtattttgacacgtagaactcaagaaaaatttcacatgtcatttccgattattatttgcatttattaaattaaggtttctctcttgccacttcacaaataatttctcgagactatttattaattaatttagacttgggagaagaacttcggggtgtgacacttgctccctccatcccacgccatggcttcgttgccggcgagcagccggaagggaagaagaaccaagggtatttttgtgtgagatgtcattgttttcttttttgacgtaaacatagtggcattgtggcgatggcaatggcaaaatctcggatttctcgccgtatggtatggtacggcagacagagtacatgaaaagtggttttgctttgcttggtcgtctccaaattgaccatggcaatccaatcctattcttactcgggtcgggggtcagagcgcaccgcatatcgcatcatttttttcgggcaatccaatcgtataggtttccactacatactttcccatttttttcttacactttggttctataaaacgccgcacatgacgtcgaaagtcaccccgctatcgcagcaatccaaaatccccaacccaacccaacccaacccaaccgcactatcacgccactcttcgcccgcccgcccgccgccggaatcgccatcgcccgaccgccgccgcgttcgtgtccccacaggcggcttctctccctgcatcaccatgggttctgacttcaaggcaatccccttgatcggtaagattcagattcagattctggaatcctgcgtgggattcttttttttcttttacctgctttgccaccaccagttgcagttagttcaattaaccacagattacgactgcttgtctgcaaaggatactagatacagcttttgtagaattttgtgtaaagatacttggtgggatgagatgatatatgcttgtactttgaaatctccatttgaagaattcctctatctttgttcatttgtcagacattagtccccttgtcggaaagattgatgatccgagcatggtcaatgacgaggatttgctgcaagttgtgcaaatgttggacgatgcctgcagggaggctggattcttttatgtggtaaaatttacttatttacttactagcctacttcagactttttagcatcagtttactacaatgggtacagcagactagctacacaatatcaatcctaatcaaatggtgtctgtatgttactaacagaaaggccatgggattgctgactcgctaatgaagcaagttagggatgtgacacagaagttctttcagcttccttatgaggaaaaactcaagattaaaatgacacctcagagtggatacaggtgtgatataaaatgacagcttcaacctgtttttaagtttccaacatttttccttgttccacattggatccttctaatcctccttcctgtataacataactttgttgtctttactgtcagagggtaccaaagagttggtgaaaatattaccaagggtaaacctgacatgcatgaagcaattgatgtaagtttaattttctctttattatttttttatcatccattaatttgttcctgagttaatccctggaagaaaaaacatcacagtgctacacgcctattgaacctggtaaatatggagaccttgctaaaccaatggtaggatctaatttgtggtatgtatccaactctccatctctgtttttttcctacagcactgtattatttgacatatgcgagacagatattatgtacttgactttgatataaaacaataccccagttttgatctattgcatattttaataatactcacaatataaataatttagcttatagcacacctctatttggaagaatgtgagggaataaaatttatatttacaatattttatctagtaccaacatgtattatgttacaatatgggtagaattatgaattatagtaaagaaaatagaagttatggctacaattgtacttgcatacttcaatgtatttttgttactagaagcatattaaatagttggtactaggtaccacagaattattgcttgttgaattacttcagctattactgaagaagttctgaactttggtagactgcctttgagtattttaggtcagagatctatcaaaattcaaataaccggttcatttatttttatgcaggcccaaatatccatcaaattttgatgtactgctggaaaactatatcagccttctaagaggttaacttctatacttagtttaaatctttatttgtgcatgtatgctattgatccatttattatttgttacttatgagtgacagcatttgttatgaaaatttacttgtagatctttcaagaaagatcatgcgaggtatagccttggcgttgggtgcgccagttgatgcttttgaaggtacaaccgcaggagatcctttttgggtttgcaggctgatcggttatcctgtatcaactgatattccagaagagcagcgcactgatactgggtggtgagcaaattgtatctacgtttttatttggtaatatatcctgcaaatcgtgtgtattgagtgtagagtcatctgacactgcttttcttttacatggcatccattctacgatcaattcagtggagctcacacagactatggttagtacatatctttcaaaagttctgttggaattgaactcatatgtggaaatacgcatatatgtttctttgattgatgtattgtggaaagtttgttttttctttatttgtgttttaatcctaaaaaatcagtagaggttatatcaaaaccatggggatcatatttatcatttgttaaatttgtaggtcttctgacattggttaatcaggatgatgacatatgcgcccttgaggtacttatttcttcaccatctaatacatatcttataggaataagtcatgtctttgccctcgaactctactcagattccaattttcaatgtggatttaaaaaactggttgtttatcaccagaaatctggacaaatatcattggttaccctattcagagattgttttaattgagatattttatggccacactgtttgtttgcttggtggccttttctccttgcaatttcttatcgccaaagttatttccatgttatctctgtctagtaataaagaagaggggacgtagaatggatagaagataagaacttgatttcagattgttttatttttcattagagtgcagtgcatctgagctgggcatctttgtacagaatttgactcatataacctaacaagagatacttctctacttttctaacattctacgcatcttctaagatgcattagtaattaggagtatgcaattagcatcttacagtttcttcccactgtccatatttagcctgaaacagggtgaagcaaacaattttgatccgtttgtaatatctggtgaatatgtttcaggtcagaaaccaatcaggtgaatggatatatgccaaaccaatcccaggaaccttcgtctgcaacatcggtgacatgctgaaggttcttttcttcctttgcagtttcactgatatctttatggtcatcaaacatgagacgcttatcaattgtcttctttggttaggtttggtcaaacggaatatatcagccaacacttcatcgagttgttaacaactcccctcgctaccgtgtatctgttgcattcttctatgaggtatgtcttgcttaatctctagtctcaatcctacacatagtttatgtgaagttgatttctcatgttctttcttttctttctgaattttgaatgctacagtcaaacttcgatgctgccgtagagcctgttgagttctgccgggagagaacaggtggtgttgccaagtatgaaaaggttgtgtacggagaacacttggttcagaaagtcttgacaaacttcgtcatgtaaaatttgtggaaaagaacatgcattgtactccaatgtctgatcgcaacattcgtcactaaaataaaatcatttgtaaatttgtcatagcacagtagaacagtcatattgaagaatggaatgcatccttaattgaaatcacaagcgatgtgaataatcttttcgtgcatggcatagatgtgtagatcatggaatgattgcagttacttcttgttacatgtcccagcacaggaggaagatgagtagcaaaaactaaatcagaaagaaaaaatctaaaatcaagttttcctaatagacgcacacttatgaaaaaactcacgagcaaactaccgaacacggacgtagcgggcttaaacataagcgtgaccaaggcactaccttttctgtcttatatactccctccgttgagtttcatttaaaaatttaatacaaatatgaaagtatataattactagaaaaatgcccgtgcgttgcaacgggtgaaaataatctatctattaaactataaagatagcttaaaaatgacacgatatttgctttgaccacattgaaattgttacattaattaatagaaaaagataatagttgtatatacattatagaatgattgtatttatagtaaatgtcacaaaactaaaattatttggttaaatccaattatgtttttaaaatatgttactgaaaggaccttgatgtcgcctagaggggggtgaattggcggtttttaaaaatgaatacggaagctaaaacaaaacagggtcggattgtctgatatgatatcaggtcggatagtcctatgtgatcggattgtctgaactgagatcagactatctgacctacacaacaactatacaaacaagagaacaacctaagagttctagattatacacaggcaaagaggtgagctcagccaacaacaatattagcatagcacaaagcaatggaacaagaaggtaaagagagtgaagatatcaccgaggtttacacgccgatgtatttcccggagttcaaatccttgaggggattctagtctccgttgaggggctcgcaaagagccgggcctttttcaaccctatcctcatgaggttgcacaaatgcactcctccttccactaagggtatctctttccttgtggaggcgagatccggccttcataaacttcttttggccaaccacacgtagatcggtggcccaagaataacacctagccgtctaggagtcctcaacctctaagagtaataagcaccacagaactcttggacaaatcctaatgctcaagatcaagagaaacacacactaggctcccaaactccaaatccacacacaaagatccaagtcacaaagaacaaggaggatttgagatagagagggagagagcttaaagatccaaagcacttaacacaaagctcaaatatggggggttttaagaatactctgcaagaggatccaaatatgggtgttggaaagccaagagggaaggcagttaaaaagctgaagcagttggctgaggcaagtggaattgttttcccatctgattctctatcttctactgatttaaatcctgatatatcttgtgaatctgaaagtgatcttacctctgttatacctgctgattgtgatatatctttgcttcaaaagataggatctgagatgtgtgagacttccgggtttcaagcttggtggacttgggagatgttcaggtcatcaagccaaaagctattggaccatccactgatgaagcctagttctgtcaaacttttagggctgctagtggcactctttaggggcatgtgtttatccctatatcagcccttttattttgtgtttaagttatgtaaactctatgctggtactatgcgttggtgtgcttgggatctgcatggattattcctgcttgttatctttctctctttaagactagttatcaaatg

SEQ ID NO: 14609 - DNA, 2766 bp, Oryza sativa
  unsure (1)..(2766): unsure at all n locations
cctttggctcattattggagactttaatttttatagatcggttgcaaatagaaatagaccaggtgcagacatgaatgacattttcctgtttaatgcaatgatcagtgatctgggtctggttgagctgcccctcaagggaagggctttcacttggagtaacatgcagcatagtcatttaatagagcaattggattggttctttacctctactacttagaccttaaccttcccccataccatagtaaaaccacttgctcgttctacttcagatcacataccttgtgttgtgcaaattggaattgacatccctaaagctgacatcttcagatttgaaactttttggatagagcatgatggtttctttgatttagttccatttggcaaaatcatgggtatgaaggtaatgcagccaagaatatttctattaaattgaagacattgagaaagggtttgaagaagtggagtaaatctgtctctaaacttcaattgttgattaaaaattgtaatgctgtcatagcttttttggactccattgaaaatttgagagatctcactttcttgaatggaattttagaattcctatcagaaacaagctgttgttatacctaaagtataaacaaatttattggcaaaagatgtgtaccatcagatgagccaagtttgggggtgagaacacaaaatttttccatgctatggctactgagtcttatagaagaaatgcaataccttctttagtagactcttctagtttagtctgtacaagacatgaggagaaggctcacatagcttggagtactttttcttcaagaatgggttgttcccagtttgagtttatgccttttcagctgcaagattttttccatgcaaatcaatctcttgctagtttggatcagccctttggtatctctaagttggacaaaattataaagaatttgcctatagacagggctcctgggcctgatggatttaatgggatgtttgtgaagaaatgttggccaatcatttgtcaggattactacagacttgcagctaaattctactctagtactctggacctggatcctttaaaccattcttttatcatcttggttccaaagaaatctgtgcccgaaggtataaatgactataggccaatatcactcatgggaatctctcttaagattctaacaaaaatcctggctgatagactgcaaaaggtgatattggagttaatcagtcagaatcaatatggtttcataaaagggagaactatacaagactgtctagcatggaactttgaattccttcattagtgccatcactccagaagggaaatagttcttctaaaattggactttgagaaggcttttgacactattgaacatgaagctattttgctagtaatggaagccatgggttttagtgctacatggcttggatggataaggaagatcttttcttctgcttcttcttcttcagttctgatcaatgaggtacctggaaaaaatttccattgcaagaggggagtaaggcaaggtgatcctctgtcacctttactctttgtattaggagctgaacttctctaggtcattgtcaacagagcttatacaatgggtcttctatcaaagccttttccatcagactttgacccaaatttccctattgtccaatatgctgatgacatcctgctctatttaaaagctagtggtaaagagctctttactctaaaggctttattgcaaaccttctagctgggaactggtctgaaggtaaattttaataaatcttgtctcattccaataaatgttgatgaagggaaagctcaaaacttagctgcagtctttggttgtcaattgggatctttgccatttacatatttgggtttaccccttggtaccactaagccaaaggtaatagattttgcacctttagtggatagaattgaaagaaggcttacatcaaacgattccttcctgtccaatggagatagatttacgctggttaattcagttttctcttcactacctacttattacatgtgtactctaatgttgccaaagacagtgattgatagcattgacagagcaagaagacattgtctttggagaggttctgaggtcaactccaataaaaaatctttggcagcctgggataaggtttgtaagcctaagagaaaaggtggcctgggagtgctaaacctttctatccaaaatcaagctttgctcatcaagtttttggaaaagttttacaataagaaggatttgccctgggtcaatcttgtttggtcctcctgttatggtaactctgtccctcatctgacaaacttgaagggctcattctggtggagagacatttgcaaattaatggatgtctttagaggtattgcaaggtgtcatctgaaaagtggaaatacatgctccttttggtatgatgtatgggctgatcaacctcctctttttcacactatgtcaaagctttgttcttttgctcaaaaccagaatgcatctgtctctgattttccgtccattgaggccgaaggaaattttacactacctttatctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14610 - DNA, 480 bp, Oryza sativa
ggccttggcttagttccatcacctatgtctatttcctccaatggatcggccgatgtaaacccttgaccaaccttttctacttcgtcaaaatcttcaatagtttcaccaatatcgttctttgtagatcgatattcttgcacccttttttgcaaccactctaaattagcttctttactcattacataaagtgatatggccttgtcgtgctatgttagccggctttacagaaataggtacaaatttgccatcagaaacactaatgaaatcatagctagaaagatccatccccgataagcattgaatattaccgtgacgccactcaaatgttgcatcggccatttgcaacctcgccgatgtatccgcttgaacaatctcaacatcatcgtcgtcccattgaattaaacattgatccaaggtagaaggcgcacaataattggcatggatccaacaacgacccaaaataacattgaaggtaccttg

SEQ ID NO: 14611 - DNA, 620 bp, Oryza sativa
tttagattaaagtttagctttgatactttgccgtgtaatcccgtgatcggttagatcgccagtttgcccgttacggaatcccaacttatcatttgtattcaattcctatctgcaattcagattgcttttatcttattcttgcttgtttctttgatttgcttgtaggaataaggttgatctgcactggcaagatcaacaacccacagataggtgtatcgatcgctaaggcgcaacacaacaacgtctagtacggttgtagttgggtcgtcaacgtttctctcaaatcgtagttatctacaactcaccgaaagatcgggccaacaacagccttgagtctctcgagtggagctcagggttcatcaggtggtatcagagcttttttttgctcagtgttctcaaatttggtcgttaacactactaccagaaaatagccatacaaaaaaattgcatcctatacctagccatatttgtgccattgcattgttcattcagtttttgctttgttgagttttgcgttgcattgtcgagtcatgttgctggtcttaagcgttagttcgtttagagtttcaggttctggtcacgtttgtaccactgtcgtcgtcgtcgtcgtgtacttgtta

SEQ ID NO: 14612 - DNA, 670 bp, Oryza sativa
tatatgttaaaaatggctaattagggtcctaaacaacactttatttcatatttttgaatgataagggccgattcatcatccaattgtgcccaaaatggttcacagtgagttgtcttattagccattttggaaatttgttaaatcagtgctcagggaatgaaagaagaaattacttcgggattcttttctttcacttaattgatctgtttatgtaaaagtttgctgcctatgaaatagtgatagaagggtgttttggtgcttgatgctgttcggttgatacataaccttgctgttgagaggtccatggattagagtttaccctttaatcttttacctgcttgattatcaattgcaggttgacaggaaattggtaaagcaaactgtgatgacatctgtgtatggtgtcacttatgttggagcacgtgagcaaataaaaagaagattaaaggagagagacatgatttgtgatgattcagaactttttagtgcatcatgctatgctgctaaggtcgaatgtcttattcagtggaactgttttatttcattatcctacataagtgtaattaaattgaccatataatatttatttatttatttatttttgatgcttgataggttactctgacagcacttggtgagatgttccaagctgcccgcagcattatgaact

SEQ ID NO: 14613 - DNA, 518 bp, Oryza sativa
tgttgtctttactgtcagagggtaccaaagagttggtgaaaatattaccaagggtaaacctgacatgcatgaagcaattgatgtaagtttaattttctctttattatttttttatcatccattaatttgttcctgagttaatccctggaagaaaaaacatcacagtgctacacgcctattgaacctggtaaatatggagaccttgctaaaccaatggtaggatctaatttgtggtatgtatccaactctacatctctgtttttttcctacagcactgtattatttgacatatgcgagacagatattatgtacttgactttgatataaaacaataccccagttttgatctattgcatattttaataatactcacaatataaataatttagcttatagcacacctctatttggaagaatgtgagggaataaaatttatatttacacatatttatctagtaccaacatgtattattgtacaatactggtagaattatgaattttagtaagaaaatagaagt

SEQ ID NO: 14614 - DNA, 796 bp, Oryza sativa
ctccgacatcatgatcaattccggaggcctaatgattgtaatgatccaaggttccatacacggttccaaaagtccgtgtatgagcaagtgtatgccaacaaagccttcgccgaacacaagtggatttcttggaggcacattggtgagacaccggagtttgtggatttgcaagagatgttctgacccgttgggattgatacgattgtcaccatgaagcaacattttgatgaagatctcatatctaataggttaaggtgtgttgggccatattttgtatgggtatgggctattactctatattgtgtgttctttatcgttttgttgaactctatgtcatttggacccttcatggtcttgtaatagcctatgtttatttgtgagcccttttaggatgatgtgtgacttatgtgagttgaatggttaagtgatgtgaacttgtgcgatgatggatggtatatgtgatattgatatatatgtgaccatcttatgctcatgaatgaatatttcttgaagttcatattgagatattgctcttgtgtttgtgatatgttgaaatgtgaaattgaaattggctccatatttgctattgttgttatgcatatgtttagggggagcttttgcttgtcattgcaatatatctccatgtgctctgtgtttaattatatatatttgtggtgtttgtcatcatttaccaaaaagggggagattgaagcatctaggcccacggtattaattttggtaattaatgacaagcactaattgtggactaaccattgtgtttgagctatttgtttga

SEQ ID NO: 14615 - DNA, 882 bp, Oryza sativa
tattttaattaactaacaccattgcggtggcaccaaaccaaaactatgctcatagtcagagtctatgtaataatgtgatccccttttgtgtactagttgaactaagcatggctaagcatttcctaaaccaacatctaatcattttgataccccagttatcaatggcatatggtaaacaatatatggctgagtaataggacccatcccacataacattgaaaaagaatgcaacatttaatagaaatgcgggatatttgtaaatagggtacaatatgatcaaatataatgcatgacatgccttgctctcgcactaatgagacctcagcaacgtcttcgagaaactgcggatcgacgaaacggccgaaatctacacgacaaacaaagcacacaagcaaaacatactataagactactgaaacagggaacaaaaccatttttaatggattctttgcatttttatgaatttactgagacttgaatggacttaaacggagctcggatgaattacttatgaattttagaaggtaaactatgtttttactaacaaagaaaaaatccttaattaatttattgcgcaataatacccagagctgacgtcatcaaagggggggggcggcgccgacatgcgggccccgcttgtcagcggcacaaggggagagggagggggcgccggctggtggctcaaggggaggggtggtccaccagtctgtgaggcccaccgggcagcggcacaaggcgggagggggagtggatggtggctcggcacggctcaagccgaccgaccatggcagggccgcggcggcggcacacggcctccgaagacgaccggcggacggcgaggcggcggcggccggcgcgaaggcgacggcgcacggccggaac

SEQ ID NO: 14616 - DNA, 713 bp, Oryza sativa
gtcgcattctgccactgacgttagtgatgtgtcggcggcggcccattcaccgcgctcatgaactcctcgtcggcgaccagcctcgcgagcgcctccggtgccaggcaaatctccaccgccatgccgccgccgccgcctcgcctttcgtacaccgtaatcttcccgtccatcttattcccggcgccgctccggacgcccaccggcctcccccacccgaagtcgttgccgaacacgtcgaaccgcggcgagcccgagatcaccaccacgccggcgttctgcaggctcgccaccgtcacgaacctcggcgtctccggccacgccggcagcgtgcgcctcacgctcgcctcgtcgcccgcggacgccacggcgcggttcagcagccacgccgcccagccgagccctctctcgaggagctcgccggcggtggccctcgcgacggcgcccaccaccgtgttgcccatgtattcttgtggcacctccttgacccgcgctcgcagtcccacggagaggccgtgcctcgtctccagctccggcgcgaggcggcgggctcggcacacggctcgccagatgtgcgcgaccaccgactggagcgacgatatggcggcgccggcgccgccgccggccatctcggcgttcgccttctccttcagcgtcctcacgctctccgccgagaaatggaggaagcactcctccaccggcgtgtacgcaggccg

SEQ ID NO: 14617 - DNA, 511 bp, Oryza sativa
  unsure (1)..(511): unsure at all n locations
gtggattcccaacttgtttcccggcttggcaagcactgcacacacgatctttctcaaatgtgacattagtgagcccgaggatgtgttccccctttagaagagttgccaaattccgcattccaacatgggctagtctacgatgccatagccaacccatgaaggatttagcaatcaaacaagcttccggattcactctatccacatcgaaatcgacaagatagagatcaccctttaacttgcctttgaatgctacggaggagtcatcccttctaaagacggtcacatcctcatcggtaaacaagcaattgtaacccaacttacataattgagaaatggataataaattgtagcttaatgaattgacaagaagaacattagagagagattgattattggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14618 - DNA, 10244 bp, Oryza sativa
aagttttgtgatgattcactactcaatattatccacgataatctgagtagtgacaagttattgttgtccggggatgacagtttgtggattgctacagagcttgcatgagctttgtattatctccattttgcaacaacaatatcagtttttcttttaaattttgcttgcatagggatctcaatttcaggacaacatctagatgatatttcgatcatttacctgagataatattgcaacctcatttgatgaattgattaaactatttttaccgtgatcttaagatttttcatagccttggtcagataagattccttcttacaatgtaagatgctctgctacctagaacacatgttggatcagagttatttgttgcgttctttagtttttccaaagaaaaaatctttgtgctatcactggcattttcatcttaagatattggtgattctagaagaaggcccttggtatttcttaaaatatttcttctttgcttttggatataccttctatacttgcagaaaaggaatacccccacacaaacgtagaagaaaaattccaaaggcaacacccagaccaattaatagcattacctacaaatagtgtttcccatatgtcttcccttttattttattttcttaattaggtctcttctaaaccgttattacaacactacttgaatggctggtgcaagattaaacttttgaacgttaccttttcctttcttaaagagtgcacaaaaattaccaataggatgaaagccagagttccaaaaggggaaaaaaataagaatctatacaaaagaatttcctgataaatgataattaatctttttctgtaaagtggtgagaatggaaaatgaagtccaatttgtatgtagttttgaaaaaagatccaaatgtatttagttttagcctgacttgtgaatcattcatattgcaaaatactcaaattacaaaattaaattcattggaagagaaaatcaagtacaacacgcattgtatggtcttggacgccacatatgtgctaatgtgcattatgttgtttttgtatttcatagctaatagtattcatagaatatgttaaactagaggtgcaaacaaccttgatcagctaaaaacatggctcattctaatctgtttaaccttagtagtacgtgaaatttaagagacggtggctaactgaattgttgttgcatgtgcaatacttttcaatggactcatttctactctttttataaccttactagtacatgtggcatcatgcaggcaaaagtgggtgcttaccgagcacaaagagcccatttgccacatgctttattagaatagaattgcaaggctagaatgtatttagaactccatgaaaaaatagggatgtatccctgaaagaaagtacagcgatatatagagtcaggggcgtaatagctctttctgcctcaggcaatagaggcatttgtcatcatcgtcgttgctccctcccaatgttgttacatcaaagaacaaggcaaccagatctggccacccctgaactcgtggcggccatatttgactacccctgggctcatcgcagctagatctgacgacctaacatcgacactggaccacactaggacaaagatttctgctagggctgcagtggaggaggtgagggcgaagcgatttccacagcggccacaaagaggtgggggaggaggtctccaccggcgcacacgggacccaaatgatggtggggacatggaggccggcgagtaaagaatgagttggggagaaggggttggagacaacaggagacagataccaccacacttaaagaatatcaccctttgcctggcgcagcttggctcagctagtgctctgcctagattgattttctgcatcgattcctctaaaaaattgccactagtagttgttttggtatgccagttcaactaaaaagccagcactaatgtgggatcatcagtgctagtttttctcttctcattgcacgtatgagtcctagaagttaggaaaccgctatcaatgttggttcttgcttaatcagcattaacagggcatcaagaacaaggagttctatggtagtggcattgtgttctgctccaaaatcacactcggcaaccttactcgcagataattactttatgaactctgctagtgttactttggatgccattacatatgtttcctccatcttgattgtgcagagtcattaccaaacccctatcccccctcctctcctccatccccacaagaaaatatattgcacccaaattcaaatccatagcagattatttttattttgtatgtcaatatttcggtttaaatgagggcctatatagaatatacaactcgcattggagtttaagtagtaacctcaaacaagaataaatgatggataggtggacatcaacatagaatttgcaagctggcaaaaatatttccacactttacgtttcacggaataaattaagagattacattttcattgttgtatttggagggacaaatgaggcattagaaaattgagatgctaagaaacatgcctggatcaattttacctcctgtagaatatttagtacgagccaagtttggaggtaatgcaaacacgcatccccctgcacccctaaaaaaaatactaattagtgtcaaatgtaccaaagtagaaatgatgataggtcagagcagagtggtagtgtagtacatagtacaattgtactaccctatttaatgatggcaataatactagtaagctattcccaaatcaaagatcctacgaaatcgcccacttgtgcaattcccaaatcaatccccttccccaatatccaatctagtctagcttaggggtagagccgccgcaaccatcactatggcctccgatggtgacaccgtagccaagctcgcgcaactctccggtgccaaccttgtgtgccacctccaaaccacaaatcgcatggctgattacaaggtggccgcacatgtgcttggcgagcgtgagcgtcgggctgccgagactgaggcatgtctacaagccaagattgatgtgcttcagatgaagtgtgatcttctagccaaggagggcgcatatagtgaaggtggcaagaagactaacattgactccaacaaaaatgaggtaagtggcaccaatcattcaagttcttcaagcaagaggaagagggtcgacatggacaacatgactatcccaccagttttgcgcaagaattctcattgcatcgacaacatcaagagcaccaaaaaaaagagggaggccatgccagagttcaattaagccagcaccaaccatgtcaaataatttcaagtgcattctacaattgcaactaccactatcatccacagttcccgcatccacagatgtatcattgtcagatataccgattatagccacagtaccccctccaacagcgatcttggtaggtccacccttacttttggaatcagataatcaagagagaaattggaacaagagatcagtattctctgagttgggaagtgttgatcaagagtatgtaattgaagaggaaactgctcccttgttaccatcatctatgcagcaacctccttccatggggctgatatccacgggtggttctccaatagctccagcactagtagcaactagttgtgcctctgtacccgatatgagcccacacttggttgaagaatcaaataagggaaatatagaaatgcagaaccaattatctcatttgcacttgaataatttgatgaaccaactttcttttgatgcttggatggaagaaagtggaggcccctttatgagtgagcaagtacccttctctttggtgctcccatccagcagtaaaagtgcatctctgctgtcaaaaatcgaaaccagcttgtgggagtctgaggaaaatatggttatcagattcatggaaaatgtggagctttgcatgggagctatttgcgctctttatcgccaaaagaagctaatggttgaatcgacatgtgaagaacgaactaagtttacttcactcaatgaaagtcaggcttacaggtatgttaaatattaggtttgaatgctaggaagggaaattattcatattactacatattatatacatactgtattgtatagtttatttacaaactagttatataaatatttgagtatgaatttcagctacaatttattggaatcttgtagttttttagtttttgtgtctgaagctgaactttttttttcactgcagctcatgactgctatgtagaatggttattctaagaaacatttatatggctgtcatatatatgatctgtcattaaaaaaatgctttataggaaccacttattagaaaaatgcttcatcaggctcttcgaagttactattaactgtttatgttgtggaatgcattattaaatgctttataggaattgtcagtatggtgttttttatagagtttctatttagtttaatttatatgatacactaatagtatatccttcatttttaagaaattaaggtagacactccatgattggggtgcattttgttagttcttatgtatagaaaatgatgaatatataccctatgttgcctttgttattataatacaggagaaagaaagatataaaactaaaagtctttctttccttggacaaaatataatggaatttactatgttgattatgtgatgaccttacaagcatgcatgctcaatgccctcactaggttctttatgtggtgtattttatagggtactattatttaattcttgatttttgtactcatttttcaatgtgatgtaatagacaggttcatcttaaattgcatatttggttaactttcctaaaaaattgaaaggcaatgctaactaacatagatttaggtgcataactatgtaacaattttgctgatcatctcaattattgaaaatattctcctcttttgttgttgtgaatagggcaacacaattggcagaatttcttttggatggtgatattaatgggccaatgaagaagaacaaagaagacctagtgaaccatgatgctacagggcccaaattcatccaggaatatgcaatacagtgctctaagcagttgtttgacatttacaggaataaagaggatctatacttttgttgactgaggcaaggttatgtgtgttgttttcttttgaggttggcgagcatcgtgtcattaaaattcaaacattatggaatttcatatgcagcagtgcatattttattgtcatgtatgaataagagatcatggaaacttggttgaagaagttaattttataacagtttcattgatgaatattttcaagtttacttgtatattggtgtgcactttttttcttctacttagcactcaatcttgattttgtattaattgaatcatatcttccctgtgtaaaagcaatattgcacaccatggcattgtcactaacatctgaacaaatggtacttgataatgcatttttttactatttcattttttttatctttaggcatgagaaaagagaacatgtttttactacactagtcaaacagagtaaaatcaatttatatacagtattggcatctaatgttttattatgctagactccttcgccttgatgacccatagacgtgggagatgagaaaataataaattttgtgatatgccatgtgacctcactaatcaatcctctgttggcatttatgccaaccgataaatagaagggcctggacactcctctgtcgtaaaatccacaatagaagctcatcatgtctcacaagttggagatcaagaggagaacagtacagtagaggcttgtcaaatgagagtaatttacaggaaagggagacatcaggaacccgatctcttcagattttacaggagacattacaaggagtggtcactgtggttttctagggaaatatggcctggcacaaccatagacctgagcatcgattggcatgctacttttaatcattccttcaaagtttaaagattagcatgctctacacatcaaaaactatggacaagcctgcattaacagtttcgtatgtaatgtgcacagatcacctgccattttggtagagctctgtcaataacctgggtagaactgagttccttttattatttttactagatgatatggattgtgaaaggcgaaacatacgcacctattgcttgatagttttgttgatagaaagtatataaattgtatagttatttttgttcatgatgcaccatcatgaagatgtttcctttacagtttacaagggatcaatagagagggatttaattaattagtactccctccgtttcaaaatatttgacaccgttgactttttaacacatgtttgaccgtttgtcttattaaaaaaatttgtgaaatatgtaaaactatatgtgtacatgaaagtatatttaacaatgaatcaaatgatatgaaaaaaaataataattacttaaattttttgaataagatgaatggttaaacacgtactaaaaagtcaatggtgtcaaacattttgaaacggagggagtactggaaattactccagcaacaatgaacaataaccctcatgcacactctacagatatttgctcttacagtgtcatactcccttctgatgtggccatttcagtcatggacatagttctcccttgtgtctataaagcttgccagaagacaggctgaactgcctaaggacatcttgacaattttctgcaggcaggatgaactacctaatgtgtgcatgaattaattcaacatcgacgatttcacatgtatgctcttcaataaatggcaatgatctactctttggtagagacagctaatttgtaagcaagcttctcgagttctccacagagattttattcattagaaagatcaagaatatttgggaaattgaagaattagtgcatctaatcaacctgctaaagaatattataggagaaggaggcgctgggaacttgatccgtacaactgttttgcttgatccgtacaataatgtgtttgttctttttttcaaaaaaaaattatggactgagatttaaaagagagtaccatgtggttttctaactaaaagatacgtgaatgtaagacatggaatagaacaatgccattgtgttttttttattattttacaaagagtataaatcgtcaatactcaatccattgaactagcaagtagaagaagaaaaagtgcagagtggtagctatagcttagtggtacattattttactccatatatacaaaaaaatatactaattgctgacaatttgttgcaataataatgttgagtagtacattagtttgatccaacaacaaaggctcatcctctttttcatacccctactacttgattaaagggtatgtcatgaaagaggcaactatagcttgtgtaagcaaaagacggttgatctagaaaagtccatctaatttacaactcaagtacgcatgcacttatatcttgcatgtcgatcatgaaagattataaaataacctcaaaacgtagattatatgtcactcgacaaacatacgcaacactaaattcaatccatgcatctcacaacaaaaaaacacaaattcagctattcagctataaatagctagcctactcaacggttttgtcatccactatcattaaaccagcaagagaaattcgtcatgtctcacacttgaagttcaggagcaagcaaacaaaaaagtataatggaggatataaagtcaactgatagtgtgtagtttgtaggaaagggagccatctggaacttgagctgtacagttatagacatggttcagcaacagtgatttttttagggaaatatgccctaacaatattagaaaccttagctaaaatcactcatcgtccatcatgtccgttcctcctccaaatgatggagcactgcactcattcagcagcgccacatctacagtgttgtgcttaactgcttatgctctcatggcatttacagtttccccatgtactgcatgctgaccacggcatttgtctccatcgatgatccaaaagtgatagggtgaaacacgcaccagttgattgttagatttgttgatgttgctgcagttattttgattttttgtagggtgtactatggttaccctgtctatgatgtgccatcatcaagaaagtgtttcatttacagattataacagtcctatatatatgtagacaggtttaccggtttagtgccccatgaaggctgaagtactgatgtgtatgagttaattcaacgtctttttcaagggtgatgtgttttgttgctctccactggtagtattatacaaccaataaaaataatctaaaccgttcgttattaaggagttgttcagattaatgtcacttcaaaccataccattttttggtaagttgacaaagatatgcatacatttaggtttttaccatactttggtaaacacataaggaatcctgccaaaacatggcaatattgccaactaagtttattttagatacaatctgaacagcctctaaagacatactagtaatgtactaaacagtgattaggggtagattaatctgtgatcatccatttcgttagcatctttcatattccatcgaaaaagtcaaaaaaaagagagaaaaaaggtttcatcactgctaaatgatgtttatacccctccaaaatattgtttttactaccggtaaatagggtggtagtgcaaataaatctaaactcttggatcgaatgagatcaatggttcaagtttcttgctactaccagtagatagcaccatatataaggggctcatgtttcaaatccatgctggccaataaactgaagcaaccaaagcactcgttctctgtggtagaaacagcagctaaatgagttcattacgagagaggaatgctgacgaaaaccaacagaggtatttgaaaaggaagaaattagtcaaactaccaaagtatatatcatgggaaaggggaggcatatgcactcagaaccaaagtatatatcctgtgggaaggggaagcactgggatctttgagtcatagaacttgttcttacatactccctccgtattttaatgtataacgccgttgactttttaacaaacgtttgacctttcgttttattcaaaaaaattatgtaattataatttattttattgtgatttgatttatcatcaaatgttctttaagcatgacataagtattttcatatttgcataaaaaatttgaataagacgaatggtcaaacgttgattaaaaagtcaacggcgtcatatattaaaatacggagggagtatatcgttagacaaaaccgaaagcaggatacaatgtaaatgtagtgcaaccgcctcactcaccggggcgtggaagttgtctagcactcgtttgactgtgttgcgtcatattggcatatctgaaaagcttgcaattcttcctgcaacttcagcaaaagtacatagctgcgaattagttgacacacgcctgatcttgtcagaaattccaattgtatatatgtgctgatccttcaggcctacgagaagattagaccatgacatgatgtcatcgacgaggaaacggactagtataggatgcacccacttgttgaattaatagttagataagaaaagggcatgatgtttacaaatgtgccctgccattgttataggagaatatggtagaatgtatgtacgagttttgttcttaattctggtctggtgttgggataaaaacaagtaccttccatgcctctaaaatgaggaataatatgaccaatgccatttgttatggatgggtagaaatcatcagtaatcaatctagttgcacccaaaaaaaatactgccaagtggtaactagctactatttactctaaaataccttatcgatgcaagcttcccgtgcaccaactacaaatttaaagaaaaaatttataaaaaaattagacacatacttcccaatctaggtgtgaaatcttatcttcaaatttattatattttagctctaaaaaatacgaaattctgatagattttctcttcaaatagtcaaatttttaaatttttttgttacggccaaaatataataaatttgaatatcagatttaacagatatgtgtaatactatcaggagtacatgtcattttattttagaacttttcgtggcatttgctagttaatatgcacggaaattaggttgtacgcatagtacatgttccaaaaaaagaactgctttcaagtaggtgcaacaataatgcttggtacattactaactagctgagctgatataagggaaaat

SEQ ID NO: 14619 - DNA, 14517 bp, Oryza sativa
actacatattttcccctgatataatgtggggggtatgtccaacaggcatctcatatcaccataccacagtcgttttacaacatcacaagaatgaaggtctatatatcattttcatgccacagcaacccagttacagaagtggcatgaaagaggcaactattctagcttgcataagcaaatgagacctatatgcacctgatcagagtgtttggaaaaagaggcaccaggaaatgccacttgctcaatacgctgcaccaaggtacacttgtttctagatcaaccacagtgcgtcgcccaaagcttagttatcatctcaaccttctttacaatatttgtgttttgttctaaaaactgtaattcttcggatccatcttccaacccgctcgacttgcgagggttgagagctcttcttccctggtttcaagaatattttctgtcttccaagtccaatctgcttttcatttatttaaatcttcaatcgttctgctttccacggtgtaaaacttcgtatcacctggaaaaaggaatttcaactcatttcgtaccgagtgcgttggaaactggaagcatgattctatactctagagcattgcattgtatagaatagaaccatgaagcatacattgtatcaaggctgcaaggcagcaagggtggtgactaaaatgaaaccgataccgacatagaactgaccgatcaggaccatcgtgtcggtcggtctgaacatgcaaacacacgctggtctgaccggcagcacctgcctggtctaaccgggccacacagtcagtaacaatctgttcatcatttgaaaatcacatatctccgaaaccacttcgccaaatatcaaaacaaataatctcatatggcaattgttcataatgaaataaagatcagagcacactttgattttacaataaggattttgttaaaaggtattatactattagcttacttccggattatggatgttcctgtttgtgaaaggtggctagcatggtgtgcaactaggtaattaacaaaccatatgacaggtatttaatcagatttttcacacttaaaaaaagatgtgtgacctgcttgagatatttttaatatgagccactatattgcacgcagcttatatggtgccggccatgtatattactttttatattatctctggccataattaaatattcaacatctaggttataatttggtcaaacttttaaaactttgagcatttttttatatattaaatttgtcgtgtacacccaccactatagaaaaaggctttagtgtcgggtcataacccatatcagtgacggaaatcgaaccggcactaaacttttgacactgatgtgggagggtcatcaagtgttggttcgtagttacaaccagcactgatgatacagaacatattttttatactcttaccatccctagctgtgtatattggaagatacaaccactattttttatttcttcaactcaaatataattcttttcatggtggaaataataacccaaaacctctccctcacatacacctccctcatatcaatcttgttagaaaatgaatatttttccttttgacccatcctaaccgagagtttaatcattgatttgagtatttaaaagaattaaaatgaaaaggttgtccactataaaatcgtagctcgttgagaactacaatttccatataaactttgttgcaattcgagtttgtataaaaaagttaagttcatatatccgaaataagcactaataagattaaggtcatcggtgctagatcataagaatatccgtcaccgatatgagtggcattgttgccggtattctaaacatctggcatcgatgtcttttcctgacaaaagtgtagtcatcctactccaactagcaagacctagcactgatgcgttactcatcagtgcctattagtggtaaaagacctgacactgatatgttgcgaaataattagtgccagatggttataagactcggcaccgatatctcctcatcaatgtcgggtgaaggatatgtattgtgcaagcttgttttttgggatgggatcgaaaccatcatcaatgtcaggttttcacgaaccggcattgatgatgggggcactgatgtgttgttttgtggtattgacctttgtcccatcatatcatgatatcactcttatgtagccaggataaattcaacctttttatctttgttccatgactttgagctaatataatagcgtggcacttcacatgtagtggtggatccaagctgtcttatggctcagactaaaagtcctttgttttacaatggaaataatataacattcagcctattcatgatgcacacagatatatttgtttacactaggatttgaaacgataagcccatagagctagactttttcaccatgctaattagatgaagctttaatatgcattgggttgttccaggaattattagaccacacggtcgaggtgcctctgttcacatgtatgctagccaataaatagtagaggctagacactacccctctatcctaaagtccgcaatggaagctaatcattcttactacaagttaaggagaacgaagagcaaaaaaaaaatgtagaggatcgtcaaacgagagtagtttgtaggaaatggagacaccaggaactcgagctgtataagaatggttgtcaacctggccatccatcacattgattcctcctctgatcaatgatggagcacttcagttcactgtatcctttgagcagaggcacagccacagtagtattgtgcttcagctctcatggcatttatagtttcccccaagtgctgctactgatcacgggctttggtcaatcgatgacccgagggaaaatttagttccagtcatttaactagatgacgcaaaatatgatagtggggtgaaacagttttgacagatttgtttattttgctacacttattttgattctttttcatggtgaacgatagttatgttgttcatgttgtgccatcaagaaaatgtttcatttatatattataagagttctgaacagagaggtttactggtttagtgcccaaaattgctcatgtaacaatgaacagtcatcatgcatgcactctaggaatacttgtaagattgacgaagtcaacacaggcgtctcgctgtcgacgggtacgtcgcctaccactgaaaccacaacgctgttaaatcctggaaaatttgtaaatatatgctgccaacataaataaaagcattttacaaatttgccacaaaactgaaaaataattatataatttatttgtactataattatactgatcatgccacaattaaattatattctataaatttgccttgtagcaagctaggctgcagagaagcaaaggatggtgactaattaactaagctttaatcgcaatgtttccatcttgtatcctatttacagttcaactgattggtaataactagcactgatatcctctattttcggattattccgctgattctgagttttgtcatacaaattctgatcgttaacatcttcttccttcaccagaacgtagcatattggcacctttgtcgcaactacatgtattgtctcttttaaaaaaacattgtactaacgcaagtgcacacatacgcggaaggatacacactcatctttataaatgcataccatgcccctataagcttttccaagagagttgacggatgtgaagcgtaaattttaaccatcaactactacatatcaaatataatatcaaaacttatttatatgggtttattatactaacaattttcactagttttgataaatatatgcatacaggtcatttatggaagaaaatacattcgtcatacgacaaaatgaccatctggccaatcatgttgttgctacaacttcataaagctctgtccattagttcacaggaatcttcccagaattttcacaggctaggttataaaaagcagggttcaccattttctgcagttcaaggccctcgcaacatgactgaccaaattgctgtgtcaagtgacaatcaagagcaaatctggatatatcatatatggagaatttatttatatggaaaaggaggcactagaggaacgtttgctatcagtagttatcaggtgctagagctactggttgtcctactaattatactctacaatctacctggaagaacaaactgctcgcccccgcgtcgcccacgcgcgggcgacacggggggaaaccctagcgccgcctccgccactctctcctcctctccctcccctcgccgctgccggaacgcgccgccggagaaccgcgcggccagccgggatggcggcggcgaggccaacccccgacggcgccccgtctccgcgcgtggatggcgggccggcgcgtggtgcaaggctgacgacgcggcgtggagacggtggatccggcgccgctgcggccggatctggcctccccgcggttggatccggcggatccacgccggatctggccggaggcggcggcggctagcggctggtggctggtggctggcggcgacgacgagagccggaggctggtggctggcggccgctggcgaaggaggccggtgcatgcagaggatgcagtggcgacggcgaggccacggtggcggaggcggtggaggatggcgcggggagacgcggctggaggccgacgcatgcggaggccgcggacggcgatgcgactggaggctgcggaggccggcgcacatggaggcgcggctggaggccggcgtgcgtggaggccgtggtggcggccgcagcggaggctcggccgatgacggcggagggcgacgtggcacagccggcgacaggggacggctacaaggcgcgacggatcggcggtggtgaagcccgtcggcggtggtgacggtgaggcgatggctgcggtgaggaggacggaggcgacggcgatgcgaccaagcacccgttgacacggcggtttgatcgaggcggcgatgacggtcatgctgtgagggggggtgttgaagcctgcggcgagcttccatccaggcgtctgccttcttgcggtggcggcttgccgccgaaagatggccacgctggacgggcgagtgcggggagaggggatccattcttctctctcaccttctccctctccaacccaaccacgtggatggacgtgaagcgcggtgaaggttgagactcttctttgatggccggacggtggcgaggcgtcggcgcggtggctacgtgtcaaagggaattagatggtggttctgctaaactggcatgcactttttgacgcgggagagtagaacaacaggcgaaagcctagctttcgggccggcaacggcgacgcctacgggcgccgttttccccttggggcattgtcgtgttttctatttttcccagtgggttcttcaggtgaaaacctcgtcctggttacctaggacggacggtggcggcgcttttgtcgtcgttttccttcttggaggcatcgtttagaagtcctattcctttggggtgttgtgtgcttgttttgttttaaacagtaggatcagacgtagacgcgtggtgtggttgtatattttctttttcctgactacagtctcccaggactataggcttgtattttattccttctttatcaatagaaacgtcgcactatcttgtgcgggttgtttcaaaatactctacaatctactgatctgcctcatcgttagctagtactccctctgtctctaaatatttgacgccgttgacctttttaaacatgtttgattgttcgtcttattcaaaaaatgtaagtaattattaattattttcctatcatttgattcattgttaaatatacttttatatataaatatagttttacatatttcataaaagtttttgaataagacgaatagtcaaatatttgctaaaaagttaatggtgttaaatatttagaaacggagggagtataactcagtcttctgcagctaggaaaacttcaacttcttttactttgttagtttgttttgagacggagccaaattaagcatacgtttcgaatctacaagtccttggagctggactttttcactgtgctaattttagtggagttcaccccaaacgtcacctgaaaataatgaaggcccattcttttcatatataccaaagtccaatcctagcttcttattactctgtcaaaaaaaaaaaaaaagacaaactttagctacgtgtgtgttcaggtttgtagctaaaattggaccttttttttttaaggacggagagggtatataagaaaataagacatgagtcaaccagactgcttggagaaggaggcactgggaaattctcttgcttactaacttttactaatgtgctgaagcgtcacattcagctatacagcacggcgctcgagcttatagctataacaatcttcaaggagggatttcgagttcttcagtatacaacacaacactggattctaaattctaatgctttacatgtgtccaatatgaaggaatagaaatattatttacctgaccatatataagaaatatttttcagtgcatctctcaaatccaatcagctttttgcacgatctgaatctgtaattgttctcttttgtctgtgagattcaaaattgagccaaactatgtaatgttgaactgtaccattaattagtaacaaaactctagcgatagggtctaatacccattatattgtaattatgattgtaacgctgatgcacagttatctaagttgtgaaacattgttgcaataccttatatggctatgttacaggagaatattttgctgtagtggatacaagccaatagatagctaggttgcaatttgatacagtgatataggttcacctttccaatccagtgcataataagttcagcattgaaccatttatcacatgcaatttattacaaactggaaacaatggtgcatgtatatatgctgggcatttcacaatctaggatataaaaaaacagggttcaccattttctgcagttcaggccctcgatcgcaacatgagtgatcaagttggaattcagggcaaacgaggatggatatcgaactggttggaaagggaggcactaggaactttagctggtcaggtcagtagttacaaggtgccacggctactatagtcatcttagcaattctcccttatcatgtgcactcctcttccttagatgatagatctgtctgatatgtagctaggaaattttcaacttcttgtaatttgttttgagacttaagctaattgaataacgcagcattttacatgtagatgtagagccaaagtatgtagctcaaatctacgacatggagctagactttttcactgtgctaattttagtggagttcaatatgggttggtttggcccaggaattggacactatttattactcttagatttggcattttaactagttgtcatcaatgtgtcaatgacacgtagactctcatatgtcaatgacatgcggaccctcaagtgttgggcccgaataacaaataattaattaccacatttaagagttgtaagtattttttttccacctcatgtccgtacgtatgctaacaaataaatagtattcctttcgtcccagaatataaaaagttttagagttagatacggttattaagaaagtaggtagaagtaaatgatggaggattgtgattagatgagtagtggaggtaggtgggaaaagtgaatggtggagggttgtgattggttgggaaaagaatgttgctagagaagtagttatattttggaacaaatcctgagggctaaaagttgttatattttgtgacggatggagtagaaggctagatgctctctgtagtaaaactcacagtagaagctcatcatgtctcactacaagccagggagcaagctagtggagaaaattatggtagagaggaatgtcaaaatgagagtagattgtaggaaagagagacaccgggaacccaatctgtacatatcatgaaggagatgctacatgatgcggcaactgtcattttttagggtaatataccgcgacaatgtgagcagaccatccatcaggctgcacggcgttgcaagcatggcatttttatgggaatagcactgcactcatcgtgcataagcgtagcgtcaacgtaatcgttagcgtgctctgaacatcatgcagagacatggacaaccttgctggcttttagctcatggcattttcagtttcatcgatgtactggacgacgcagaatgtgaaaggctaggcagataggtgaaacacacacggattactttacagtcttgttgatacaaaaccgagaaaattatgtagtatgtacctccattttaatatataacatcgttgacttttttaaaacgtttgataatttatcttatttaaaatttttatgcatatataaaaaaatattaagtcatgtttatagatcatttggtaataaattgaatggcaatacaataaataagaattatatttttttaataaaatgaatggttaaacgtatctttaaaaggtcagcgatgtcatataataaaaaagtggatatagtagttgtctattataatgttttatattataaattgtttgacttttttccatagtaaaacatctttaagtttaaccaaatttattaaaaaatatagtagttttttcaacacaaaacaaacatattataaaaatatattcaatgttagatttaatgataatattttcttattttagatgttgttaatttttttataaactcggttaaacttaacaaagtttgactagaaaaaaaaatcaaatgacttataatatgaaatggagagagtatttcagtcatgaggatagtactaattatgtgcattttaatagtttcttgcaggcaggctgatctaattatatgtgttcaaataaattcagcagccatatatttcacacttatgcatgttggccaagctttttgcgagtccaatatataagctcctcaagagggagaaatgttccctacagaaacaacaagaatattagagaaagaatacatcgaatcaaactaccaaattatagtatcttataggaaagggaggtgctgggaatactagctgtatagaatctctagttcaaccactctgacacaacaaggatgacataatctacaccttggtacaaccgtttcacttcagttacctggacatggaacatgtatagttgcatgtatgattctattgcactgaacaagctgatcttctgttcaacacctttggcttgcctttcttccgacagcaccgggaaatcaccgttcaacagttgatcttctcagatcctgtgcgttcatcctccgggcatggaaagaaccgagtgccttgtacgaggaaaatggctgcaggggatgagtttgagttactaattagaaaggaaattgaattttgaaggccaaatgtgtggcagaggttattactatttacaaatataaatactgttctaaacaacctgagaaatcggtaggatgtgttaacatttctaattatagtctgatatttgaataaaaatatacggcattgattttgcattgaaagacgcattcctctaaaacatggaatagaacaatgcatttgttctttttctatttgcagaggggtataaatgattgaacagttataaaaatcatcgataatcagtctagtagcaggaaaatttgattgaacgttagctagcttctatttgcccccatacctaaaaataataactgaattggtgcgacaataatgcttggtacattaataattcattgattaaatatcatgaggactattaaaacaaagtttctggatcaccatgacatatttgcttgatccatcaacacagctctcttacaaaggtcttttttactgcaacgaagttacagcttataagctcaacatgaaacaggcaattgtgctagcttgcagaaaatggatccaaggcatgtggcttgaaactaaaaatccatggagctagactttttcgccttgctaattttaatggatccgaactcaatatgggttggacttgctgttgttcgcaagtacgctagccaataaatagtagatgttggaaactcctttttcgtaaaacccacaatataagctcgtcatgtctcactataagttgggaggagaaaattatgatagaaaattgtcaaatgagaggagtttgtcggaaagggagacaccaagaactcgagttgtacaggttttaactgaaactaggaagatagcccgcgcacatgcgcgggcttttaatataatgttgtttgaatttttgttaaagaatatttgcacgcgggtgattttttttttcttgaaatattctttgattctattctaaacctgtttttgtcaataatctatttgggattgttttgacagtgattatgattttcttctaattacccttgtaacatataaattgtaaattagacttgaaaccgtacagtcttgaatttatgagaatatattgtatcgcaacaatggagtttctaaaatttaaatagcatgtcttttcttgtatagtactccctctgttttttaatttataacaccatggacttttaagatatctttgactattcgtgttattcaacacaaattaatgttatgagagagtatatttatgaagagtgccatttatagattgatttattcaaccggttggtatggtttgtttccacatatgtggattaacttacctttgaatatttgtaaagtagtatatttgatttcataatatatactgagatttttagaaatttctaaggttgtttggatagcatgtaaatgatatggatatttgaactattgagataagtgtaagtgcttattattttacatgtaagaacatatagttggatccatgctactacaaatataacattttagataaataccactactattcacaatatcggctatgtgccactggaatttggagaaattggaccagtgccactccattacatttccgtaaaaaaatctctgttatccccaactgcacgtgggacctaactgccagttccatcttcacctccctcccctctattctctctccccttcctctctccccaccaccatcgttgacaaccaccgttgcagccgccatcatcgaccacctcagcggtgggaggcctcgagagccactaccgttgctactgtcgtcttcaaccccatccatggtgggagggctcgggacccgctgccaccatcctcgatgccaaccgtggcaggaggctcaggagtcgcaatcctcaacccaatctgtgcgggagggctcgaaagctattgccgccgccaacatcgtcgttgtcctcatagcagtagcggggatggaggaagagatgggggaagaaagaagagggaggatgggggaagatggacctcatatgtgggtccctcgtctaggggtctgacggaaaacgtgatggaatggcacggtccttgtttcttcaaattttaatggcacatagccaatatcgtaaacagtagtggcatttgtctcaaatggcatatttgtagtagtatgatccatttaaccctaataaatatatgggtttaaactattgatttaattgtaaagctagactacaaccattcaaattaagtatagccaaggaaaaatagggccaagtgccctagctagattactaaatattttctatcatcaatcagaccatcaactgatcaacctgcttagggcctctaaatataggcttaggcttattactttcgatttttaagttagatttttagcttatacgctagtggatttagagttataagtttaacggtggagtcatacatatgtcttacatcagccaaaattttcttttccaacctagtttttgatttaacagtataaagagtggcttatggctttaaaagagcaaaaaaaaaattgcttgcttgtttaagagtggcttatttttctcttctaattcgaagatctttaatggatttttggtgtgcatatgtatgcatatagatcatccacaactgtgtggctatctagctagcataaaaatctatgcatgattgcttggacagagttgagcacctacgggaggcaggcatgcagcagtatgtacgaactcatacatacagggatgaatacgtgcgggaggcagggtttaagggatctttttttttttaagattgatccgatggttgataataatgggcccatcgatttaaatgaaaatcaatggttagattttttaattgccacgtagcagcttgagagcattttgaggagtgacatgtggcgtcttgagagcgtttctagaaagtttaatggacttttagtatataataatagatagatagatagatgttacatggtgccacaactatgatgtttgagggaaccatgcccagccatagtcatagacctgatcatccaatatgttgattcccgtctgaatgatttagagcatcgcacgccatgacctctggtacggctgcaatcaagattagagtgctcttcacatcaagaaccatggacaaattaaacttgttggcttttacttcatccatttacagtttcttcttgcagcatgtgtttgttggccattgtaagttaaattattttgacttggatgatgcagaatgtgaaaggtgaaaaacacgctcgttgcttgacagttttgttgatacagaacatgtaaaatcatattgtgattttttgttgattatggagaatgctttatttatagtttataaggaatctatatatagagaggggtttaacgatgcggcatgaaagaggcaactatgtgatcgtgtaattaattgtactaagttattaaccagccttatacctattctcatacgatcttattgagtaaatgagtaactagaactgagatataattacaatatcttttttttcactgcctacaaatacagctcaactaacagtccaacaagaggcattttaggacatagctaaagcctgacaatggaagtccatgtagaactggtaccaatgatcatcctcattggttccgctaaattgaggggtctggaaccagcactaataaagactttttactagtgatagagctaattaattctttaccatactaaatatttaaatggagcccgacaagggttaggccagctgggcatgtatgcttgctagatagggcatccacagtgtgctcccaagccaagtaataggaaatattttaatccttatatcacgtagtactaaatattatggaatcaataaatagctgctaccaagctagagcactgcgtcgtagtagtaagtaaaaaaatattgattcttctggcatgtattgatcctcaccccctctcccttcatgcataaaagcagcaatagaactgtagacagcttaagagtcttaggaaagggagacactaggaatttaagctatacagaatggcgatgtctcgtgttacatgttgtagcaaaagtgaaaatttacggaaatatgtccctacaggattagagacaccagttatccattaggctgattcctccctctagatgatgagtattccacccactttcggttctagtggcacagctttgctccaggactgcatacatggtacaatctctctctatgaccggagggaaatttgagtttttactagatgaggcaaaatgagaaagggtgaaacacacaatcttgcttgacagttttattgatattgctacagtgcttttatatactatagttattttgttgatgacgtaccatcataaaaatgattctttttttttggggggtgggggggttgattcatttatagtttaaagagagaggggttaatactcaaaccttctcttgcaagcaagggcggagctagagcgaaatggagggtgatgccacttacttaatttactttactttagatcgagtttaagctgatacgggtgcctaaatttatattgagagaggtgcatacatggtgaaaatagatgagtgatagctaaaaaattttcttaaccgggttcctgggcaccccctaatatacaccagctccgcccctacttgcaacattgaacagtcctcatgcctgtgtgtaactatctatatctacagaacctgccagcatgtaggctgaacttccccaggataattcttaaattttcttggcgcatacataagaacgtggacggggcatggtgtaattgatgggggaaaataacttcagggtgtgcacttgaattgataatttagaagtaaactggattctgaagaaatgtgcactaaagcagcctaccattattttgaaaacagcctaccattattttgggacggagaatacggtggaatgtatatgtttttaactatggtcgcatatttgaatacataaccagcatgttcataaaagaaaaaataactaccatgtggttttgtaattaaaagatgcttgtctctaaaacatgaagtagaacaatgccatggtttctttttttttttcttacggagtggtacaaataattgaatagctagaaaatcatcaataatcaatatagtggatgaaaat

SEQ ID NO: 14620 - DNA, 8210 bp, Oryza sativa
  unsure (1)..(8210): unsure at all n locations
gtttatacaaggagacatgaaagaggcagctatactatagcttacataagcaattgaggcatgtgagtttatcaaagtgcttggagaaggaggcaccaggaaatttctcttgcttactgctccctcctttcctaaatgtttgacgctgttgacttttttaaatatatttgaccattcgtcttattcaaaaacttttatgaaatatgtaaaactatatgtatacataaaagtgtatttaacaataaatcaaatgatatgaaaagaattaataattacttaaatttttaaataagacgaacggtcaaacatttttaaaacagtcaacggtgtcaaatattttaggatggagggagtaagttgtaccacggcacagtgggccaccgacaggctacgggggcagcgcttgagtttatggttagaggactgctaggagacggtgtacggtcccaggtaggtaggagagtgagacgtgcggtcagttgcgcatgtgcgactcccttttcggcacgaacagaagtgcagcagccccacgtcctacctacctgggctgtactacgtgcataagcacaactactagcagctcacactagagcctatcagcctaccaacttttattcgattgaatctaatctgaacacatatgagtttgcgtggactgaattgactagtttggtttgaccagggaatatagtgtttggattacttgtgtttgagcctgttctcatattattttagtttgcaccgataggtgccatcacttagcaatatttgcatgtatcatcactcgctgatacttgtaggtatcaccaccagtacctgatagaaataatcactcattgatacctacagtaccatcaccagtacttggtaagtgcatcattcataatacctaccaagtattatcactggtacctacaggtatcatcagcgatacctggtaagtaccatcaatcattgacacctagcaagtattatcatcgatatctacaagtatcatcgttggtacctgacaacgatacctatcgagtatcattgttggtacctgatatataggtatcatcacttaatgatacctatcgagtatcattgttgatacctgacaggtattatcacttaatgattcctctcgagtatcattattggtacttgacaagtatcatcactcagtgatacatatcaagtatcatcattgatacataaaaaatattatcaatgatacatgaggtatcacatggtaccatctcgtgtactaaatttatggatgtctattattataccagtacttatgagaggccgacaagagatttgtgagtaacttaaagactcgtacacacacatcatatactgtgtagatggatagcacatcttaactaaaaaaattaattaaccatgcacgtatatatggcctggtcagtgggcacgagttgcatgacccaacttgcttacacatagcactaaaggctcgtaactctcgatgcatgtagacatgtagtgcatggctagagcatgtgatgagccggagcagcccatgcaaagagactacgcacgattggagagagtggatagtcgagcatggagggttatgcgacgtgaattgaaaagaatgatgtacgcctgttccgctccaatctgttggaacggtattccgttccgtagtttttctcttatggttataacgatctctgatgtattttttttagttgtgcagaatgctttacacaagccaaatatgatggaataaaaaatttatttattacctaattatatgaaaaaaaaaaagaagaatcaatgcctctctcaaaaccaatcagattttggtcgatccaaatctgcatttgttttcttttgtatgtgaaatataaaattgaaccaaactatatatgtatatgttgaattgtatcattagttatagtaacaaaacattagcggttgggtctaatacgaattgcaattgttatggtaacgacgccgatgcgaagcgagagctagctatctaatatgtacaacaattttacaatatatattttttggttacgttacacatcattgctcttttttatgtgacatgtaactaataatatatactaaccagttgtatgcctaatctcacgcaagaaatgagaagtataattgctatattattttctgttgctaattgtcgcctaaattatagttcaactgacataactgatgtcctctgcattttggatcagacccctagtttcaagtctgtcatacaaatgatggtcttggagatgagttattcttccctcacaatgtaatggagcaaactacataagaacatccacaagatcatgtcaaaaggacaaatctgattctgaattcagaatcaaattaagaagtactccctccgtacatgtaaaggaagtcgtttaggacaatgcttaagtcaaaccttgggaatgtaaatcatgaataactttcgaattgctgagtttgaaaatgtaaaaattatatgaatagatttgtcttgaaaaatactttcatagaagtatacatatatcattttttaataaatatttttatagaaataagaagtcaaagttatgttttggagaccgtgtcgctgtccaaaacgacttcctttacgagtatggagggagtatgttctattgctacaaatttacaacatgtctttaactttggaaaacatgataaaattatttgtgtttgatttaactatttgctgatttgttcaaatgaaacataccaagggtgaaatgttaaaagactcgtgcctgcaaaaaaaaaaaggaaagaaatgcgtagctgtctctatatacactactgcaggattgattttcctggacggggccccttttgtttacatgcggttcgtaagtggaaccgcacaggaaaatggggggactgatgccaggccatcgcctacacaggaaaatcaatttttatgtgtgggtcacttaacaggcccgcacgcaaaaataaacctattaaatgacccgcacacgaaaatacatcgagctcgatatccttcgcgccccttccgccacaacctccctttcaccttactctctccctctctcccactccactcctctcctccaactcctctcctctcctctctcggccgaccaacggcgacagcaggtggcggcgggtgatacagtggcggcgctcggcccctccctccctctccctcggctgcgggcgagaagaagggcagcgacagcggcggcccctcccctccctccccttgaaaatccggcggaggggaggcggggaaccggcagatccggcagagcggtgagagncggcgtgtggcggcggaagggaggcgacccacacccctcggcggcaggaggcggccgcacccatcaaccgcgggaggcggtgggacagaggtggatttgaaggtgcagcggcgtcagtggctggcatggaggtgcggcggcttcagccgcgacaagccggcgtcgggtgagttgattcccctcccctccttctcctgggctcccctccccttcccttgcagatccagcggaggggtggggcgtcttcggccggcgactacggatccggcgccggcgacgggagcgggcggcgattcgtagccggcgaccgcgggggcgacggcggcgggccttggctagggcagcggcggcgacgacggattagggttagggttttgtttctatttttttactttttattttctcatgtgggcggcttaagcgcccgcacgcaaaaatccaattttcgtgtgtgggtgaggcacccgcacgcgaaaatcgtgattttcccagaccccttggcacgtgcgggccgcccacccgcacgcaaaaatcatattagccgcatgcaaaaatcggttgtgtagtagtgatatatgggcatatctcttctcaaatgttttccccttctgttggtcctttggcaaatcacaagattcaaaagaaattttgtcgaaaagcaaatagagttctgaagggccaatgtgcagaagtccatcatggaagccgtccattccatttgtacaaccggtcattaaattggaggatatgtagagatattatatcataattgattttactattgtggaacattcaaattaaagaaatttagacagggtggtttttcgaaagccatgtgcttgcacatcaatagatactcgacaatataactatatatataagtcgttgttttaagaaatgttgataaattggtgtaacattaatgcgtggttcatctctctatatatacctaagtggatatcccagcgacaaaagataaagcatctcaataaccatatgcatgttgtagtagcaaattgttctataaatgaaacttttcgcatatcactacaaactaactacaaatttacaatggtgatacgaagagttcaatatgattcatgataggttgcctataagcaaacagttctgtatgggacctattaggaagagtaggcaccgggaaattccaactgaatcggctaaggaaacatggtcgagttcgtttctctgctgcaatgaaacaaacaaaatcattctcatcccagcgcctccaccctcgcgctaaaaagaaccatagagaaaatggtcactgcactccgcaaaaaaaaaaaatccctaagattcttaggctaagaaaagcagaaaaaatggaggaaaatggttcctgcatgaaccgtgtaaaaaaatcgctaagaaaatcagaaagttccgaaaattgattggatagaaaaaaaattaaattcgctataaggggaaaaaaagggagaaaaaacaagaaatttactaaggaaatcggaaaagagaaaacctggttggataaaaatagttcctacttatactaatccacatattatagttctagcctatttttgatggtacgggtccattgtgaagggtacattactataaaaaaaatggttggataaaaaggttctgttttgtgtcatatccacatcccagacataaactatttctaatggtataaatccattgcaatgcacaggcatataactcctactctagtaggatgggaagggagaagatttgtcttgttttacgcacatatgatttacaaactaataaataactgatcagtgtgtgttttaaaaaaaactatatgaaagtttcttaaaaatcatattaatatattttttctaagttttaaataattaatacttatttaatcatgtgctaattactcatcttgttttacatatgttctcctttccctctctcaactctcccttaggctcatgttcgctacttgttgctgctcatatgcatatgtttttgagcatgtaaagcactactaccttcgtcctagaatatatatagtagatacttcctctgtttatgattagtatttttattattattagataataaaacataaatagaattttatgtgtgactattttttttaaaaaaaattataaattgttcaaataagacgaacagtcaaacgttagacatggaattccacggctgcacttattttgggacggaggtagtagaaagttttagcgtcggacatggttattaagaaagtagatagattaaatagtgagagattatgattagttgagaagtagagacagatgagaaaaatgaatggtggagggttgcgattggttgtgaagagaatgtttgtgaagaaattattatattttatgacaaatcctgtgtgctaaaagttgttatattttgggagttgggacggagggagtagtagttgctccctccatctcgtaataagttcatttttacctcctcccatttgttccaaaataaattcattgcatcggaatttgtgaaagtagagtgtgattgtattgggagtagttaaaagtgagaatttgataaattagctaggggtattctggttattttagttttgtatagtatgtatggcatgtatgaaaaatgaacatatttcaggatggaggaagtagataataagataacaagtgtataagttcattttgatgatctaactttgttagaattgtttatctgttcattggttaaaggtacaaatgagtttgcagtagctccaaataattgttatctatcgttgtaactcccttttacaaaaagcaggggaaaattttggaaagtatttatgaaactttgttatgacagatccattcttagagcttgtttgagaagcttttggcagctacaacttcttccaaaatcagaagctccccaaacagtagggtgaagctatagttcaagagaggttgctcagaaacctggtcaagaaaagtttttagctataattcatatattttcactatatatgcaacccttcagtgtaaacttactccctccatccgaaaaaatcgaatctatgactgaatgtgacatattctagtacaatgaatctggacagaggtatgtccatattcgtagtactagaatatgtcgcatcttgtactagcttgattttttatgggacggagtgagtaggcacccgtattagtttaaactccatccaaagcagagtaaagtaagcgagtggctctctcctccattttgttctagttctgcccatgcaaacagtctagcttttcaaccatattataagaagctgtagttgcggaataaagaaaatgaactaaaagacagaagctgtgaacctagcttttttagattcttatgaattggctatcaaccggctgcttataaaaatcttaagctcttccaaacatgcacttataccataaagccttaatttcatcggttcagcattcatgaacagtatgtgcactacgtggaggtacagtgagtttgttttttttcgttttccgcgcgtacgcttcctaactactaaacggtattatgttttttgaaaaaaaaatctatataaaatttgctttaaaaatcatattaatccattttaaaaagtttaaaatagttaatactcaattaatcatgcactaatgattcacctcgttttccatatcttctcaatcttctcttccctctcctcaaacttggcctaagggtgtattcaataggaggggaaagaagaagattgagaagatgcgcaaaacaaagttagccattagcgcataattaattaatattaattatttaaaacttaaaaataaattaatatgatttttaagtaattttatgtagattttaaaaaaaatgcaccattgaagtttgagaagtgtgcgcatagaaaacgaactgacttttctatctcttatgcttcaaacgagcacaccctaatttatttttctctaatacaagatcatcgccttcatttcacagagtgactcatgttattaagtgaaaattctcaacgtgcacaaacaatttcctcaatctcttcaatttcacgaattttaccttaatctttaaatgctcctctgttagttgagtattagttttctttaaaggtgattgtattgcggtattgccctctctcacgcttgtggtagctcagtgatagaaaaaacaattgataacttgagaatatcttcagttgttaaaaagaaaaacaacagcgatagaattatttaaccaaatattttaaaatgaaatttgaaatttttaaataaatttgtaattaacttcaatgaaatttgtatttcaccaaaatttaaacccaaataagaaataactttggtcacacaggtgctatttgatcacgtcatgtgaaaaggtgagtcccctatcgcctcggtagcacaaaaatactaacttaatgtgtgaggtgtctcctgataaataatcgtatttttaaattgtattccccaaaagtgacttcgtgtgagtcctacaactaaaatcatggaagtcacttagtgaagatactggaggatgattgagaagattaatttcacattttccttaatcttatcgtggatggaattaatcaaacaaagaccttatgagggagtgcctccatctttgacgccgttaacatttttaaatatgtttgaccgttcgtcttattcaaaaacttttgtgaaatatgtaaaactatatgtatatataaaagtaatttaacaatgaatcaaatgataggaaaagatttaatatttacttaattttttacaaataaaacaaaatatgtttaaaaagtcaacggcatacaacatttaggacgattgtagctaaaataaactttaccaaatttcggcaatgccaaaattttagcaagatgatataattataaaaattttggcatgattttta

SEQ ID NO: 14621 - DNA, 8001 bp, Oryza sativa
ggacacgagtccgtccacattagtaatacgcgtcacacacacgaggaaattattcattacgcgtatatatacgcgcgtaccacacgaaggcgtagtaaccaacaacacacgtgtgttccagaggcttcacccgcagcgaatccccccacctgaagaaaaacgagacgagattctctcgctctcttccggcgagattttcgtctttcccccctctcctctccgctcctcgtctcgtctctccgcttcccctcctctctcgattccccaccatggccggagccgccgcgacgccgccggcgatgatgcgcgccgtgcagtacgacgccagcggcgggggagccgccgggctcaaggtgagcaacgccctccgccacactgctctctctctctatgcgcttccttttctttttctgctctgctgctagtggtagtaccgtagtagtagtaattaatttcgttgaggcggagtgttcgaggcggtacactctggtcgggcgatgagttcatgccctacaacttatatccaatgctaaaatttgaatctcaaagcttaatttcggagttgattttcaggtttttatttatttatcgtggtttctttttcaacgttagtatttaagttattatgaaagttttgctaatacgccgtttgacgtattatcagcgattggccaaacgatgatagcctcagcagtatggccagatgattgatattatttgttttgctactcttttcttaattcgtttgtgctctgtgtaacacggtcacaccccattgattaaaagtccatatcggttcatctggttatgtgcttatgtgctcagatagagatttgttttttttatgattgttatgctcatgggtttaaccgtttaagagcctacaggattacagagagtcggcctatgatatcctgcttgacgattagtactagatgtctgatgattctcctgttctaaattccatgtcactttcaaatcgaaccaagtttttctttgtcccaagacctgcaccaaattatatagtaataatctagtctattaaactagagtgcaggagtcaacttggcagcaacaccctccatcacaaaataagttaactttttttacatgaatatagatgaaactaagtaaatttattttggaactaatggtgcagaccattgttgtgtgtgtcattgactgagtgacccaactctttccaaaaacaagcctaatttaaggctgaactgtagagatcagaccctgcatgagcgcactcacccaacactttgcttcttattctgtgtttctacatttctttaaagagatttgtgaacaaattatgtgatgatactcctccttgtgcagcatgttgaagtcccggtcccttcggcaaagaagaacgaggtgctgttgaagctggaggcagcgaccatcaatccagttgactggaagattcagaaagggatgctgcgtcctctgctgcctcgtagactgccttttatcccaggtaaattacatattcttgctgcggaatcataaacacttatctttctatatcttcttcatatgtaccttttgccgccgcaaggctggctaatcgtacgcaacagggagatatggtggaatttttccatcttttcttctgaggagtacaatcaaatttaagtcggctgggttgggaattagaaatctgtgaggggatggagagaccacatatcttttcatatacagaattcaggatggagacacgggcgcaggaccaactattaccacaaactgaaacatctagcattaccactgaactgacatttcactaaatttgtcttgtatatttattggtggcgatactgatgctctatgtagattctagaacacaccaagtattttctgttatcaaagattcacagaaataaacttagttttagtattaattctcagatgacagagtaaattatgatttttcttgcatgttttgttcatatgtgtgatacaactgaattaagctttttttttagaaaatggattaaaatccggcctctatatccacaatggatgtacacagcccacaactgaattaagcatatctgacagagtaaaacattttagacatgatgagagagtaaaacattttaggcatgtctttcttccggcacctatgccagtaaaacatatgctaatagctgcatctctgtgatctattttgcagtgaccgatgttgcaggagtggttgctggtgttggtcccggagtgaatgatttcgcagtaggtgatcaagttgtcgctatgttgaacagtatggtaagttctttccactcctgtgtcatgttttttggtttgccatttcaacttaacaatatcatgccctgcaaaaaaaaaaaaacacttaactatatcatgaaaataaacacatcattgtcagtccaatcctatcttggagtacatctcaattttaaggttaaccaatatctgaatatccctcctgttgcaacagaacggaggtggattggcagagtacgccgtggcggcagcgaacctgaccgtcaagaggacacccaacgtctcagcggccgagggcgccgggctgcccatcgcggcgggcacggcgctgcaggcgctgaggtccatcggcgccaagttcgacggcaccggcgagccgctgaacgtgctggtcaccgccgcctcgggcggcgtgggcctctacgccgtgcagctggccaagctggcgaacctccacgtgacggccacctgcggcgcccgcaacgcggagctcgtgaggggcctgggcgccgacgaggtgctggactaccggacgcccgagggcgccgccatgcgcagcccctcggggaggaggtacgacggcgtcgtgcactgcaccgtcggcgtcgggtggccggcgttcgagccgctgatggcgccccgcgggaaggtgatcgacatcacgcccaacttctcagccatgctcacctcggcgctgcacgcggtgacgctgcggcggaagcggctggtgccgctgctgctgtcgccgaacaaggccgacctggagttcttggtcgggctggtgggggaagggaagctcaggacggtggtggactcgaggttcccgctgggcgacgcggcgaaggcgtggcagaagagcatcgacggccacgccaccggcaagatagtcgttgagatggaagggtgatagtatcatgttggcatgttcggttgttcttgtttgttcgtgggtggaaacttacattggttggaacataacaatacagaatagggaatactagtcagtttggcatctgtttagtttgatgatatgacttggtgatgatatatactcgagatttgtttctctcttctgcgttttgaagaatttaggagctgtaaatctgagggcattatatatcgagattacttctgcttctgttgatccttttgcatgttacttttcactgttaccaactagcagctgctcttatgcacaggccctagcgaacactaaccaccattgcactgacaaatcacaaacaaaaaagaactcccatgcaaattttggaatctataactcatcacctctcattcgtaatagaatcgatcctgctagaaaagagggacaaaaagagggggaaaaacaaacatcaggtactccaaaaagggccaagcttaccaggactacatctgaaattctgaatagacgtatatgctacaattagtaaaccaatatcaccactgctctcccttgccacaaaacaagggaagcttcaatttatgacccgatttttgctgataatctctcacataaacccaactcaacacataccctcttcccgaatgttgataattccaacccacgaaaatatcaaactttttcaccgacgcatagcaaccgaggcatagcaactaactcgctcactttgcaacggcactagtgcccgatggcgcccgagcagcacgaccagcagagtggtcaacccgctggtagccaacatcaccaccacgtgatgaaccacctctaccagcgcctctgcctccatagtcggatcgataattgaactcaccccttccatagcccctccctccggtgtaattcccgcggcctctcatgccttcacctcggaagttaccacctctaccaggagcaaaccttcctctgccaccacctgaaaccagaaataggacatgttgacttaacagaaaaggaagacaaaaaaacaaaatagggaggcagatagacaagtatatttttgccatagcacgtgataaaatttgatacgatgaaatgcaacatacaaatggttccacagaaaaacttcgatgttcagcaatttggttttgctcttgaatcagaaatttacgagcatacaaccaggagaagcaatgtgtatcgactctgataggcagaagacattatttgtaataataaatgcgagcacaaacaaacagaacacatctctgatcaaacgaatgcaatttgaatgaaaggtgagcaacgtcaaatattcaattgtcacaagtgccaattcaacagcagatagaaacgtatccggaatttcttccataaaatccaaatggaatcatgtgctacttatattcaagatatacattgtaatgctttctgaacttaccacgtgaaccagcagttctcttttcctccacataacattgccggtcactaatcgtcacaggagaaccctgcagagtaaagagtttgtcagataaaaaaacagttgactgcacttatcatgatctccttttggtattcgcatcagcacttgtagtcttgttaaagctgattcatcattagataagaaaatgtatcaaggtagtgttttttctaacatcagtaatagtacatatgacttatgcttgtgaagaagttaagttccaacactaaaaaaaacacttccgagcaaagaatgacagaaagcagttgcaattgcattcttaactagcgcgagtgtagttttgctccttggtggagatttgtgtattctctcccttgtacataaatctccatttacattgtcagttaacacatggtcaaattatcagcatcactaaaatgtattgtcaaatcaaagaatcagaactatatatatatttctctcgcacattgatagtcttaactttctaaatggaacagtcaagaaaatacaacattcctttccaacagtgctggcatgcctgtgttaaggtattgagaatacgataatcattcctcccagctccacatttgctggttaaattatggcaactgttacacacaaaggatcataaaagctttaaacactaaaccaaatccatgaatgcctccgtgctttaaaaatatatggggccggagggtagggggaataaaagctatccacgttccagaaccactgggatcataaactcaaggcagcacaagtctaaggcctacgagcaaataacaacggacagctatcattccaatggcattgattccaccaactgagcagacagcagcgggctaaaggttgcttagcagcatcaggctaccaccaaaaaaaggaaaggaaaaaggttgatggctaggacaacaagcactgtacactttatgagaaaatatcagatatatagggagggttgactctagtgattcaggaaaacaagggttaatttagcttagcatggaaagtatttcttttatatattccgttatacctctaaaaccaggaaaatttgacgaggcatagtcaaattgtaatttggaaaaagaaaaactaaccatagtgttgtgtggtaagttagaatgtaaattataaatactagtagttcaaaacctaattaactagaaataacaatatcattgcatatacttctcttagttctgcctgctaaaagatgagcaaataacagtcatacaagaaaaagattaaaagaatgatatatcatgtttatatatgccctcacaaacatctaacccctcccaaaaaaaaaaacttagaacccctgccaaacaaacttactgcaactctttagtcacatatgtaatgcaattaacaccaaaatacacattctgcaacaagtcactcataactaaatgaaataaatgatgatgagcattcttcaatatcacagaacaatgagattagtaagatggaattaccgcaattgcactttgaactgaactgggatcttcaaactctacaaacccatagcagaacccttgaatctgtgttttcaaatggaaatacaaagacaaatagttggcattaggactcacttagagctctatcattatgtaagactataaaaaaaaagtaccttgtgacttctaacttggattccgtccggcttgatagcgccaaatttcttgaatgcttcttctaattgttcaggcgtggcacttaaaggcagattccgtacatatatcgcatgtgcatcaactttgaaaatgattgtaaaacatttcagtcagacaccaatggtacaaaaaagattttaactgcgagtttgaatctagaaaataccttcagcctcttgaatgttgctgctttcaggattaggactgaaagttggagcatcagcaaccggagcaacaggtgcaggagcaacttgcttctcttgttttggtggtgccggcctggaaggaattgcagatatttgtggtggaatttctttcatgactttgacctagatcacacaaaaaatgcaagtgacaatcttacaaggtagtactcaaatgtaaaaatgttaacatgcaacgtaactacatgttacccaattagatcatagccaccaactagcttcaaaaattcttccacctaagttgctacttgtattgaaactagataatcatgacatcaagaattaacatttcaatttcatagaacaattcccattacccaattaccaaaatgatattcccatgcatatgtattgcgaagtgcattattaacatttgcagctaaattgcatttctattgtgcattgcattattaacatttgcagctgaattgcatatttattgtgcagtgcattattaacatttgcagctgaatttatgtgccagtgccatttaaaattcagaactggaagcttcatttgaagctttacacatcagaaattaaaaggcatcatgcacctagaaaaatcctagcaattacttatgcatgtttgctcgaggttggaacacatgcagaactccatgaaggaatgaaaaatgcatatctcctcccaattcccatgatcacattcagaagcattaaaaaatgcaaagttctaatatcaaccaggacaggtgactttcagctcggtggatgaaagacaaacagcgttcaaaaacttacaattgaagcatacgacttcttgggggcctcctcttgtggtacaggggcaggggcaggggcaggcggagtcggcatagccacagctacgttatttggcacttcatctataacttcaggaatcggcgtttcctccacaacaggcccctctgtgttgttcggtgggttataaacctcctcgccgttgagatcagcctcctgagcattgggtgcaggatcagccacatgctgctccggctgcgagaaggcctctacaaaagggcaaacacaatcagtttgaccataagctcgcagcaaagaaacagccctgaaaatgctcctccacaccacaccacacaccctgttcccgcggcacgctagtgccattcgccgaaggagcaggcaccgaatccggctgctgcgacggcggaaacgacagctccagctccggctccggctccacctcctgatccccctcccccccgacgtagcgcaggatgtcgttgagcacgaagtatcccttctcctgcggcgcgaggaagaaggactgcgagaactccctgcgcacgtcgtcgctcccggtgaggtggcccgtgacgagcaccgtgacgcccccgcccagcgactcctgggcgtccaccgccttgatctccgcccgcacgatgtccatggacacgatcttcgcgttaatcgcctacaacaacaacaacaacaaacagttcaaatccccctcccccga

SEQ ID NO: 14622 - DNA, 5162 bp, Oryza sativa
  unsure (1)..(5162): unsure at all n locations
ggggggtcagaattcagatctcccgcggcggcacgggtgtcacgtgcgtagcgtgtgtgtggtttcagtggttgggatggagggatggatctcggcatcgccatctcgcgcggttcgaatgattgatggattgtggtgggatttttggccgagaacggcaggaaaggggctgtgtgctgctactgtacgaggggtaagtcactagggttggcttcagtgagtgagtctctatgggagggacttatatttttgagaccccctgagtggtaagaatcggttagagcaggtgtactaaaggttgtcagaatctcgatccgtattatgtattatatactccctccatcctaaaaaagacctaagtttccgtgtccaacgtttgaccgtccgtcttatttgaaaaaattatgaaaaaaaataaaaagacaagtcacgcataaagtgttaatcatgttttatcatctaacaacaatgaaaatactaattataaaaaaatttcatataagacggacattcaaacgttgcacacggaaacctagagtttgtctttttttttgggatggagggagtagtattttacaatattacgattttaccaaaccaaaatgataccgatcccacgtagtatcctaattttcatagtatcttgattctactatttattactatattgtcgacatttgatatcgcgactacggtatttagatggtatggggatcgtcggtaccagggtatatgcgagattgaggtaaagagatggagacagggatttttatacaggtttgtgccccttatcttacaggtaatagccctacatcctgttggccgaagccggtgttgctctttattcatctggatcacataaatacaatgtctaggataatctatctgtccgtcgacgacctgacggctaaataatcaacttgtagtcgacgacatggtagtcttcctcctcgaatgcgtactcggcgagatcaaagatggtgctagatccctcttgccggcccctgtaggtgctggatggggtatggctaggctaatttctgatgtcgatatacgacgatgtattggcttgtggctttgtagattgtggtgggtttgtccttttctcctcctaggggggcttgtatttatatccatagattcccccttgtccaagtaagactagggagataaatatggatacgatccaagtagtccttgtcgtttccatatagaactcttctcgtccttccttacccggaactccttctatatacgaggtatgattccgtataagacatggtatgtggtggaccttaccgagtttagtcgattactattgggtatatagaatccataaccttgacatatatgatcctacgaaatcttaagtagtacttcgattctacgatccatacaatcctacaaaatattatttaaaataagatgatttaaaaataatgtaaataaatatgctcaagtttatataaaaatcagttaaatatataaaaccaatgtggttttctcttgataagtgtctctatttgtatgacatatattattactatattttttatagaatggctatatgtaattaatataaatattaaattaaacttttaaaaaaaatctcatagtatctgatcctacgataaaatactactttgagcaaaactatactacctaggatcctgataatgacaaccttgggtataatagaatattgtaagtcggcgatacaagcatctgtatcagacaaacagatcgtagagagagaaaaccggagagagaaggcagccggtgctaatgcaagcgccgagctctagtacattaaacgatgcaagtcatggagatctatacaaaccagctctcagtcctagcttttgcccaataacttgaccatggcctatcaaaaaacgtacaagattgggtcgagggaaacaagtctgatcaaaagaataaaaatcagttccttagagaagcatgggcatgtagcttagcaactagttatagtccgtaacatctgttggtaccatctattgctgatgtgtacaaatttgtatcttttcccagaacgcaattggtttttaaagatacttcaggatctaggtcttttactagttagtcccggtaaagctcccaaacggcgtattttttcgaaacgaggtcctcagtaacgagacataaagactccaatggcgatactattaaacttcctcttagagtcgttagattggctatgcattgtactatggttgattccacggagaggaatcaagtttccacggatggaagtgaaaatcaccactagaggaactgtagcggcggctagggctggcgtcggggagggagaagaagtgaggagagagactagggtttctaactccccctgagtaaaaatattccccgacacccggaggttccggacagggaggcccggaacttccggcctgacaaacagtgggcagacaggcccaaattcaaagaggagggaaagggataaaaaagaggaatggaaatctatggacatgaagggacttatgatgcatatgaccaaccaacaatcaccaatacataccaatggtcaatatacatcccaagagggagataaaaaccaaattttcgcaagaaaaacacacacaagaatttttgcaaaaatttcacaaaagggattttggataaaaggggaatgtttgagctttattcctggtatcaagaccatcttctacacaagaagtgatctcaagacacaaaagctcaattttttttaatttacattttagtgacatatgtttgactataaattagccaaccacccatcacctaatattgcgagaatctaagatattgaactcactcctaagctcgcaaaatcttttctcatctaaaggcttggtgaaaatgtcggctaattggctctcggttctcacatgtgtaaggcatatatctcctttggtctcatgatctctcaaaaagtggtggcgaatatctatgtgtttggttcgagagtgttgaacgggattattggctattttgatggcactctcattgtcacataggagtgggatcttggtgaagttgtagccaaagacttttagagtttgtttcatccaaaggagttgggcacaacaagaaccggcggcgacatattcggcttcggcggtggataatgcaatggaattttgcttcttgaaggaccaagaaacaagggaccgcccaagaaattggcaagtcccggttgtgctttttctatcaaccttacacccggcgtaatccgaatcggaatagcccaaaagcttaaagtcacaacccttaggataccacaagccaagattaggagtatgaactaaatatcttagaattctcttgacggcaatcaaatggcactctttaggctccgcttgaaagcgagcacacatgcaaacactaagcatgatatcgggacgagatgcacataagtaaagagagatcctatcatggagcgatataccttttggtccacacatttaccattatcgtcgaggtctaggtggccattagtaggcataggagtcttgatgggtttggcatcttccatcccaaacttcttgagaatgtccttcacgtacttggtttgagagatgaaagtgccctcttgtgcttgcttcacttgtagcccgaggaagaaggtcaactcgcccatcatagacatctcgaatcttttgaggaggatgatagggggcagagaactcgtgcttgattcccacttcatcaaggaattcctccacttgagtgttcttgaattctcctccattgtcgcttcgcaccctcttgatggtaagatcatagaggttttgggcttgcttggcaaagcgcttgaagacatcttgagcctcactcttgtcatggagaacatacacccaagtgaagcgtgaaaaatcatcaacaatgacaaaaccatacttgttatctccaatacttatgtaagccacgggcctgaataaatccatatgtagaagctcaaaagggcatgttgtagtcatgatgttcttgatagaatgtggattcccaacttgtttcccggcttggcaagcactgcacacacgatctttctcaaatgtgacattagtgagcccgaggatgtgttccccctttagaagagttgccaaattccgcattccaacatgggctagtctacgatgccatagccaacccatggaggatttagcaatcaaacaagcttccggattcactctatccacatcgaaatcgacaagatagagatcaccctttaacttgcctttgaatgctacggaggagtcatcccttctaaagacggtcacatcctcatcggtaaacaagcaattgtaacccaacttacataattgagaaatggataataaattgtagcttaatgaattgacaagaagaacattagagagagattgattattggagatggcaattttacctagaccaattaccttccctttaccatcatctccaaacacaatattctcacgagttccattctccttatcaagacttgtaaacatactcctctctccagtcatatgattggtgcaaccattgtccacaacccaacatgaaccaccggaggagtatgcctacaaaagaaatcaagcttgggatttaggaacccaaacttgtctaagtttgggtcccttgatgttagttaccaaagcctttggcaaccacacacaagtgcggtactcatcattgtaattcccattaaaataagcaaccactttgccctctgaatttttggaaattacatatgaatcatagtaaagaccatctggcgggaacctcctggcattatgcccggaacttccggtcatgtcttgtgcacggccattggcccggaacctcctggcaaaccggccggaacttcctggtgggaatttttgagagacagagactcccaccagaaggtttggnccggtttgtctgnatgttccgggtcccgggctgctcacaagattagtcacctcactggcttgtggtgcttttccttctctcacaaacatcaaggcattctttcacatttaccatcacaggcttagacacagaacttccacccgaaaacccaagcccgtgtccatccttgttaggatgagcggtaatggtcttgtaaagggcatcttttgaatggtatgtcttcatgcatccatatttcacta

SEQ ID NO: 14623 - DNA, 13911 bp, Oryza sativa
gggcttgggcttgacttcgggatatttttcatctccggagtaccacacttccgccatgtgtgcctccgccacatgagcacgttcggcttcttcttgcctcccttagccttagcttcatttgacctgggacaatcggcaatgaaatggccatattcgccacaattgaagcacgctctctttgattgcctctttcccttgtcatcatccttcctccctttgccatagccactcttgcgaagaaagtgtttgaatctcttgacaataaaagccatttcttcatcttcactttcttcacaacttgactcttcttcttggtttgccttcaaagcaacttcttgatttttgatcatgggcgcattcttcaccatttgcctcacttcacgagcttcctcttcttgcatctcatgagacacaattcttccaagaatgtcatttggggtgagtctcttgaagtctttcctttcccgtatcattgatacaagagtgggatttcttggaccaaatgcacggagaagtctcttgactacaaagtgatttgtcatgtcctcactcccaagtcctttaatcttgttgacaagaatcatcatcctatcatacatctcttgtggtgtctccttgtcatccatcacaaatcttccaagccttccttccaataattcaatcttggcctcacgaacggcgggtgatccctcatgagccaattgcaaagtatcccatatctccttggcttcctcaagtccatcaaccttgttgaactcctccggactcaaggcagagagaattgcattggaagcttgagcattgcggtggatgagttgttcttgctccgacgtgagctccatgtcatcatgggggtatatcaatacatgtacaaacaactttccaaatacttagatgcaaagagattagatgcaacttcatcttgtgcttccaagtggcataatatgtcccatcaaattgaggagcacgcccggaaggcacggagacaaggttgtgagagggaatagtaagtttgttgtaatcaaaaggtatagtagctcccttgggtggtggaattcccttgctgcttgcttcatcttcattcccattttccccgttctttcctcctaagtccgacatcgtggatcactcaaagcggtgaagcttaaatcaagagcaacctgctatgataccaattgaacatgcagagatgtagtctagagggggggtgaacaggctttcctgaaattttctcaacaatcgcagcggttaaattaacagggcccggaacctcctggtgaagaacaccggaacttcctggcagtgataagaagcctggaacttctggagttcttgagccaggaacttctgggcaacatagaaaatcgaaataagggaagtaaaacaggtcctagctagagacgatcacgcacagagttgcacaagatgtaaatcacaagataccagcagattcaaacacagatcatgcacaagagagataaaggcgattttttcccgaagttcggatcacacggatcctactctccgttgaggtgctcaaagagccgggtctcgattaaccccttgcctcacttatgcaaagatcccagaagaagtccacagccttcaactcaacacttctaggtcgttttttagaattgagtgaccaccaagatccaactcacaagtccttctagaaaagaccacaagtgcaagttgctctacctaggacaacctctgaaaactcagcacaagaatctttactcacttacctcgtttccttgcggaggtgaggaaaaccttcacaaactttcccggacatccacaagatctttggaagctcacgggcgacacctaaccgtctaggagaagatctccaagagtaataagcccaagtgacagcccacaaggtatccaaagtgctcaagcaaacctaatcttcaagccatctccaaaacactcctacactctcatctaatctctcaatctcacaagataggctctagatttgaatggaggaagcaaagaaagcttgggagtggatagaaaaccctagaacagaaagagctaaagtggaaatggccaaagggtgacctggggacgaaatccatatatataacggctaggtgacgtcatctagccgttactcacaagtttgaactggaaacctgccaggaggttctgggcaaaagtgccaggaacttccgggcaacacttagagaaattctcccaacactttggtgcccggaagttccggccagaacctccgggtaaccctctctatcccggggagaaaaataaactttggtgtccggaggttctggccagaacctccgggtaggcctctctgtcccggggaaaaataaactttggtgcccggaggttccagccagaacctccgggtaggcctctctgtcccggggaaaaacatttccaaaaaaagaatccaaaaaaaactttagactcatggatatgactaagagcactttgtataccctagaaccacacttgaaacccctcttaatagtacggtttttcctaaactcaattttgaaagtgtaaaacctagtctaatcaccttcgatccttttcatacttaggatcattcaaattggggggtctccttgcattcttagccatcacaacatgctttgggactaaactcctgtgtataaacttgataaacacgttagtcccctttaaccaccttgtcattaatcaccaaaacccactagggggtttaagtgcatcttcaggagtgtgtatttacctagatggagggtggtttgtataaggggatatgacacggtgattgactgattgtttaggtatctatatgtgcactagaggttgtaccgctcgtgcaaaataagttccatagctaggcttgagagaaacgcaaaaaacacgaggacaaattggtataggtgagggatgagggacaagcaggtgcaggggcagcgtaacatcgggttgatgcttcccatcatcttcttgtttcatttgttcactcaagcacccacaaatcatcatcatcgttagccgcctttatcgttttcccctcctctagctgcttcaatccacggccaccgctcaccactatcatatttggcagccatgagatcgaagccggcaaattcacccaccacgtgtctataagttttagagtgtcgttatcgtcatcattgttgtcatcttcctctccatctctattcctctacgtcgtcggcatgctcttccttgcttccaagcttttttccccaacctctaatgtgttggatcctgtggccacaagctccaactatggttagcaagtggtagggtaggaaaagcacaaacagtgagtggagtggtgtacaggtgagtagtgaccgttacatcatacgggacaagaccggctcttttttccctttacccttttccttttccgattgattaagtcgaatgaagtaataatggtgtaagttacatttgcacagtggtaactgtgtacttcttttgtggactgatcgatcgagcaccatagcccccggcatgcacaacgggagccatggctacatccttctcgcccatggtggctacatcgacaaccgtcacaatcgggctaccgctacatccaaaatgagttccggtctccccatcgagtttggcccatcgagagctcttgggtcttctctgtccaacctcaaatcgaagagatagagattgaagggaggaagaagtggttgttaagtgtgccccaccattttttacttgtaccatgtcacttacatgtggcattcagctctattttcagctactttgatgactgagctaccacgccatcacacttggaccaaatcaacctgccacatcaactgaaaccgcttccaaatcatcgaaggagtcaatttacaccggtttttgaagttagggtggtgttatacccggtttttgcagttgatgaatgcaatttaatcaaggtaaaagaggagggacaccaaatagacttgttcattaggctaaccttcgacgtgcgtccaaactattttccaatctctcgtgagtcgtggcagggcacgatccaaaaccgaggaacgtgcacaccagcttgccagaaatattcatactagggtgacagggtcgcaggctcgtttgctgattttgtgagagaattcgtgtagtccatatgttttcaaataacttataattttgattttaccatataaatttaatcaagctcgcactttaataacatggcatcttttagcatttgtaaatcctctacgtaaaatatgagtattcaaaatttaaactgaataatacccgctgctagtaatttaaaaacggagagaataattttcctatcgcgacttatgagtgggtaattgtggtatgtgtgataactgagtgtatttgtctttcatacaatcgattttttttcaaaacaatatagattatacatataaaaagtgtatgcgtatatttggacttttaagaaattgcaatttttaccaggctttaaaagatggttctaaaaaaaaccactaaggctatattgtgatgttgttcactttcaaacatgatatttgaccattcattttactaaaagtttatataaatattatttacatttttgtgacttattttatcattaaataaactataacgttaacttatatttatttgtattaaatttttgaataagagaaataataaaaacattatgcgaaatatcaatgacgtcttatataaaaaacatgagaaaaattccatatgtactcctgaagttcgtccaatcccttttatacccttgatatttactcattcccttccatatccctaattttcagttggatattttataccccttccgtttgttgaccgttaaattcttattataaagtctatttcgctctttggtgtcaagataatataaatttatgaagtataccgatggattgtataaatttattgtatgcgactattatatttagtttattttgtgagatattatttaacaaaaataaattttatctcacataacaaaaataaaatatcataaataatatcttgcataacaaaattcataaataatatttatgataatttatttttagatatgacataaaaataaaatttatttattagttattaaaaagtacttatttagcacataaatagatttatgttataaaaaatgccgtactactataacaatatatatatatatatagtttttaatggtaaaaaaattattttttgttttgccttcacggaggtgaaaataaaatattatttttactaaataatatctcacaaaataaacttatatataatagtcgtatacaataaattttattttcttaataccaaagggcaaatatgatatgaatttaacggtcaattaatgaaaggggtatagaaatgatctaaactgaaattaagggtatggaaggaaataagcaaatctcaggggcataaaagaaattggataaactactttcaaggtacatatggaattttctaaaaaaaaacatagatagtactttgaatatatagattttctctcgatttctgttagcacgctttttaaaatactaaacgaagtgttctgtgcgaaaactttagttgatttaaaatattaaataaattaatttatcaagtttataataactaaaacttaattaattatgcgttaagattttccattttacgtgcatcaacttaattaattttagcttcaaataccagcagagcagaccatagactaccaataacttgggcatgtaaacttattttatttatttatttatttatgtgttttttagaaatattttatgttccctttggtcgctgccaatgtgccagccccatgccctgcccgtgtggccgtgtgttccgaaattccaatagtaacggaacccgatctctctctctccccctcacaaaaatccgagcccaacccccctaactccccacaccccccaccaccttccctccccactactccacgatccccaccgccatcttcaccgccaccgccaccaccaccaccgcctcctttctcaagccgcgccgccgccgtcgtcgccgtctcctccgcgctcccccgcccgcgatcgctcctccaccggcaggttcgtcacacacgctcgcgtttccccccccgggttgccgtaagtacgtacgtgaaccctccctgtccctgtccctgtcccgccattccgcctgatcgccacctcgtggaacgggatgaaccctagagcggccgtggtggggagtggggagggatgggtctttattctgtcagtcataataccgatttctcttcgtttcgtttcgggaggttttctttttcttgccgtttcaaccctagattaatcctgagactttagcgtttaccattaccagagacagattttattttgtgactttttttaatttttgttgatgatgatagggagagaatcatgtgctacactttctacgaaatcgatttagtgatccgtgcttgtgtagttcttgtctctgcattcctgctttgctgctcgccaattagccacagattcttttgttctttgtactactactagtactagttcttgatgagggagcaataattcggagcgtgaataccccatcgctagcgcaatcgcctcgtcggtatcgacctttttttttttttttgccctgcttggacagaccgtgcaaaagcctgcgcctttctttctccaaaaatgcttttttcccgtgttggccgtcttctttttatcgtctagtatctatattcgtagagtttggccgtgtccttttcgtgtgcctcacataatgtgtgtgtaatttgaggtgccaatgaaacgaaagtcgcccatgaaaatgaaactcactgttttaaaggaagtggatgagagacgaccgatcattttccgcgatccgttggaaccgacttctcatcaaatggtttggaacctcgattggagactttatttgttggtcgtacaactaaaagttgctgtagttgctgtatgtttttacctcttttttttttgttttcattatttggctggttcatcactctgttttgcctgtgcactcccccctttttttcccttttgttccaaccttaattggaagattccaatcgaatgatcaaactcgtttggatcgacaatctgctctataggttgtttattctatctttttttgttcttatcaaactagaagttctctgttctgtgaacagaatcttgtgagctctaagcctctaaattcatgcccacgattatttttactgagagaaacgattgaactagtttagtgggtccctattaggttatctttttgttcttgtaatggttatggatgagccttactgctacagtttgacatgcagacttgattctatcacctatagcatctgcaataggaatgttgaacacatgtgattattcacatcatattctcctctgtagggacgggcatatgaaaatccattaataggaataacccgacattgttgtgtttcttcgagacgcggaatctaaacagtttgaagtggtttactgaatggaaattctgttgttgtgtaggacagatattggattcttctgttttggaaagcaaatagactgtcagagatggtgatgtctatagacaatgtgaggggctttgcactggccacatcatcaagtgcatttattggttcaagctttgtgattaagaagattgggttgaagaaagctggggatgctggggtaagagcaggttgtgcctcctcttgtttctggttaaataattcattttctacattgcatagaaggttttttcttaaaagaatgctcaaatcccttgtcctgcagttatgtttcaagtagaatgtacataggttctttcattataatccattattgatccttatgatttgcaggttctggaggatactcatatttatatgaacctttatggtggatagggatgacagctagtaagtatggattacattgtgctcttttctgttgataatgcgtggcaaagaaggcattctcagtctaatccagtttccttttgttatatgatactccatatttatggaaataatttattggaactactgaggtagcttctacgtaagttcacactacagattttatctctctgttacagtgattcttggtgaggtggccaacttcgcagcatatgcatttgctcctgcaatacttgtcactcctctaggagcgctgagcatcatattcaggttttacacatatctttgcgtctaggaaataattttgattaatcagtagtatgttgtttccttaacactcttttattcattcagtgcagtgctagcacactttattttgaaggagaggttgcatatgtttggtattgttggttgcatattatgcgttgttggttcagttggtatagttctacatgctccaaaggagaaaaagatcgattcagttaacgaaatatggcatcttgcaactcaaccaggtagctcttatctcaaaggtcttcaacagttgttctagttgtcatttcagtagatatagctgtattgtttacctttggagaaagttttaattttgtatttgtgttttaatataataatccgttttattctcaattttgccatcagtgctgacctgctgatctgaaatgtaacttggcaaacaagagaagcagtattattttgcaatttttgaagagttctatctaagagtctatttgcatccttaagcatgttggcttctcaatttttttttggttgatacacataagaaaatgatgctcaaagaatcagtttcttgagaattttcacttgcatgactgtcattcattatgctgagatttttccatcattctaccagaattagtacttgtggttatattctataggttagggatactacttgccttcccaaaattcattttgatgcataagtgtaacattgtgcttgcaggtttcatagtctattcttgcatggcagtagttgttgcacttattttgattttctgggtcgttcatcggacggaacaaaggaaaatgctcgcatatattgcaatctgttctctgatgggatctcttacggtaggctcgctatgcatcataactgaactgtttgaatcaagttgatccattatgttctgataaagtaatatacttgaggcaggttatcagtgtaaaagcagtggctattgccttgaagctttcatttaatggagtgaaccaatttatctacgtcccaacctggttctttattgttgtggtggttatatgctgtttagtgcagttgaattacttgaacaaggtaaccggtcacatcttaaggaaacattcagcagttttttacttgatgggatcaccgcttttctcatagatattattgttgttactatctatttattttggttgtggctcaacatgggtttcatctctagcctactccaatgtaattgggtcttccattcagaaaaataaatgcttgagagttgaggctgttacatagcttacatgaatgatttatttcaacaacatacatcttgtcttgtcgtaaaatattatttacttcacactgaatcttttgcattgacatacttcactgtagagtcttagcacctagatttctttaattttacattttctaataatttaaatcttttttctggcattgtgagtcctgcatattgacatcaatattgtctttttccctttatcttttttatttgaacattttttttttgttattgtaggcccttgattcattcaacacagctgttgtctctccagtctattatgtgatgttcaccattcttactattattgccaacatgatcatgtacaaggtgatttccacatcgttcatacctttcgttagttcatgtgatatttctatattaaaccactttcctatttgatgaaacctagacttgaaaattcaatatgtgtttcttgagactttattctggggaagctatatatggcatcatcttaaaatttgctgtgtaaaactaaaattttagcatccgttgtaagctggtgtattcatgtctagtatggcattgttgggcaagaaatttttttcatgccagtatgcatgacaattcagtattcataaaaggggcctctgcgtcgagattcttgtcgctactgaacttgtactaatttttttaacttgactcgaaaaactaatatttgaattatgcatgatattccattgttcatcttccgccattcgatactaaacatttccgataggtgctaacccattgttaatgtgacttttttggagattgacaaacatatttgatggtccctaaattttcattccaggactgggcctctcagaatgcaacgcagatagcaaccgagctttgtgggtttgtgacaattgttgcaggaacttttcttctgcacaagaccagagatatgggaaacgaacaatctgaatcatcttcactgagaggagaatgtgaactccagaatcattagctagtcacatatgttgagcatctaacatatacaagtacattttaggatcacaactcaccatgtgccgtggagccacttaaatgatactgatttagctcgttggaaatttaggatatatatatagatgcagaatcatatgcttttcactgggttattttgatacattaatcagggacactttgtcagttcaaggagcactaaaagttctattcctttgtaaatacagttcatgagtgtaagtgcgcgctgtgaaatgccaaagcaatggctcatcatcaactcctatgtgttgttgcacgtatagcgtgcgaattttcaaaattaaggaagcaattattctgttacagatatttcgcttttgaggctactccctccgtccctaaaaaacgaatctagtactggatgtgatacattttagaacaatgaatctggacagtgatgacagtggttttttatgggacggagggagtttatacaaagcaattattttgtttctactgttttctaatgtgtggggcgtaaaaagtccggcaccgtcaccaccacatgttcatatttccttaactgctgtgtaagatcgttttctgatgtgcaagtttgtttgtttaattgtataaaccagccaccctaaaaagatctgcattaccaatggaatacttcattcagtaggtttgttgccaagaatttgacattgccaatatttttctgactaaccaataaagcagcaaaatcctaaacaaccatattaggcataatgcttttactttcaattagatggtgggcctttgcttatttcagcacaactttcatatagaaagttttttgcaaaacgtatataaaagttgactgcaataagtattaaccactagttatactagctaaaaagaacaattctttcatttcccccttttttttcttgaggatatgcaaataacatgtgcaatggaggtgccataatgtgcttaaaattaggtcataagaaaaatcattgacctggtttaacattatggggacatcttgaggaggaatgagccacctagtcttgcaaaccaagcataatcagttatgtttttttatatgcagcaggttacactgtaatgttatgttggatttaagacaacttaggatatataaccccactcttaagacatactaactccgtccacccttatattaggagccgattccaaattaggtgtctttttttttaagagtcagacactccctcactgtcactgctctacttccatccccgttgattggttagcggcctagctttctagcgcatgaaagaagcatatgtgcaagcatgcatcgtcatagccgacatccactaatctccatgctagctagtatgttaggaacttctttcctatcttaacctccccctctccaaacatttttttctaaattaactatctgatttataatccaattacaccgttatactcgtaattaaatctttaacaaagatctcacatgattatattttaataagaaaaaataaatgttctttttatcacttatagaaagatctttcatcacgtgtcaaatgttttagttcagtgtataaaatatttcaaacaagtgtaccattcaaaaaatactgactgtaaaaccaatgaccactatgtgaaatattgcgtcccagcaagtaaaatataaaagaaaaaaaatacaaacttaatattatcgaaacatttagttatgtatgaacattagactgcaactgatgaagcattgtaaaatatttgttcaaacatttcaaagagcacaatgtgcaacatttacaaattaccaagtgaaatatcttaaaaacactagttgaaatatttaaataaaaccatagcaacaattaaaataaatccattaaaaaaactatttttatcaaaatataaccatatgtgatattattgtaaatatttaattgcaataattttattagtgcaatcagattgtagattacaaaagtaatttgaaagaaaatatcatttgaaaattatattacgaaagatgtatgtatgtatggcatgggtgaggtgtcacttgtgcgtgcatgcatgaatggagtgaggggacaacaacatgctagctactcatctactctctggtagatgggaggagataagtgatagaatatggaaagttgaagcgcctgatttttttctcttatgtcgagctttcgatttttttcgcagggcagacgcccatgaaagaaaatattaacccatatattagcaaagatctccgatctttttattttttttttccttttgagtctctcatccaattcgtgtggtttatgcagtttttcctttgctttgtacatgtacccctaccaaaatcatactccctccgattccataataattgacgttttggataagtttacggtcaaacttttataactttgaccaccaatagctttaaaaatatttagtttaaagaaactagaacaacatttatagatttgtctttcaaagcactataataaaagtaaacatgtatttatttattgtatatattataatagaaaaataaggtcaaagatatattctgtagtctgtgccattgtctaaaacgtcaattgaaataaaaccggagggagtatgctttttctctattccgtttcatatcattcattagttttaaatgggctctggctgattataagccgcaatgcttattactgatagaaaaacaattttatgggtaaatcttttatacatgcgttcttggctattattatggaaaaacattaaaatcaacaccaaaattaaattgtaaaatttatttttttgttacgattaataagtttaagagtaaatgatgcgttggagtagttcccaaaggaaaattttccaaacaaactatgggatggatcaacttccgtagccctctcgtctctgccgtccaattaaagaggatttaactcagattggtttaattccctcacaacgattcatctcacaatgttgcaaatatatagccactcacccttccaaagtagaaaaataaaactccctccattttataatggactacgccgttaacttttaactatttatcttgttcaaaacatttatataaatatcatttattttatatgacttgttttatcaaataaaatataatcttaacttatactttacatatttatattaattttttataagataaatggtcaaatgttgtgcgagaagatcgtaaatttcaaaaagagtactccctccattacaaaatataagcatttttaagtatttttagaatagtgccaagtcaaatatttttaagtttgactattaatagcaaaaaaataaaaaaagatggatcatgtaaaaaatgatgttaatttattattaaacgaattatcataatatgcaactcattttatttaagaccttttacttttactttacagatattattgctcaaggtatcatttcgaagaa

SEQ ID NO: 14624 - DNA, 5505 bp, Oryza sativa
cgctcatctcgtccatcctgggcggcggcggcatcgacgtccgccgcttcttcgcgctcgtcccggaagacgcgccgcgccgcggcgtcgccaaggtgctcgacggcgtcggggcgctcgtgttcgacgacaggctgtacgcgctgctgcgccgccacgaggagggcggcggcgcggtcctcccgacggagctggcggcgccttaccgccggccgcttgcgccggcgctggcgccggtcggcgacggcggctgccggtcgctgttcatcacgttctccaaggggtcgccattaacgcgcgaagagatcgaagagtacttcactgagtacgtagctcaatctccatttctcaatgcacttggtaattaattacgtgcatgcgataaactttgaccgattagttgtaactcatgcatttattattgggaaaaccaactaatcaccttgagagaataataaaagataaaaaaaggtatttttgcccttgcttttcatcacctctttctatctggaaactttctcgcgttaacattttaattctgtttttgaatcttaatttcttatgtgtaccgtataacatatagaaactctgaatctccaaaccttttgccttgagatcattataatatatttttcgaaagttgagtttcgttgttttataatttaataacgaaaatttcaatttttcatttcaatttacaaatagttttatcttgaatcatgtaaatccaggttatagaaagtgcaacaaaaaaaaaggtatttttcattctgcagtgcgcgatatatatggtatttcacaacttatgagggattaaggtggcattcgcagaattctcttatatatggtcaatgttttttttatttgtttttgttttgaaagagtgtggccaatgttttaaaatatttgatcatcttttgtctatttgagaaccgggtttcaatctccatcagatacagattgagtgttgttttttggggacttcaaacttgagaggtgttattcaggggcggagctagaacgaaatgaaggatggtgccacttgcttaatttactttactttagatcgagtttaagctaatgcgggtgtctaagtttgtattgagggagtgcatacatggtgaaaatagatgaggtataactaaaatattttcttgaccgggttcctaggcacccccctagtatactcaagctccgcccctggtgttatttccataatcatggttttcaaactcttcccatttacctgtgcgtaggtgttgtcagtgtggtggaatttttttctttcctggctattatcttccaaggcaatagtcttgtgattttttcctactccatccaatgaatcatcgcgttgtctggtactaatcgttcgaaaaaaaaaacttttcccatttatgctggttttcagaaaaactttgtccaatccgtaagcagaatgtcaccaagtaccttcagaatttgcaggcatccataagtactaactaacctgcaaacatcatctgcaggaggtggggcgactgcttggagaaggtgatgatggagaggacgccggccggcgagccgccgacgtacgggaggatcgtgttccgccacgcggcgacggcggccgcggtgctcggcggggaacacctggtgaagctggtcatcaacggccggcagctgcgggcgcgcaagtacttccccaggaaagcttcagccttcagccatggcttgaattgatcaagcttaagctagcatatatatatctacttaggcacttacatttatacatatctatatatatactactaccacgtttatggccaccacggtgagatgagtcattccacagtttttgcttagggcatatatataatataagtatacagatgcagggccactaactcatgggccattatcttttgtgatctatccaccatggtcatgtcattgctaagaaaaatgtagatgcaagatgtttttcagacaagagcataaatcgtcttggatgccttgacagaaggcaggtgaattaagcaaatggacatgcaaattttattagatgagtttcattgataaaatgattttgtccaacccatatgaagaaatggtttagctgatggattttgagatggtttggctaaacaactgcaaaacgatggtactagtaaatataaggtcatgttgtatatatgttcttaatcttaatctggcaggatcaggatcagatatgccagagtgcacactatctcatactgcgaaaaagataactaattatcatagaaaaagggttcaaaatgttggtctccaatgctcatatttagccagacggcttcactcacaatatctcccaagtatgaagctcaacttcatgcaacatccatttaagctatattaattctcaggaatgtgtaatgacagaattgatcaatacagtatctcagctgtacaactgaaacaatataacaaatgctattttcagatactatcttttatcagtttgacattcagaaaaagatcagaacaactctttagcttgagttgagcacttgagctaccgtcacgtacagattaacagaaaatgtgctctgtcaagaatcaggtatgatttccagccacagttacactcctctctgttctttacacatgttggcctgccaatgatcaatcttcgtatttgtacgtccgcgggtagcacgtcctcttctgcagccatgaaacaatggtcctaacatcgtcctcggccttgtctgtcaattcaacgtgcataggcagttctacactcccgtcagaagatgtatcagaaaatacgtcactggcccttgttgaggaagatgcatgagtaacgttggggcgccttcgtcttaatttcgtccggatgaaggtattccagatgctctcaaccatctttaagcagttggcatcatcgccaaatgacatcagcttatccagaacctgtgtcatggccagctcaaaaccagtagccttcaagaagatgctgcgggcttcatccactaggttgtcgtcgcgcaacaaggatatagcagcatctgctactccctctctgacaaatctgctccagttctcctgggcctcgcagagactggcgatcgccatcgccaccgtcctcttgacttctctgtctcctaccaagagcagcagctccatcagcgcagcgaagcctccaagttcaccgatcttgatcttgttgtagtagttgtcagccagtaacccaaggatttgagcactcttgactcttgtgtccacaggccctagcaatgcccttgcaatcagcacaggtatggcatattgatcatctcctaatatcaccttattggggttgtaggaagctgtcttcgcgatgatcttgaggataatgtcgtccaatccgggatcagggtccaggcatgtctctggcaagaggcatgcaagttttgcaatcatccctgggctttggccaagcagatgcaggagcgaggactgcgcattgctgatgagttcatgtaggcgtaatatggcatcaaatgttttgtcagacaagctaggggagagtgccaagaggttgatttccctgaacagggcttcctcctcagaagaaatctttggtggttctgcaattgttgtcacatctgtaatgccgtttcttgtacgccatagtgctgtgcacagcataatgaggatattggggatgaatatgctgttgtcgagaatctcatcagttactggacagaggcgtctattttcactccaccatttctccaatgctaaaacctcaacagtctgtagacacaacagatgcaatcagtgagatgaaaaaacaagaattagaatcagggagttaatattcactatggaagctctcttttattcttgacaaaagggataaatcctcggaacagaataagaataagaagtacagtaattagaaaactatataaggggagatttaacaagacaaatgaagatacataaagataaacaaaaatgccttgtactagacgatcaaaagtttaaagataaacaaattttaacatatgtaattttctactgcaactagcttcactccaggcatattgctgaatcattcagacaaaagctccattttgagaaaggggttaacttataatgacagctcagtccctgaatcggctttcgtaaaaggccattgctcaaacctacatgatgaaagagaacaacttgacaacatgctgaaaatcagcccttcagggtattcttcacatcaggataatgtttctttccttgtttgaagcaaacataactcccaaagaaaaacaactcttacaaattgctataatttttattctccttggtgatatcatatcctatggcccaaagaagcaagcataatgtcttctaaaacaaactttaggtggaatcaagtacttcagaacatgtaagcataacaactaggggatctgaattcaccctggcagaaacaacctaacaagattccaacaggaacttgaatgaaacagtctaagaggaaatctgttatgattaacaaaaacacttcttgaatccaaatgaacaataccattacggatttttcttggactgtaattctagataaagttttctgaaacaatctctaggtggaaacaaattattcagaacaagtaataggacatccgaattcacaccctggcaggacagaaacagcataacaaggttcaagcaatccaagaggatttctgttatggaaagaacaaaaaatggcacttcttgaatcgaaagcaataataccattacggattttccttggactgtaattctagataaaaactcagttcctcacagacagaaattgaacaaagctaagagatcgcactaagaaaatatttctacattgtcaccaatccgaagcgatcttgcaacatttgtaccaatccagcactaagaaactagtagtagaaactatcagagaacatcaattacaatgtccaagcagggtatgcaaatgaattgaataccaagaacagcacaagaacaagccacaagaactgaagaaattgaggaagcagcgaaagattcggcacacctttccagaggagatgacgactggattcaccatgaccttgttggagatagggcagaggaagaactccggcacggcggccgggccaacccagcgcttcctgaaaccggcgccgcggtggagctcgtcggagcgcgccgcctgcagcgcccggaacgcggactcgaagagctcgagcgggggcaccggctcgccgccctcgccggcgcagagctccgcgaaccacgcgagctccgcgacggcctcgcctcgccgcagccaccgctccagcccggcgaggtcgagcaccctccggtcgacgaggagctcccttttgaccctccccagccgcgcgctcgccgtcgcctccatcgtcgcgtccaggaactgggccctcgcccccgccctcctctccgcctccacggtggcgaagtggtcgaccaccgccgccgggtgacgacgtcgtgcggcgccccgaggtcggggaa

SEQ ID NO: 14625 - DNA, 5704 bp, Oryza sativa
taatatagactaaagaagggtgttgcgatgggataattttgggcctaatttggatgggcggagattgagatctatttagaattgtgcctaaacatattagccagttgaggcccagattgatgggccgaaatcttggttcatttatgtgtaggaaaaagtacatctgaggtctctcattttgtcaccgaattacaaaatcatcccgcaacagataaatcagatatatgatatctctcgacttataaaaccgggtcattctgggtcattaggcggtatttaccctggtttttgtctaacgtggcagccgagtcagcgtagaacccacgtggggcccatatgtcagcacatcaatcctcttccacctctatcctctctctcttcccatctcaatcaaagcatctagggtggccagtgtcaggctgggagaactggagaagggtggtggccgacggaagaggcgctcgacggctaacagtggccttcgctggcggtggcgacgcttgttggtgaagacgggtagggggaagatgaacggggatggtggcgctgcgggagagctgagacaggggagcacgggtggagagcaatgggggagcatgggggagggactcaccagtgaactccgcctctccttgtcgcattcgtgaagggatccgaccgggccgtcgcgggcctcctcctctcccgccttgcccagcccgacctcccctgcacatgggaggtgggaggcaaaagaggtgggaggacggcatgctcggtgaggtcgaagcggggcacgagggcgctggaggacgacgtggccaatgaggtcgaggcggcgcgcgaggaggtgggaggacgacgcgaccggtgaggtcgagccgaggcgcgacgaggtcgaggtggggcgtggggagatcaaggcggggtatggggatgtgtggaggcagccggcgaggtccgccatggatcgcaccaagagcagccggtgcgtcctgcttggcagggcgaggtccttgacggagaccggcttcaccctcgagcttgccgctgccaccttcccgccgagataagtgccgctgtagatgctgcccgactgccgcttttccactgcccaccagccgttgtagactttcatcgacgagcgggtgatcttgaactcgctggccagccagcaccgctaccgcctatctcctctccgccgctcttctccttgcccgccgccagccaccgcccacgcccgctcgtgcactgtaaagagacaagagaagagagaggagaagggatggagaagcttgtttctgcttgagccgtacgagatgaaattctcatatacagttctcggaggggggtttgggttagttacctatctcaataaagtatatgattggtttgaggaacgtcttgagatttaggcaattgcagacaatataactagtaaatatgttcctcctcatgtcaacatattttaatgtttagggggaattacacttacttgttttctagtacaagttgctacaggttttgctatgactttttactatcgcccaaccattacaaaggctttttcctcggttcaatacataatgaccgaggccaactttggttggttaaggttccctaacatgtgggaccgagtgggtgccacgctgactcagttgccacgtcagataaaattggggtcaatacttcttaaggatctagagtgacccggttttgtaagctaagggatattatatatcaggttttccggttgatggaggattttgtaatttggtgacaagataagggacctcatatataccttttcaataatattttttttgggagactaaagaacggtatactgttgtaatggaatagctgacgccaacatgatgtcagcatggtatcgtaagtatcagatatgatatcccgtaggaattagatttggtatataaataacatgacgacatcatcgtgacgtcagctattccgttggaattgtatattgttctgtagtatttttttgttttgtaatttttagttcgatttttctgtttgcaagtatggagtaagcgcaagtagaggccagtgcaaaccgggcagtgtatcctatgcacagtgcacacgctcacactccgtaccagagcattggttgcttatgagtcaataaaacttacttcctccgtcccaaaaaaagataaaccctaggtttccgtgtcgaacgtttgatagcccgtcttatataaattttatttttataattaatattttcattgttgttagatgataaaacatgattaatactttatgcgtgatttgtctttttaatttttttcataatttttttaaataagacggacggtgaacccagagtttatttttttttggacggagggagtaaggtgccacgtgctacgaccgtagaaactacagttcattgcctatcttcaaggtatccaacagcagatcaaaccatcaccttgtttgctttatttcgtcccttccaatggacgagacaacctacagagacccagtagcgtcagctccgatcgagatcgagtcagaaaaaggaggagagaaaaaggaaaaaaagaaagaaagaaaaaaaaagggcaaatgaaaacgctcgtcgtcacgctgccgccgcatcgcgtgcacgtagccgcctcggcttggatccccccctcaaccaaaccatgcagacatgcagtgcagacgcgcatcgcgtgctggcgccactcgtttctctcgacgcagccttagcttagggccagttcaatttgatatcattttcaaccttaccaaatttcggtaaagttgtcaaaaaaaagtagatacatttagtttgctgccaaattttggtaactatataaaaaatcctgccaaaattttagcaactataccaaaattttgacaatgctaaaatttagtaaggttttttttggtattaaagtgaacaggcccttaactacagcctccacacacgctcccttccccgcctgcccgtccatccgtccccagcctcctccggccgctcgccggagaaggaggaggacgaggagacgacgacggcttccttcgatctcctcgtctcctttctctgttccgcggtacgcgttctcgcatcgcactctgttcttgcttcttcttctacttcttctctctgtacgttctgcgcattctgtcaatttgaacacaaaaggggtggtagtataactcggaatcctggtgttaattacaatttgtttgcaacgaatcgtgagtgtcaattaggcacaaatttcgtaacaccccccatcatgatttatcatgatttgacatgtttgtatgtggaactttaaaatatgataaaaatgtagatagtgattgaattaatacttgttagtgggtgtgatgatgtgatttttatctttaatattgagctttaggaactaatgatttcaaagtgggttcctagccgtcttctccataaagcgtggttgctgatggctgtttgtgcattcatgtagccgattaacatgcatgttttgctgcaaagtggtgaacatgggattaaaattttagggataccaaagctaatagaataaatatatgccactagaataaagctagcaggcatttagacatagcctatcaatagaataaatatatacttaaatattgggagtagctatatttatggcactatatttttcactaaaaaatagtcagcatgtatttacattgtaagtctctaaattacatatgtaaatttagtgtgtttataatttaagttttaaagcaaatttaagtatatatttgtaaagacaataaacaataattatctttcagttatttatccttgttcttctagaaatatctggtagtggtagagtaaggaaggaaatgtatcaaatggtagaaacaagttctttttacaatatataaacatgattatcgatgtaatcctgagggtttaagtccaagctatagatgcgcactccatacacacactagcgagtgtcactcttaacccatgttcaaggagagtaagagatgaaagttaacgacaaatttcttaaatatcattactcattgaaagtgcacatatgtctgtgtattttacgcatattaatatgagtatatatatatatattcgaaaatattgtttataatatagtgttgttcaaagtgttctacatgaatgtatgagattccacgaagcatcttggcttaaaatatatttgagttctttaaaacaaatcacaaaactttgattttttttttgcaataaacgatattgtgtgtattaattacaaatgccttagaacattttttttcttttaatttactgttttggaacatcttttttcacacagctgctggtgttgtggagtgctccaaagatcgacagcgatgcattgaacattagtttcttttttttaaaaaaaaatcttttgaacaacggccgctagctgcttttgtcttttcccatggacgccaagtactagagatcgatcgaaccattcattatgcgacaccgaagatgcatggggggaggaacaaaataaggctataattggctggaatttcggtgaacacgagagatcacggtcagtgtcatcaccatcgctcgtgccgtgccaagaacagtgtctgtcgatcaccaccggatcgatcgatcgatcgatcatcagacagaggaaatcgaaaatatttgctggaggttgaaggcgactgaatctttccaggagcagaggagagagagtccctttcactgatccgatagatctttacttttcgctgttcatcgcggtagccatggccccaccaggccaccaccgcaggaagtcgccgctcaatggatcggtgcaccaaattaagcaccttttgttattttttgaacattttagcccttcttaaaattattttgtgaatatatctatacaaagtaaaccgttggatcggcgtcaaggtctcgaggcatggagctactatccaagcccttgctcgtgtgacggtcaatgttaatgttagaatttgtgttcattatatataagatgttacagtttagaattggaagttgaaacatgtgtaggatagggatagagttggactatattttaggcttcctcttaaatagagagacacacatgttataatcgtatgatgatctaatatagatgagagggaatgactgctggtggcgtccaacggagggtcgcatgagagagaacgacctagcatagaaatttttggactttaccgatactaatttcgtaaaagtaataataaatgatatcaatactgattgtttctgaatgtaaatttagtttttctaaattttgtgtgttttattgaagctgccactaaatagttaaattcataaatataaaaattctttatccaatcgatattgctttcataaaaaatatatttcctccgtttcatattattataactcattgacttttttctagtcaaactttattaagtttgatcaaacttacagaaaaatttagcatcatctgaaatatgaaattagtttcgttatatctaatattgaatatattttgataatatatttattttctactatattttcttgtaaattaagttaaacttaaaaaagtttgattaaaaaagtcaaatgagttataatatgaaacgaagagagtaataaaatgatgccattttcgaccctttttcacctaggcttatagtttcagaataagctttctcggttggtctattgataaag

SEQ ID NO: 14626 - DNA, 3393 bp, Oryza sativa
ccgccccaggaagaagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcacattcactaaaattagaccataactcctttagtaaaaccctttgatcagcatgttaaacataatgcactctaccactatataaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctaccgaaacggaaaaaatatgccatctattaaaataggcgtaactttctcatacggactcggaatcaggcaaataatatatgaacggacatctacagaaaaagttacatccgattctccccgctttgccgggttcggggatattaaaacctccaaattccgcttgcaagattgtgttttcgaggagggaagtttttcggtggagctttggaaaattccacatgccacatatttcgtccgtttgagtttattttttacgtggttggttcctgtgagttcctaagtgtgaaaaaaatatcaaaaaaataaaataaaaataaaaaaagttgcacatctctctcctctgcactagttcggagagaggagaggagagaaaaaattctacatgtcacatattacgtccatttgagttcattttttctgtggttggttcttgtgtgtccctaagcgtgaaaaaaatatcaaacaaataaaacaaaaataaaaaatttcggggggggggggggcgccagccactctggcgtactccccctagccacctcagcatagccccgccacgtcggcggtgggacggcgccaaagaggctggcgccgtcttgtttaacaacggcgccagccactctggcgccccaaaaaggaccatttttgggataagtttttctagggatctacttgcgaaataagtttttcaaaaggactaaaatgtgaaaaatccagcctcgtggtccgccgccgcgcccttcattcgtctagccgaggtggaggaggaggagagagaggacgtacggacggcggcggcgccttctccttccactccggcgcctcgccgccggcgacgctgacgacctgcggtacgtacggctccacatgtcgctccccgtcacgtgtttctttcctcaattagtcaaatttttgtggcgccggagagatcggcttctgcgggaggagtttgctgtttttgacgtacgccttggaatttcttttcttttatctcgatgaatttgaatttgctccgtcgctaataattcggaacagcgaaatctgttacgctcggatttgcctcttcgttgcgaaagaattacaaaatttctccgcttgacttgatttgaattttagaaattcccgttctttggttcagttttgcggttctgaacttctgaaccaaatgcatatttttcctcataatttgttgcaacggtgggtctttgcatgtcgtcgagaatgggtctctttggcacgtgagcgtcaggcatgaaaaaataagcttaaaagagctggaaatttggacatgtgctgtttcaaaatgatttgatcaagtcatccaatatataccactaactggaactaaaatcgtggattagtgtacacaaatttaaacagtctgaagatgacctgtttgactctgttaacaagtactagagggaagaggaggaagtctggttgatttcggcacctaaaagtatatataatttgtttcatcctttgactcgtggtgcaaagaatctagcaacacacattcttgtcctaatcgagtataatagtattatgtcaggcatgctgaacttggctgccaagcttgactgttgtttcctttggtttttcttcactactgcacttcaccactttggctgcaagttatttcagccatatcgaagcaggatctgtttggctgttgaagtggtgataacagtcttagaatccagttctttactattcgttagcctttcttaaatattcttaccagttataaatatgtgatattttggaatgcgcgttggcaatacatttaaactttaaccatcaatatccctttgaatattttggttcaacttttgaaaacatactttatttgttttcaaaaatagtttgaccatattgtaacttttccgtacttttttttattttacaatactactattttcgacctaaaatataataacttttgcacaaactagcgctgtggtgacaattttgctatccagatcgttacatttttttttctttgggggtggaggtagtatatactactgtcataataactttgccagataagacaacgtatcgtgttctttcctcagcttgtttcgccttttagtcacgttgaacttggctgtcaagttagtgtgcatcgtttcctcgcagtttcctccaattaatcgcaaagcccttataaggacttgtcagattattgactgatttgctgttgctcacaaccttcagtaagtagttcacctcatctgtaattgtaaacacactcatctttctgtttgaagttgagaagcagagcaagaagctaagcttgggggggcgtggccatggcggcgccaccaagcatggaggagcctcttcttggaggcggcaatggcgaggagaagaaaggagggagctcgaggctagcggtggtggccgaggtgaggaagcagctgtacctcgccgggccgctcatcgccgggtggctgctgcagaacgtggtgcagatgatctccgtcatgttcgtcggccacctcggcgagctcgagctctccagcgcctccatcgccacctccttcgccggcgtcaccggcttcagcctcctggtacacacaccagcccttcctcaaatatacggttcttcagaaagtaactcgagatatctaaactttacactaagttttttggagtatctgaagatatcaaattttatatttcaaaatttggtacttcttaataccttctataaaattacctaacatcgaaacctaatattcattcctgacatgatattgaattcgctccccatcttggtacgtgttcgatctgttcatcatccatggtatgatggcatgatatcttgagaaagtaccttgaagcacttaaattttacactaaaatttttatttcctcaatatacttaatacatgg

SEQ ID NO: 14627 - DNA, 44164 bp, Oryza sativa
gctggcatggcgagcagcctgaacacgctgtgcgggcaggcgttcggggcgaagcagcaccggctcgtgggcgtgtacaagcagcgcgccatggtggtgctcggcctcgccagcgtgtgcgtcgccgcggtctgggcctacaccggcgagctcctcctgctgttcgggcaggacccggagatcgcggcggcggcggggagctacatccggtggatgatcccggcgctgctggcgtacgggcccctgcagtgccacgtccggttcctgcagacgcagaacgccgtgatgccggtgatgctcagctccggcgccgccgcggcgtgccacctgccggtgtgctggctgctggtgtacggcgccgggctcggcagcaagggcgccgcgctcgccaacgccgtcgcctacctcgccaacgccgccgccctggccgcctacgtcaggctgtcgccagcgtgccggagcacgtggacggggttctcgtcggaggcgttccacgacttggtcggcttcatgaggctcgctgttccttctgctctcatggtctggtaagtttcttttacttaaaaaaataaattttatagtactttttttttattacacgatagatgtacacgcgcacacaacactcaacacgcaacacacacacacaaaaggagagattcggaggtagagatgttcttcaaactatttttaagaaggaattgtaagcaggttgggggctaaacatgggacctcagaattgaaaccacacatcccttaccaattaccactgtattatcaagtgcatctctaagcacataacaccatactcacgaaattttatagtacttgagaaaatacctatggatatcaaaattttggactgaaaaatttagtaacaggagatatcaggttttataggagtattagaaaatatgatacattttggtaccttgttaagaacggtaaaattactctaagaaaactattgtgctagtcactctgagttcaggtaaatttcgttgtctcatgtcgaatttagctgaaatttgcatgttttgtagcttggagtggtggtcgtttgagctccttgtgctgctctccggactactcccaaatccgaagctggaagcatcagtattgtccatttggtgagtgatgttttcatgatttggtcacacattctgcatccagtttgcctcctctgatcgtgtaccactgaatttcctgcagcctgaactcgggttccttggcattcatgatccctttcggccttggttcagccataaggtcagatatattgatcaaatcaaacaccttatcataaacattgctttcaatttattgtttttcttttcatcaaaacaactgttcatgaacttttacaatgacaaattaacgacatcacaatgccctgttcttcgtgatctctctcagcacccgggtctcgaatgagctcggcgccggtcgacccgaggcggcccgtctggccagccgtgtggtgatggcgctgggtctcgtcgtcggcgtcgcgatcgggctcgccatgatcctggtgcgccatctatggggttacgcgtacagcaacgaggaggaggtggtccagtacgtcgcgaagatgatgcccattcttgccgtctcgttcctcttcgatgacctgcagtgtgttctgtcaggtcagatgatcgatgctcgatctcaaccaaaaaaattgaaaacaaaatgcatgtgattgagagactattgtctgagttttttcacgcgttaatcggttcttttcatatccatctatttatgattgatttgtatatatggttgttaacaaacatattatccccaagaaaatgactgacagtgagggattcttcaggtgttgcaagaggctgtgggtggcaaaagattggtgccattgttaaccttggagcgtactacctcgtcggaattccagcggcgctgtgtttcgccttcgtctaccatcttggtggcatggtaattctactgctcacataagagaaagcattacctcaattctgtcaacattttggttggctatttcttagatatgggacctggaatataagttttcatataatctttggccgtgtatattcacttatggatacagaggcttgattactatccattatctaaaagaaatcggtctctgttttgagcagaagaaattgacctctgaacaatatatatgcttccaaacttgcagggactgtggttagggataatgtgtgcactcatcgttcagatgctgttgcttctagccataacagtgtgcactaattgggagaaagaagtaagcaaaatcattcagaacttcttgcatgcgtcacatgtatactgttattttttctgtcagcttgtcattacggtttcttgatgatgtggcctgtttttgtcttgtgtctttccataggctctgaaggccaaggagagagttttcagttcgtccttgcccgcagacatgacatgataatacaatgtacacgatccaagaaccaagatgaagatcgatggacgattttgtttggcaatagtggccaagaaattctacgagacaatgggaaattacagcttgagaaattaagaccgtcatctctatgttttgatgacacaattaatagtcgccaaaacaaggaactatctgcaaggaagagttcagacagcgagaaatctgcttttggtggattttttgtcagacgaagaaataaaatgttatggactagagacgctgcattggatacaataatgaattgaaatgttcagttaactatatgtaatggatgttaggatttcgacaatgacactattttggctctactattgattagatgattaattatattgtaagtattatgtgacatgcgccattgagtcatgattcatgataccttttctcctaaacgaaatacatcttcttttgcttgtaaatatgcaaatataaagttttttttttctatgagcatgcttcatgattttcttaacaatgaaagtttaacttttaggctttgcatcgcaactaggtacggacagttggtgatgccaaggctgaacattaaacttccagtgttaaaaataaatatttttctatcaatctggcctacgggagtttttaattagtgaaaaaaaatgcccatattcctagggtaaaaatagttgaagctgtttattgaaacatgtgttgtccatggagatgcatgagttgatgactagtgctatagcttccaattgagaaggtgtgacatatattattgatgcatattagctgttcaatcaagtaatgctaattcaagattgttcattgaagaaaacaaattaaaaaaactaaattcttacttcaaaataaatatataaggaactggcctggtaagttggatatcttggagctagaattgaagttaaactgctgttgtttgggcaagacatgttgttcacacttcagactaaaatggagggttaaaccattttacctcagcaagtaaataatctaattgtgctatcattttaaaattgtaatcaatcagaagcatacaatatgttgtttcatgtaccagaagcatgcatctaatgagcatgtccctcccatcttcccatatgttgaatagcatgatactaggttatggacgtgatacaacttcttctcttaccagcatgtgtgtgtatatatatagtgatacaacttatacaacttcttctcttaccggcatgtgtgtctatatatatatgtgtgtgcaactagatgttttcttgcataagcacttgctagtaaagcttaaccaaaagaagtagtgtaacacctatcttcgcacatattcattgatatattagagaaaaccaaacaaactatgtgatgttctgattagtgtatacgctagaatgtgaatttgctagtgaagccttctagatcaaggttcatcaaccatcaatctaactaatttctttacatagctttgtagatatggaacatattttttgagatattagacaaaaccaaacaaactatgtgatgttctgattagcttatacggtagaatgtgaatttgctagcgaagccttcataatcaaggttcatcaaacatcataataaataatttatttacatagctttgtagatatgaatgaagttagtaggtagctttatgggtattaaagcacattaaattcaaactgttgaggagctagttagagaagtacagtagcatgctacaagtcacgtataagcacatgtggaagagagagaagataggagagagaaggaaagcgggctagtgatttgtagccagctgcagcacggacttcaaaacattgtgtgtatgagaggtgggaccatatattaatgatgtagtatatgtttataagcaactattattgtatgaatgagttattagattgactatagatgatttggaaccagtggttggctataccattaaacttgctcttagtatggatgaagttagttggcttaatctcttctatatttttatactcaaagtggggaatatatagtaggcctcctcatcacctgttatcgtttcccatcctttccggttatcatgtagctgatctatttaattgaaattggcctgcaccaattgtgcgtgagttgagctacttttagtcttatcagttgcccatagttcctaataagataaaacaacttatattttaaagcataaaaaataatttataagtaaaacttttatatatgttcttagcgacttaaaatccattgctgaaaaatgaactacattaaaaatatcttaaaatcaactttgaaaatttaaattttggctttggtttcttagggcaaccaatggggccttgttcttgctgctcgtttatgtttgcatggtatcagagcggcattgatcccacatgttcctttcccatttttttctcctccgctacattcatggcttctccacaacccaccataggcagtgttcccccctcctccttccctaacctaggacaccgtcgccaatctcgtcacggcgctcgccgctgcccatgccgtgacgtccactggcaagaacggagaccttctcctcgccaccctcaccaaggcataggtggcccaagatgccatcatggtgtcatcggtgcaagcactaggcgtctcttcggccctgacgatcccgctgtccgtgcaagatcgaattggtgctctcccgccacctacgcctaacacgcgtggtcgttggtgcagcacctgagctttcagcatcccaaacttcaaggcacacgtgtctgccgtccttgacatgaagagttcgaactacaccaagtaaagaaccatcttcgtcgcgttcgagcctcctcctccgctcgacactgctgggatctgggcgcaaaaggactccgctgtccacatcgccatgtactgctccatcgccaccgacgtccttgatgtcatcatggagaccatggtagttggcccacgacagggcatcttccacgacaaccgtgaaaccagaatcatttatcatgaaatggagttccgtagcgtccttcagggctacatgccggtgacgaactattgctggcgactcaagaatctcgctgatggtgatggtgctggccacgtctcgtcgtcggcatcgcgatcggcggggctcgtcatgatcttggtgcgccatttgcggggtttatgcgtacaacaacgaggaggaagtggtccagtatgctgcgaagatgatgcccactcttgctgtctcgttcctcttcgatgaactgcagtgtgttctgtcaggtctgatgatgctcgatctcaacaaaaaatagtcaagttgtgaacaatatatatgtttccaaacttgcagggactgtggccagagataatgtgtgcactcatcgtgcagatgctgtggcttctggccaccaactgggagaaagaagtaagcaaatcttgcagaacttcttgcatgatcacacaatgtgctgtgtttttgtcagctttgtcagtaaacagttcttgatgttgtggcctgttttgcattgtcttgtgtctttccataggctctgaaggccaacaagagagttttcagttcgtccttacctacagacatgactacatgataacactatggacacgatccaagaatcaagatgaagatcaatggacgattttgtttcgcaataatggccgagaaattcttcgaggagaacataacgagatgatgggaaatcacagcttacactgctggagaaatggtttttaaccccggtttgtaacccctgtagtcatggttatgcaaccgcccctgtagtcctggttatgcaaccgggactacgaatcccccggttgaaataaccgggattaccaaccgagactaaagatgaagcccggccaggttcggttggtagttttttttttcttttttttcattgtttttaactttaaatattgatttcactacatccccaaatcatccccaaacaaaaggatcatctccaaatccccaaattgatcatctccaaatacatcacaaattctaaaaaaaaatacatcacaaattctaaaaaaaaaacaacacaaaaacatcacatatttacatcacacacagatcaaatacatcacaaattctcaaaaactaattcatcacaaattctaaaagaaatacatcacatattataaatctcagatctatgcaatgaatcacaaattctaagaaaaaaaagaaagaagaaacggcgatgccactgccgtctcccgcctcctctccggcagaggggaggacgccgccaaacgccgtcgcccgccgcctgtcgccgcgcgcctgctgcctgccgccgccatcctatccgcccgctactaccctccctgcttcccgccgccacctgccgcggcccgccacggccttccgtggcacgtaggccaggccgccgccgccctctgctcctcgctactctgcacaaaaagaaggagacgataagatagagagaagagaggaggccggaaaggcaagtataagagagagagagagagagaggaggaaaaggaagttaaaaatgaggagtttgtgaggataaatgcgagggattatatacggcacatggattggactaacgatcactggccccctgacagcccctagctgtgaatgaaccgggactaaaactcatctttagtcctggttaccggtactaaaaatcatacagggctgatggagttttaaaccgggaaaaaaaccatctttagtcccggtttctatttaaaccgagactaatgtggtttttggctaacccatcaaaaatgttttctccagtagtgttagaaaattgagatcgtcgtgtccatttttggtgacgcaatagtcaccaataaaattggactatatctgcgagcaagcgttcagattttggacaacgagaaatccgtttttggtgatttttggtcagatgcagaaataaaatttttatggagtacaggcactgcattcgataacgataatgaactaaaatcatgttaataagttaattacatgtattatggatgtcaggattcgacaatgatactattttctctacttttgattagatgactaatgactgcttttgtttgggaaaagacatgatgttcacacttttgacaaaaatgaagggttaaaccattttagttcagcaagcaaatgatctaacttgtgccgtcattttaaaggagtgtaatcataagcatacacactacgttgtttcatgtaccagaagcatgcttgtgttaaatagcatgataccaggatacatggacgcgtgatacaacatcttctatccactccccatgtgtgtatatatacctatatgtttccttgcataagcaagctttaaaaaaaggtgtaagcttcagatggattccattagatattagagaaaaccaaacaaactgtggtgatgttctccttagcatggttggtgaaatgtgtcctgatcaacctgcaaatattatcaagctcacttcgacggtacttagcaaacaacactgtcttttcgcatggaatagaatattattttgtatagtttgctatgtttcatccattcaaattaaatttttaatctgtattggataaaatgaaactaattttaacatgtaacaatgagaattcataatacataatgtactattactacatggaaccatttaatattaataatacataatggtcctacaaattagccatttgaaatttcataagtgtttatggtaacatttgtttcttaatttaataacaatcttcaacttaaaatgattatatatgctgaaacaaatattcaatttacagatatttgaacttgtatttttctaactggaaatatatataaaaattgtgtcgtatattttgaagtcattctaatctcgtacacactaaaaattgcagctatttatatactaatgtgattggatttattttatcgatgcatattggattagagatgagaatcataatatcaaatggaatacatatgcaatatatttactcgacaaggaaaggtcgatcgcaggtagtcacaaggtaggttggtttagagaaaacctatttggtcatggtacagttcctggtgagagtgcatattttttttaacatattttttctggcttagaaatatatgttttttcatcattatgaattattacactaaaaaatcactcccaaatcccaatcactaaaggtttattagattgttatactctgtccgttctaaaatataacttctccaaattcatagctaaaggtcccaaaatattttaggaaggaaggagtaaatttgtcattcgaattactaatggtttaattgttggatattactgttcttaatggaccgttactccgttagagattggcgtttgtatggtattattgctcgatcctctcgttagccatttgactatgaagacgtgttctcttgatcaatcctataagtacaggactttctaccctatgcccgtttctggttgtgtcttagctgataaaagtggaatctgaacgaaacaaaaatacaaaactacaaaactagtaagggagttgagtacatgctagttgcaatcataccattgggatgctctaaaattttgacaccactaattggtattgcaattaattatcaattcattatgtagaacaagaaagagatcagatcagaattggtattgcaagggttgccactggaatttttttttcagttatacatggcttttaccatcattgagttgaacaaactttatgcatatatctagagatatgaaaagagtaatattatcaataatgggtaatatgacgctaattggatgctagtaacacaatatttgttttttttatgtttgaagttttttctttcagttgttaatagtatagtgctattgtgaacaaattaatatataaaagtacataaataggcataatacggtagacacaatttcattgagatgaagaaactagagaacatataaatgttgtactcagtctataatctagctagaatgtatattttttattcattggtctcttccactttaattttaatctaaatgattaattaaacagactgaccatccaacaaattatatcgacaagatgtcaactcaatcatgaccatatacatccatataaatgtttgaattatctatcaaagcttgcaaagatgtgctatttgcttgggtggttgctcattgagacttaaacaagtagtagcaacagccatggtcacacagtgcaatctactttgatttcccctaatatctgaggatagacttagaagtgaaaatgataggaaaatagcttagctctaggttccaagccatacatacttctcaagattaaacttgtctgtgtatatagtttgttgctatatattggccaatacaacgcagacagttgttagaaatgaaaaatgtatggttgtaacttcaatacatgcaagtgcaaatgcatatgatgtgcatttctactttccaggcatgctcatgccttcacaaatatctgttgaacattgcttcttttgccgtatctgttgctcacttgcaattgatttactctgaaattaacttggaagtaaattaatatgaagagcaaacaacttagcttatctcttaacaggactccagcggcaaaacgactttcaaatatttcagcgattcagaacagaacctcaaccagtgaataaccagaccaatcatcagtgcagtacttaatagcaatatctcacgcgaaggaaatattacgcagcaaaggatattgactcacaaagacaagtctacaatctgtataacactatattcttccagttccaccgggtggtggacaacacgatcagaactagaagtgattccaacgagaaccaagaacttacataggagatggataaattggatacctggtcaatgccatctcttcgatttcatctcaattaaacaattgccatctgttttctttggtgaggccactgcaacatggatgccggccacaccgactatatcctccatcacattcttcttcctagctaattgtgccgccgcgcccctccttgccagctcctcggcggcgcaagtaaggagtttacataggccgtcgcattctgcaccgatgcaggtcaggaagatggcccaacttcccatgatgtcggtcatgcaggcccaccgatcgagcagaaaacaccatcgcctcatagtggctccagaaatttttttttatagtcctattccacgcttcaaaatttcaaaacgccgaaaactcaatgtacgtatacaaaatttactcaaatactctactaaaactagcatttaagtctagaaattataaaaactaggaagaaagcccgcgcacatgcgcgggcaatttatttgttgttcgtaaaaagaatattaaaaggaatcatatgtcactatattcattttaagaacgatagattaccttataatcgtaaaagaatgaaatatttatattgcgaaataataatgtccattattatactaaatgataataatagaaccatagattaccttataatcgtaaaagaatgaaatatttatactataaaataataatgtctattatattcaaataaaattcactttctcccggttatacgtaaactcacatatcgttaaccttcgcaaacatagaagttaatatgggttttgattttctttcttttactatacatctaattcgaaggaataatacatattgtcaaaattatttgtgctaattttgttaacactatttagatgagaatggcataattatataaggatataatatgttttcatgtgacattttttattgtacgcatgtatgttgttttttagtgaatagtagtaagtatattcataatgtgggtgcacttatgagtgtctacgatttcatttttcatcgttaataaaaaaacttttaaaaagtttggtggaatcacatgaagcgaagacacggtggcgtgacttttttagcaacatcgcaaaatatttcactacatatatgcataatttgagcaaaactttagttttgcaaagaaagaagcagaaaactaccagagggagcagatcatacagaggcactcctctgttttttttcttttttgacatctcaaagatgataaaattacccatctcatacagagttggatttctacccattatccaaaaaaaaatcactctcatttgagctgaagaaattgacctctgaacaatatatatgtttccaaacttgcagggactgtggttagggataatgtgtgcactcatcgttcagatgctattgcttctggccataacactgtgcaccaactgggagaaagaagtaagcaaattcatttagaacttcttgcatgctctcatgtatactgttcttttttctgtcagcttgtcagtacggtttcttgatggtgtggcatgtttttgtcttgtgtccttccataggctctaaaggccaaggaaagagttttcagtttgtccttgcccgcagacatgacgacatgataatacaatgtacacgatccaagaaccaacatgaagattgatggacgattttgtttggcaatagtggctaagaaattctacgagataatgggaaatcacagcttaaaaaattaagaccatcatctacatgttttaatgacgcaattaatagttgccaaaacatggaactatctgtaaggaagagttcagacagcgagaaatctgcttttggtggatttttggtcagacgaagaaataaaatgttttggactagaggcactgcattggatacgataatgaattgaaatgttcagttaactacatgtagtggatgttaggatttcgataatgatactattttggctctactattgattagatgattaattatattgtaagtatgatgtgacatgcgccattgagtcatgactcatgataccttttctcctaaacgaaatacatcttcttttggttgcaaatatgcaaatataatttttttcctattttcatgatttttcttaacaatgaaagtttaacttttagcctttgcatcgcaactatgtacagactatgccaaggctgaacgttatacttcgagtgttaaaaataaataattttctatcaatctagcctacggaagtttttaattagtgaaaaaaatgccccatattcctacggtaaaaataggtgaagctttttattgaaacatttgttgtccatggagatgcatgagttgatgactagtgctagcttccaattgagaaggtgtgacatatattattgatgcatactagtaagcgtgattcagaaaacacattatcaaaattcatgtcacttattttctttttcatagcacgccgatacacagacaaaatgtttgcctaaagtatttcactttctctttgccagatcagtaaaagtcatacattaccaaaaccaagtagaaatttgcggaagcaaataaattataaaatatttgataatcaatacattttcatcaaggaagttttcatttacatttcagaccatcagcagagcatgaatgcaaatatatatgcaataatttctaatctcgctcagtctctctgcttgagagcttgttattcattttttccattctcatccattgaacaattcatactgatacaaaacaaacttgacattgcatctgaaatctgtgcagtgaacttgacatataattcgaaatcaatcaaaagtcttcaaaaccaataaaatccaacgaataagcccattacctgattctaacactggggcattttcttttgaatacaatcatcgtgggcgatgcatgcacgtgtgatggattcaccagcagggctagacacagacaacacaatcaaggtagcaagtatcagaataataggatatttaaagtatggccacattctgcatggtaaccaaaagcggcggcatactcaaaagatcattttcatactttctgagttatccaactcacaaattgaaagtaatatctacatgtgcatcaggaggcaagttttacgggttactccctcttttgagttatccaactcagaaacctgaaaccaaactttttgctcatctccatggctcctagtctacccatctccccaccttgtagatctttagggattaccacctgttagcaaattacgtcatttgatataattagtatctagctactacctccgtttcaggttataagactttctagtattgcccacatttatgtagacacacatatatgtctagattcattaacatatatatgaatgtaggcaatgctagaaagtcttataatatgaaacggatgaagtagcatatacgaccaaaattctagaaaagcttcctgatttatagatattaatttcaaaaatgagttattatgggtacagtcagagtgtttccttggccgaaattatggtaagcataagctaaatgaacaaaaatacgccatgtttcaatgcatgagtttaataattaaattaattaattcccaaatacaactgtcaataacaaatcagcaagctgcatatcatattttccagctctttggccttcctgaccattgtgcacagaccattcaaaacctagaaattgaatgcaagttcgattactcaccaatatatccaagcaaaaaactttgcggatttcaaaaccctaaaaccaaactgttagtacctaaatgtgcaatgtgtgcaggaggaatggatggcgtagtgaaaatttgcatatattggtctgctgaattggttaggtctttgcatttgtgagcataaaaaggtgatggggtttttatcttcaactccaatgaactcaaaaaaccaggcaagatattgcttcaagcattcagtgccaaaagctcttataaccttcagtgaggccattacttttgtcacagcatgaatttctaggatttgggagaaagtgagatgaggatgtcattctaagaatacatacgaactatgaggctgtgaatagaataaggaaaattaacttggactataaactatgaggctgcaatatttgtatttgtggcagcatacaggtgagtaacgttatggtgcaaataaataatgtgatcctttagatgtttgtgtctcagctagtcaacactgcaatatattgagtctatacccttgtgaaattgtgctgcaagaactggcctggtaagctgtatatcttggagctagaattgtggttaaactgctgttgtttgggcaagacatgttgttaacactttagactaaaatggagggttaaaccattttagctcagcaagtaaataatttaattgtgctatcattttaaaattgtaattaatcagaagcatacaatacgttgttgcatgtaccagaaggcatctaatgagtatgtccctcccatcttcccatgtgttgaatagcataataccaggttatggacgtgatacaacttcttctcttgaccagcatgtgtgtatatatgcaactagatgtttccttgcatacgcacttgctggtgaagcttaaccaaaagaagtagtgtaacacttagcttcgcacatattccttgagatattagagaaaaccaaactaactatgtgatgttctgattagtgtatacgttagaatgtgaatttgctagtgaagccttccagatcaaggttcatcaaacataattctaactaatttctttacatagctttgtagatatggaacatattccttgagatattagagaaaaccaaatcaaactatgtgatgttctgattagtgtatacggtagaatgtgaatttgctagcaaagccttcctgatcaaggttcatcaaacatcatagtaaataatttatttacatagcttcgtagatatggatgaagttagtaggtagcttcatcaatcaaaccacattaaattcaactgttgagaagctagttagtgtcaaagatagcatgtaatctctattttttggcataatctcttctatacccctaatcacctgctattctttaccatccttcctcatgtagctggatctatttaattgaaattggccccacctgctattctttaccatccttccttattaagctggatctatttaactgaaattggcccgcatcaattgtgcatgagctgagctactttcagtctcatcagttgcccatatttcctaataagataaagcaacttatatattagagcataaaaattaatttataggtaaaacttttatgtgtgttcttagcgacttaaaatccaatgctggaaaaggatctacattgaatatcttaaaatcaactttgaaaattcaaattttggctttagtttattagggcaaccaatggggccttcttcttgctcctcattatgttttcatggtatcagaatggcattgatccctcctgttcctttcccttttttttctcctgtgcttcatccatggcttctccacagcctaccatcgactgtgttccccctcctccttaccttacctaggacacagtggccaacctcatcacggtgctcgcagctgcccatgccgctggcaagaacgacaacctcctctccaccctcgccagggcatatataggtggcccaagatgccatcatggcgtcatcgacacaagcactaggcatctctttggccctgacgatcccgctacccgcgcaagaatcggtgctcccaccacctacacccaacacgcttgtttgtgtgacacccgcgctccctaccctgatgtctggcgctctcagcatcccaaatgtcaagatggacatgtccatcgtcctcgacataaaatttttgaactacaccaagtagagaacctttttcgtcatcttcctcagcaagtttggcttgctaagccacatgttcaagcctcctcctccactcgacactgccaggatctgggcgcaaaaggacttcgctgtactcatcgccctgtactactccatcggatgtcctcaacgtcatcatagagcccatggtagttggcccacgacccgtgggtcgccgccaaaggcatcttccacaacaaccatgaaaccaggatcatctatctagaaatgaagttgtggagcctcatccagggctacatgtcgatggcaggctactgctggcgactcaagatctcgctaattccatgcgcaatgttggcgaacagatctccaaccacacccttgtcctcaacttcatccacggcctcagccctcacttcaccacccaggcataacttctgcatctgcaagtcgcctttcccaccttcacaagtgtccgctcgacgcttcttctagcggaaatgcactgtcccaccaactcttcgctgccacctcgaccagccaatcaaactccaccaacaaagggaaaaatggcaagggaaagggcaaagggaggagtagcggtggcaatggcaacactaggaatagccgtgatagtggtagcgatggtagaggcggtgattaccctaggtctggcagccagaagtaactgttggctcctccacccggtccatgagtgatgatgatcccatgagcctctactccatgggccgtctcccgcagaccctctggtggaccaggccttcttggaccacagcctcatatgacggttcaacaggcctttcatacacaagaatcttccctggcctctgtggctggattggaggcgcctgcctagcccacctagggtcaagccatgttgcagccctgaacatcttgcaacatatggacaatgcaatggtggagcatctccagcaataggccttatttttaagcccctaaaagttaaatgagggctgcccccatttcccaaggacccaaaaaatgcctccaactccagcggtagcccctacttcttaattagtccctactcatttttatcttgtatattaaaacacaatccatgtttacactacgtttccacaataattcaaacataaatatttctaacgcatataatttaaccataattaaattcacaatttcaaacaccacaattcaaattcaaaatcaaaattttcaaacatgtaaatatggtgtgggcatagtgccatatacaacaaaaacatgcaaccaagattcataattcaccaataaaaatgaaaattactcataaaaaatctttcagatttccaagttcagagaacgtaaactgagcaagctatattctgataatcaaaatcaataaatgaactgtacttcatttgattaccggtgataatttacaagtacggtgctgaagaacaaaacaaaacactttacaaaaatctgaaacatggtagacgcaacaaatcgagcagaccctcacctgatttggaaagtgggggacgtcaccggagagggcgcagcggaggagaggtaccggggtggtcaggggtgcctgggaggagatggtgccggcactagatggaggagcgtcggggaggaggggcaccagggtggacaagggtgtcggggaggaagggatccaggaggagagggagggagccgtggaggagatggagggtgccatggaggattgatgtcgaggagaggggcgccgagcatagtgatcgaaaacgccaccagagaacaacacgcgcgggaaagaaagaggggaagcgcgcctgggaattttctcccgcgcttttcccactaggtgatgggggccgggactagagcccccaggattgggggcttggggagatgatttgggtgcctttctattttggggctttagtaggagccctgttggatcttagtttttggcctcaactttcaaaaattgtttaagggctgtgtttggaggccctattggagatgatttgatcatgcacaccggtgccacctcgcacggtataatcttttcctcccgacctccctcatctccgatgtctgtcaccatcggtagcagttcctttgatcccagtttcttgcattggcaacaccaccctctctacttctcactgttcacatatcagactacaaatgaagggttttcgagtaaaaaaaaagaacggttaaacaattttagctcagcaggcaaatgaattaactgtgttgtcattttaaatgagtgtaatcataagcatgcatactacgttttttcatgtaccaaaagcatgcatgtgttgaatagcatgatgccaggatatggatgcatgatacaacgttttctcttgacctgcataggtgtgtatatatatatatatatatatatatatatatatatatatatgtatgtatgtatgtatgtatgtatgtacctatatgtttccttgaataagcagttgctagtgaagcttaacaaaaagtgtaacagctttcgcatgtattccttgagatgttagagaaaaccaaataaattgcggtgatgctctcattagcatgtgtgttaaaatgtcaatttgtgagtaaagcctttctgatcaagttgtaaatactatgaagcatcattttgattggattctggaaacagaagaggagatctgggacatcctttatataggcttgggaggaagagattggatcagattcgagaggaaacgacgacggaagaatcggattcgagagaaaactacaacggaaattagggtttatcccgagttcatcggatctcgaatcctacaacggggtttatcccgagttcatcggaataagaactgagacgaaattcatgggattaagcacgaatttgatggatatttcgtggggacaaggtagaggaggttgataggattccgttcccgcaatcaatttgagaaaaggagcaggccggatttgatggaggtggtggcggctctgcagagtggggcgtcagggagaagggaggaagagggaggcaaagctacgggctgaggaaagaaaagagaacaaggagtaaccggattcggctttaagtaggaagataatttttattaactttttaatctaaataattgctgagatgatatttcatttattaaaaataattctaaggctcaagtaaatcaaacataaatcctgaaaatacttaggcatacaaaatatttaatgataattttatctagctcatgtttatgttcaaatttttcatagattttattcacacacttacttaaatcattaaataatttctaaaaaaaatccccttttcacaacaatttataatttagcgatttttagggtgtgacagatactattttctctacttttggttagatgattaattacaatgcaagtacatactatgtgatatgcaccactgagtcatgctgacttttcacgtaaacaaaatacacatcttcttttgattgcaaatatgcaaatatgcaaatatttttgctattagaatgctgcatgatttttttttacaatgggagcaaggacataatcacataaccatacatgtcgacgtcagaatttgaaagcacgcgtacagtgcactatgctcttctaaaaggcatggtgcgtaaggttaaataaatattggtcattgaacatgaaaaagaaatttaaaaacactaaattctcacttccaaataaataagcaactggttggctggataccttagagctagaaatagaattgaggtagactacagttgtttgggcaaagacatgatgttcacacttcagactaaaaatgaagggttttcgagtaaaaaaaaagaagggttaaacaattttagctcagcaagtaaataacttaactgtattgtcattttaaaagagtataatcattatcatacatactacttttttcatgtaccagaagcatgcatgtgttgaatagcatgataccaggatatggatgcgtgatacaacgttttctcttgacctgcatgggtatatatatatccatgtacctagatgtttccttgcataagcacttgcttaacaaaaagtgtaacagcttcgcatgtattccttgagatgttggagaaaagcaaataaattgcggtgatgctctcattaacatgtgtgctaaaatgtcaatttgtgagtaaagtcttcctgatcaagttgtaaatattatgaagcatcattttgatcgtagtctgtacacatattcctagatataggttgaattcatgaggactaagctagcatcacgtcaagacggccgagttttgtacacacgttcatagatataggtgaaattcatgagaagttagctagcatcacgtcaaaacgacctagttttgtttagctaaacagtatttaccaaacaccactgtcttctttgtatgaaatagaatattattttgtatggtttgctatgtttcatccatttaaattaaattttcattatatatgggacaaaatgaagataattttaacatgtgcagtaattaacaatgagcatgtgtccctatttggtactgaaccaaaatatgtcattgctagggcagcatgcactattactacatggagccatttaatattaataagatacagtggtcctacaaattaactgttttaaattccataagtgtttcagtaatatttgtttcttaattgaataataatcttcaacgtaaaatggttatatatgctgaaacaaattaatctccaattcaaatatttatgaaattgtatttttctaactggaatatgtataaaaaattgtgtcagttattttgaagttattctaatctaatacacactaaaaattgcagctattgatcaactaatggaattagattcattttatcatgcatattggattgagatgagaatcataatagtcaaatggaacagtacatatgtaatatatttgagtcacaaggtaggttgcattggtttgcagaaaacctatttggtcgcggcacagttcctagtgagagtgcatattttttcgaatatatattttttggcttacaaatatataactgttcgttattatgaatcattacaggttaaaaaatcactcccgatcatcactaaaagatttattaaacggttatactccagccattaattccaaaatatgacttattcatattcatagctaaaggtagctatattttaggttgcaagaaatgattagtctatctagtcattaaccttatgtctccaacgatggtttaactgttcgagattactgtacttaattaattgaccgttagagattggcatttgtatggtattgctcgatcctctcgtaagacatttgactagatgtgttctcatgatcaatcctacaagtacggaaatttggtttgaaatgatcgagcgtatgctttctaccctatgcccatctctggttctgtctcttagctgatatataaagtggaatctaaactaaacaaaagtacaaaactggtaagggagtcgattacatggtgattgcaatcataccatcggggtgccctaaaatttttacactggtaattggtgttggtattgcaatcaattatcaatttcgttacgtagaacaggaaatagagattggaattggtattgcagataattgtgcttatcaaaaaggttgtcactggattttttttagttactagctaaaggccatgcgttgtaatggatattataagagataaaaaaacaaaagtaaagggaaaaaatacaagtttagtagtggatattaaaagagataaaaaaaacaaaagtaaagggaaaaaagtacaagtttatagcatagggagatgattaggcatatgatgccgcatcatatccaaagcaaaagcatgtacatgtggggacgttatggcgccacatgtcagcttgtgacgttggaggtaggctcgaacgccaccactagcattatttaaggtaatatagatacacctagcttttatcattcattgagttcaacaaactttatgtatatttaaagaaacaaatatatctagagacataaacactagtactacagatttggacatctatgatgggtcatctgagatgggccgaaaagtatcccatttaaaatatggctactggggagggcctgtcatagatgcgacgtcatctgtgatgggatagttgtaacccattacagatgatctatgacgggtcacaaccaaggctcgtcataggacatgccatctgtgacgggtgtagtgttatgaaccatcgtagatgagatcactcatctctgatgggtcttaattgccttatgtactggtggtagttacgatcagtcatttccaaacaaaatcccggatagagatatgccttatatataagttgtagttctggatgatatctacaactttataactaaatgtttttattagagatcgtttacatccccaaatatgtattacagtgatgagatctattttgaagaacaatatttcaaaaatttcaaattacctcggatggaaaatgccccatatcaaagtcatagagctcaaccagatgtacaccattataattgacgatattttcatttaaatagtttgcatgcccgaatattgattataagttgagatctatcctaaaaacgaaaatttgaattcttcaaacgatttcagacgatgatattccctatgtaaaagttttagaacacaatgaaatctcaaatgttttagttggttacatttccatttgaagtcatttagagtgttaaatgtatgttacatacttcatataggaataattaaaagaataatattgaaaaagtaaatcacatgtgctctacaagtgggttggtaagtgaggtttgtgtagagagggagatcctgagttccaaacttgacacatatatgcttgtctatattgttagcaacacatttttttttctaattttacaaaattagaaccgtgccactactgtcatttttccacccatctccttgattttccatcttcttccttcttactctcatcctcttctctcccctccagatcgccggcgaagagagcaaaccaagaaaaccagatcaccggctaataccgcctcgatttcaccgtgacccagcatcgctccccattgcggagcttggaggaggagggcgccacatcgtcgggccggcgcaacaatagcaggagggccctcatcgtgcgtggcactgcggatgatgcgtgcaatgtggcctagggaggagatgtatgcaatacttctttgcctggagcatccagggtcgatgtgatggcgacgaccatgttgctgtgcggtggcagtgtaggttgcggcgtccccggcgcggggcgccgccaatttcttcgattttcttttttcttcattttttctttctcttttcttcgatttcttctttcctttttctgtggcttcgcacagtcggcggcgtgatgcggacgaagccgggtgacggtggcgtggcccaacgagggcacggcaaggtcgggcggcagcggcgcgaccttgcggtggctggcgaggtgcggatggcggtagggcatggccgcgcgaaggtgacatggccctgcggtggccggtgagggccggcgcaacaagccgaggacggctcgccgcagcagcccgaggccgacgcggcgtggcttggcggtcgggcgcccccgcagttggccgcgaggcaaccatgctggcgcgatgcggatggccggcaccggcgccccaggcgttcaacgacgcgatggtaggcggcgcggcagccaagctcatgtgtggcgtaggcgaccgacgttgcctctcctacttttccccttttcatttttttgttctttttcttcgaccagataaaaaccagatgaagacgggagaaagaaggaagagatggaaaaagaaggagattgatggaaaagatgacggcagtggcatggttctaaatttgcaaaattccagtggcacagctacgaatagaagaattgtaatgacatttttctgaatagtcaaatttgcaatggcatagatccaattaaccctatttgtatttgggttgattttttcttttaattgttcctagtgctattgttaacaaattaatatttttattttggatgttttttctttcagttgttcctagtgctattgtggacaaattaatatgtgaaagtaagtggcttggctaggtgtttattttggatattttttctttcagttgttcctagtgctactgtgaataaattaatatgtgaatgtggcacggctaggtgtttattttggatgttttatctttcagttgttcgtagtgctattgtgaacaaattaatatggctaggcatgctacgttagtgttgacggaaaacacggttgcctacgagatttgcttcactccagtgcaggttcaaagcgtgtctcaaatgtcaagagcgtgccagctggtttgatcttgcaaccagcaagaaagacaaaacaaacgtaacgtaattagatgaacgataaccgatcggccgatagggctgatgacgtatcattaggacctacccaatatgggtaaacctaatcggctgtgtctttaggatagtcagttaaaagtaaaaccctaaatatgccctatctgttgtaatgccgtctctaaagtatttatgaatcactttaagacaatattatagaaatagctatcagggttatggatgccacatacccgatagtaatcgactaagctcggcagggcccaccacatactgtcagggttatggataccacataatagtagttgactaaatctcggcaggacccaccacataccatgtcttatacggaaacaaccttcggatataggaggagttccgcataaggaaggatgaatagagttctacatggaaacgacaaggactactcgtattgtatccatattggtctctctagttctacttggacaaggagacacctataggtataaatacaagaccccctaggaggagaagggagacggaacaatagatcaagacacaatatcaacatacaagccaacacacgccaagacaagccgctggatatcgacatcagagatatgcctgggccaaccctatccggtacctacagatgccggctgtagggatctagcgttgtctctgatctcgccgggcacaaactcgaggaggaagactaccctgttgtcgactacgggatggtttcacggccgccctgtcgacaacagttagataggctaccccaaatattgtactggtgtgattatggtgaataagagcaactaccggcttcggccaacaggagtaaggttattacctgacaattcaggggcccgaacctgtataaaaatcctcgtcttcgtctcttttacctaagtctcgcatatatcctagtaccaacgatccctatactatgcaaataccggaatcgcaacatcaaacatcgacaatagccgatggatcagtacttacagcaaaagtagataatgtactggctaatactctaatacagacttatatgaacaaatcaatctatataaatatattagatagcaatcgatcaccatatatgaagtttaagcaagatcaatctaacttgatgtacttatataaagcaatctatctatataagtggcaaatatatacgtaaacagatcatgaaacatgtactatcgtttatattaggaaagatcagccgaaaccccaatactatccttaattatgattaattccaggttagtttttagattctaagcacgactaaggttgatgcataagtatgcaaagaagcataaagtctaaacaatcaagtaattaaccactttttaggatggtgggtatcttagctaatctaatctagtaaagtaatttagtcgataccggcataaactctaaagtgagaatcagccgatatgactaaattgaaatactaagactagattaactaagatatatgatagcaatggtcacgataaaagaactaatacttctaaagtgacataatagccccgatagcgcaggtcgttacctcttgtcgagagatcgcagccgatgccccgactggaagcaaaaacttgtcgaaaagtaaaggaaagggtggcgatgcgtcgaaagttgtattgattggattgtctcccttattacaatggtttggggtttatatttatatcctgagtacaaaacttgtccattatgggcacgattcaaactttcctaaagataaaatactaacaagtcctcacagcggactcttaccaaatctctaactcaaaactgacataaatatcctaattaatagatacaattaccttaaacgagctctgtctctaaacggcaatgacagatatctaaatcaaggcccataccgagtctacgtcaggctatatcgaatgcttgccatatcagctcaatcagacttcgactctgtttcccgccgatgcgcaatccgtatttggcaagattcaatattcttcgattcctctttgatatccaactctaaatccgagtctatcttgccaaatttcactgccaacagttatacacaatttcattcagatgaagaaaatggagaacatataaatgccatacctaatctataatagcttttccagctttcctggtatcagtgtacacctatgattctttggcctctttcgctttaacataaatgattacccaaatagaccaaccatctaccaaagtatgttgacaagatggcaactcaatcataaccgtatagatccataaaaatttttgattatctatcaaataatgcaaaggtgaactattggcttgggtggtttcccattgagacttgaacaggtgttgaggcgaatttcgcataaacacacgaaggcctaagagatttgtttagctctagtgcatgttttaaaattgggtttagagcaatgcaattagtttgatcctgcaactaataacaagatagaaataaaagatagatcatggagtcgattagctatagggccaatatagtacctctgcctagttgtagacgatgaaatttcggatcaacggctataaccgatggaatattaataaacataagaaaaaatatattagccaaaacttgacattataatttccaatgatttgtctttagtaaagtcaatcttgataaagccgatgcattgaaataactgtcaataacttcaataaacaatttaatgaatcatcataagtcgctatcaaataaaagacaatcgttaggaatatttccttatcaatcataatcttgataggttggacataaccgaggcaatataagattaaaaataataaagataatcgctaattgattgtattagatttgataactaaccgatggagtagattgattattgataaaaggataatttaccaataaaacaacgaataatatctatcgatttgagcaaatctgtcttaataaaatatgacctgataaattggacataaccgagatagtataaagtcaatattgaacctgatagatttaaacaagccaatagatactgaagaaggtgattgatatattgattctaactaagacagcaaatccattgaagaaagaaccgatatatctgataggcgacgtgtgcacagaccaaattagtatattggacttaagaaagtattagccggaccgatacaatcatacaagcaaaatagatgaaacttacttttttgccaaagatcgaaacagatgcagcccaaacacgaaaatagggtggcgatgcaccgaaacttgtatatttacaaaacccaaggcaaacatatttataccctcagattagaaaagagtccaactcaaacacgactcgatcggctaaaaggaaactgagtgcaatttacatacgacacaattggtttagaattctatctgtagaaggaaattaaaacattccttaatacagaagttgatataaaatctgcgaaactatatctgatacgcttcccaaccgaatccactacaatcatggcgtcaatttcgcctttgacttgatcttgactaacgacaattaccaattctaccgtcaacaagtagtaggagcaattggcatattcggctaactgcaaatgccatgcattgcggcgattataacaacacagtgcatcctacattgatttcccctaatatcaaatgatagaacttacgagcgaagcaagataggaaaatagtgtagctctaggctccaagccatccatctacttcttgataatattaaacttgtctacattaaaagtttgttgctatatagtgcccatcaacgcaaacggtagttagaaatgagaaatgtatgattgtaacttctatgcatatgcaagtccaaatgcgtatgatatgcatgcatttgtcctttccaagaacaactgcatactcatgccttcacagatatctgctgaacattagttgcttgtaattttaccttatctgttgctcacttgcaattgattttactctgtaacttggaagtatattacttcctccgtttcataatataagtcattttagcattatccacattcatatagatgttaatgaatctagacatatgctatatctagattcattaacatcgctatgtctagattcattaacatctatatgaatgtggacaatactagaatgacttacattgtgaaacggaggaagtaatatctactccctccatttaaggttataagatgttttaactttgatcaaagtcaaactatttcaagtttgactaagtttatagacaaatatagtaatatttataatactaaattagtttcatcaaatcaataattgaatatattttcataataaatttgttttgggttgaaaatgttactacttttttctataaacttagtcaaacttaaagcagtttgactttgaccaaagtcaaaacgtcttataacctgaaacggaggacgtagcaaacaacttagcttatctcttaacagcactgcagcggcaaaacaactttcaaaattttcagcaattcagaacagaacctaaaccagcaaataaccagaccaatcatcagtgcagtacttcatgcccacgttaaatctcctgcgcacgtaaaacggagcggtttattagcacgttattaattaagtattaactaattgtttttaaaaattggattaatatgattttttaaagcaactttcgtatagaatatttttttcaaagaacgcactgtttaaccgtctgaaaaaggagagaggtgaattgggaaagttagggaaagaactcagccttaatagcagcatctcacatgaaggaaatattacgcaccaaagtacattgactcacaaacacaccgcacacgcctgcaatccgtaacactagtcttccacttccaccgggtgctggacaacacgatctgaagaagtgattccaacgagaagcaagagcgtacccagatggataattggatacccggtcaatgccatttctgcgatttcatctcaattaaacaattcccacattgttttctttggtgaggcctattcccactagtgagaacccatctcggtttgcaatccctttagtcctgggttgcaaatcgggatgtctaattcgggactgaagatacccatctttataactgggactaaagatctatttttagtaccagccaggactaaaggtattttttaattgttttttgttgcttgcatattgcccaaatccgcacatcaaattgacatcacagataaaatgcggaatgcctgcctcctcccgcacgccaccaacaaccaccgcccgccgcccactgctgacgccaccgacggagaaggggggggaggagaggagaggggagggtgctgccgccgcttgccacccgctgccgcctgccgctgcccactgccgacgccgccgacgatggagaggggaaggggaggaaagcgaggagaggggaggggaggggggaggagtggaagagccgtgaagtggataagtggaggaggcgtgcggctgcgtgaggaaataaggacgacgaggaaatagttaaaaaataagttgaggagataaggacgggtggggaggcgtgcggctcagtgcgctgttccggattttttcaacttttgacccagttggtataaacaatagggactaaatattgacaccaaccgggactaaagatagtgggggtgtgacattcgcctaacgactttttaaactgagacttaaaatgtaccaactgggactaaagattataaagtgttattaggttttgaactggggctacagatcttatttattcccggttcctattcaaaccgggacaaatgtgatttttgccatccggataaagatctgttctccagtactgttcacactcaaaaatttcaaaatgctgaaaactcaatgtacatatgcaaaatttgctcaaatactccactaaaactagcattttagtttaaaaattacaaaaatacaacacaaatagtctaatgggtcatgcctatagagtgagtctggctcgaatttaagtagggaggtcattttgggtcaaaattaagggtgatccaggacctgtatcaggggcggagcttgattagggggtgcccaggaacccggtcaagaaaattttttagctatacctcatctattttcaccatgtacgcacccccctcaatacaaacttaggcatccgcatcagcttaaagtcgatttaaagtagagtaaattaagcaagtgacaccatcctccatttcgctctagctccgcccccgtatcactcctgaaccccccatgctatctctgttcatccctacacgacgccagtgcaccaccagcatcccaccccacacacgtcctcacgccgttggacttctttaaccgatgtcgagggctagcgtgacatcgagcctgtgctcctcgcttccacccacggtcatggatcgagctcaagggcaaggaggcagagcgaggagagcgagctcgtcttggtgcttcgacaacgaccatcctggcgacatgctggttggggacgaccactggatgccctgctcatgtctcttgatctctgtttgtgcagcacgaaggggcgtcgaaggaggcctgacggacaaggccgtcggcgatgcagaggttggaggaattgttctccgcttcttcttgtgattcaaaccatggggctaaggggaatttcatccattgaagtggtaaaagaggcaaaatcaagccaatgaattaaaaaagggacgggttcgtttgaaagatcgttcagctttagcatttttgctgcgcgaaacaaaaaaaaataccagtattaactattataaacttttttataagaaaaaaaactatataaaaaatgttttataaaaacatattatttaccagtttgaaaacatagtaacaataaacaaggaaaggaagaagggcaactgtttattactacttccgtcccaaaatataagaatttttaaaattggacataattattaagaaaataggtagaattaaatggaggagagattgtgtttagttaagaagtgaaggtagacgagaaaagtgaatgatagagttgtgattagtttggaagaggatgttaggaagaagtcgttatatttttagacaagttctgagtgatagaagttattatattttatgatgaatgaagtatgagatgtagtagagacattgcaggtttacgtttcagtggaagctagcccctgttggcaaaatacttcgacttgtttgacaactcgagcgaagaggattggaagtttacatgaggagattgatggtgagattaagatgtgaatttgatttttaatcccaatatcttgtttagtagatatggtgaaaattgatagggagtttaatttgagattatgtcattaatgaaaaatggatgcttgggatttatttaggcagagtaaaggatgaattccctcttaattaccacctctattcaggtattgaaaaggagggagtctacagagtggcggatctaggaacttttatgagtctggacaagcctaacgatagagaaggacaattaactccatacaaccacgtgcatgatttaggatagatcaagttctaatttatttttttttgaagagaatcgacttctaatttatgaagaagagaagcgatgcgcaaaattatatcgatgaaatgtaactcgttaattgttaatgttgaataactagacagttatatatatagttagtcattttgctactttatgtgctgattaactgatctgacattcattagaactagttaattaaacacgtaatttgctacgggtagtattttactcaattgtatgcgacaggctaaccgagactggctctgccgctggagaaaattgatggtgagattaagaagagaatttaatttttaattctaatatcttgtctactagaggtggtgaaaattgaatgggagtttaatttgagattagattattaatgaaaaaatattattgagatttatttggacaaaataaaggatgaattatctcctaattaccaccccttctcaattctccatcctcattccccgcggcagcggcaggctcaatgccttctcgcatcgattcttgatcccaaggagatggtcaaggggagaagcggcgcttctcgattcgacggcgacgaccttggaggagggaggaacggcggcgcttcttgatccaacggcgacaaggcatggggggagcaggcgcaggagggttacctcttgtcgatcttggcctgacgctgacggcggccatgggtagagccgtagaggtggcctcctgcccgccggacgctgtgctccttctcccccgcatcgaacagtgaactgtgaggtgtccttgttgcctggaatactttggctatttcttattcccttggttccaaccaagaatttgattcacttttttttttttgtgctgctctcggttcgatttgcaggcacaaatgtgagcatcagactggatggccaacatttagggtgactccactccagagcgctgcttgatccatcttctgctttcattgttactatttctttgcttccaaaccacatatgcattcagggtgactgaccgaatccaatgccattgatttcttttgtcctctgtccaccaatcttcgaaattttgtctggctagcagggaaagcgagcaggcaggttcagtggtcagtgcagagagagcaaccctgcagctattgattcagtgcagagagaacccagcaccagttcgcgaaaaaaagaacccagcaccaaagctgcaatgattcagcagctgcagctgttgattcaatgcagagagaatccatcaccacatctgatcgcagaagatgcagatgcggttctgcagacgatcagccgccagcaaaacaaacgccagcgaaggaccagccacatcaagttcaacgatctccaaattgacatgcaacacaacaaaagctgattagaccatgggagaggtgcaaactggtgtgcaacaacaaaaccttattcgaccattgaacaggtgctcgtgtgcggagcgtgcgctgaattctcctgaagtgaaggctaccagcgccgtattggcacatcagggatatcaacttctacaacaaaaactgctcattagttcccagatgcaggggtattccaaaatggcctcttaatttgatccatcttatgtccagtggtgcctcagctaccattctttgggaatggatcttgttaggcaccaaaaactccaatggggaggcaccactttttgtaagcaaaatgttaatatattgtccaactagtaataactataatgataaccccatgataccatgctatggacaacttcatttcaaaaggtaagagtatggaataaagctgagtggtgagttaagtatatggactgaatgggacagctattagtggccccttttcttttttattttaattttcttttttgtccttttggcacaacaatggaacatcctgggtaccttttagtaatttcccagaaggttagctgagcacttgtgcgtggatgcagcgtatggccccaaaagtgagttgagccccttcttctacataaggaaagaactaactgaaatttggggctgtactcttctaaatttcagttagcgctcttcgtttaatttttgggagacgaaatttgtactctatctggaactagcgcatctgcactctctttcctgtgatcctatctaatctctattcatattgatctaacatttttttgaacaaacatgtgattgctttgctcataaaagacatcaagaagagcaagatcaagaagaggagctagctaggtagtctgatcattgggtagaaagatttgtgaaacaaattaaggacccaggtacgtgatccaattatttcccttctttactccagcttggtatgtttggagtatcagatatactacaattgtcagcagaaactgttattttccaattgtagacaaagtctgcatgttgcaatttcttgtgttcttggtcgattttatactgtactagtaagcttagaacaaaatttcaaactgtgcttgctgtcttacatgtttctttcactacgactagtcgaacttccagagaaattatgtgcctatttgagatatagttgtatgaaatacaattatacatttagatgtccaggcagactgcatgttgtagccttttgtgttgctcttcagttttgtactagacaagtaatgttagaacaagatttcaaaattgtgtgttttgtcttgcatgttgctttaaccaaaactagtcgaatttcctgagaaatcatgtgccttcaaccactagatacagtagacccggcataatttgctagactttaaaagcaaattgttttttgaatggtagatagataggtgttaggtttgccttcaaccactagatacagtaaatctagcttttccatgatgcatctctggaactcttaacagtttagcacttatgatcatgcagcagtgctcaatctggctatggacaaggtcgtcggaatattgaggggagtagctggtgttgctgctgacgccaatgcattccgtgaattcttccactgggtcacaccacacgtcttagctgccgtacgttctcaacagcagcagcagctgctgcaactggattcaggagggccagtatcagcatcaactggaaacaacagaacagctccactgcatcagattcaggatgatcttcagaaactcgagcacaacctttgggtgatccaaacaactattacatccacgatgcatgatctcatcgaccgccttgagtggcatagccacagggaaacagaagccaggcaccttcgccagatcaaggatgcagtgtacgatgccgaggacctccttgatgagtacaattactatgctcttaaggtgaaagtggaggcgagcaagaacttggggcaagatcactcacatggacccgttttagagttcttggacagtgtcaacttcaatggcaacttcagcaaagtgatggaaatccaagacagactgaagcatgttttcgaccaatccatgggtttaggcttgcacaaaacacccaagaagtttgatcgattagtcaggccagagacatgccgtgtccttgatgagtcacagatatttggtcgtgagcaagaactgaaggagttgatgcaaatgctaggagtagatggacacaagagaggcaggcctgcagcacacactaacactactgaagcaagaaggatggagttgcctgtgttgccaatagttggcatgggaggtgtcggcaagacaactatggcccaacaaatctgtgaggatccagaggtgcgcaaacattttcatcaccgcataatctggatatgtgtctcagatgaatttgaggtaaacaggttaacaaaagatgctctgaagtctcttggagtcaagtcagaagataccgatacaagggataatcttatggttaatttacgtgatagtgtcaagtcaaagaagtttttgctcgtccttgatgacatgtgggatgatgtcttaaaggatgagaaaggatggagaacatttcatagaactttaagcaatggtcttgatggcagtatgattttggtcaccactagatcttccaaggttgctaacttagtcagcgacggtaatcactatgagctgaaaggattgcaagatggggttttctggaatttcttcaaactatgtgcatttggatctgtccagagttggagcaacaggccagagttgcagcgcattcgtccagaattggagcgcattggtagagctatacttcccaagttgaagggttcacctttggctgccaaaactcttggacgattgttgaaatgcaaccgaagcatagagcactgggaagacatattgaaaagagctgtggcgattagaacaagaggagactgacattttgccggcccttcgactaagctatgcgtacctgccgcagtacatgaaagaatgcttctcaatctgtgctatatatccaaaggatcacatatttcaaaaggaatttttagcagacatttgggtagcacaagggtatgtggagcctcaagatgcatcctcttgctttgatgaccttgtaaaccgatccttctttcagcaagcagcccaccaatatgataatcagtatgtaattcatgatttgctacatgatacagcacaactagtctctaaggatgagcgcttcatcatacaacatgtaagtgacctagctaaaatccctccaaaggtacgtcatctatcaatattcactaatggaaatatcagatgttcagatttactgtatatttgcgcacaaaataaaaaattgcgttccctagtatgcaatgattcttacataaattgggaaccttttgctcccatgattgacggttggttcaatgaacttttgaatatccgtgtattgagttttgatctttcgactgtcagaaagctacctgagagcataggcaactcaatacatttgcgctaccttggtttattaggaaattctacttttgagacccttccttcatctgttagctgcctgtatcatgtccagactataaatgccaagggttgtgttttcaaaagatatcctcaaggttttagtgatcttatttccttaaagaaaattgaatcaaagggcttcatatataataaggataaagataagcaatgcctaaggtggcccataatgcgaacacctgacaggggcgaagccagaacaaggctgagccccccctatgctccaaacctggctctgccactgacacctgaagaacagttacagatgacagaggagcagattgaattgttacctcattggaaccttcagcatttgacaatagagtattacctgggtcaatcttgccccagttggctccggccagactgcctgaaaatgctgacttcacttaaactttcttattgcaagaacattcagagcatatcattctttgacccactctttcctgattcggaagattcaaagaacatttgtcaccttgaggtgttggatatccaacattgtcctaacatcaattggcaaggtttggtggctttaccttcttctcttagaaagattatccttggaaactttggccattcgacggatcactttgtgagttgcttttgtggcctcgctctcctgaaatgtctgcaaatacagtgtgaattcttaatgtctattcccctgcaagtttgtaaaaataatcttcaagccttggaggatttgcatatttatcagtgtagctccctcacatccatctatgtctcagaggcaagcagcaggcaccctgttggagtattttcatccctttcaagtgtcaccatttctctttgcaatgcactgttgagtcttgatgagttcctgatgcctgcttatatgcccgtcgtgaagaccattcttgtggaaagttgtcgacaattagcattactgccgattgatgagcttcatcgcttttcttgcttggaggtgctacgtattgaatcatgtcccaatttgaatacacggaggataatgacattaccatcctctcttcggaagctcagtttactcggttgtccaagcatagagttcatcgacaacagccatctggcgagttctgtgacactcaagggactcaacctgaaacttgttagctgtccagacctcatctctattgttggtgctatatctatctctgaaatacagtcgggttatatacatgattgccccaagctgatggagatgacacagcctttcacaagaggtcgctactggtacgtgctaaggaatcacacttgatagctcttttttttttctgttaaaactggttatcttcatctatcatagagtaatctcattaactttttgataattttttttgtatgaaatatttttaagctcacagcaaattgtcatgctagaagtgctctgcttccatatcataaattgtgttgtacttatttataacatctagagttctagactcgaccaaatctcataattggtattacagttagtcgtattttcatcaactgtggcaaacagaccggtttccgctggctgtcaagtccacaataagccgatactagctttttggagacttcacttttacaatactatgtcgtagaatactaatttgtttagatttagttatgctctaggaaaagaaagctgaaatgaagtacgagttgtactatttatattcattggatttgatagttcattgttgttaatggtttcagatgatttcaagataatgtcgagtgttcaagatgatttcagatgcaaacagcacagaacatgccagcataagttatgttggggatcagggagaatcatctcggcaaactctacatcattcacttatatcataatgtttgaagtttagtaataaactttgttattatatataggagagagccaaaagaaagtgcagactaatcagaccatgggtattggctaggagatgagaatctcaagagctgaatttgtgggtgtacaattgtgtattttactggatgataccccatgcattggtgtggagatttacgtgaaagactattatatatagagggacaaactttataaaaatataacggtatcatgatgaataactttgaatcactctattaaattttgtaggatgcagttttatttcagcccacggtggcttttgttgtgtgttggtcttagtagaattgtatcagggaactatagcctacgtacataaccgaagtatcttaaaactgctgagatgaaatctgtatgcaatggctcatgtattcttgataatgatatggcgtgctttatctaaaggctcctttatagtgttaattgcagttagtggatcagacaattatataggaagaaaggattacggtgttagaaaaaagaactctttatctctgttactgagcaattgatgtggagcacttagaagttggcagtgtagattttgatgtattgcctgtcagagctcgtcagtatgcaaatattagattgaactgaaatttgccaaaagggtttatattaagctgtaaggtgagagacatcagtaaagatggccatcattcatgggctgtggatgataacgaggagcatctggctccttttctgccgatgcgtttgctctacttgttgtcagtgctctattgtcttgaaatggcgtccgttgaaacactaccacatgacaacatcatttagaaatagagtaaatttcaaaataactcaggttgtaaggcatatgcatatgtaaagagacaattgcttatgggactagagagagtacatgacaacaataagcaaaacatacaccctccgttctaacatttatctagattcatctgcataagttattttttattagacgaagggagtgcatgacaacaacatttactcatttagaggttgtgtggccgaaagatttatctatttgtcactataagaaacggtcattctccaaatgctactattaaaattatcattacatttttttacactggagtgaggagaatgttttttttttttgctactttcgcatatatgggtgtgccaacgggggaataagtacactttgactccctcaaatatacaatcaatttaatttctatccctcaatcacaatagcaaatatcttaaacccttacggccttaactattaaaactggtgcaaaataactttctcggtggttataaagttggttttcattggcatgactcgttgatctagtccaatcgctgagtcggcatgtatggacccacatgtcatcatctctctccttcccttcttcctcctccccctctctctcccttctctccatgttcccatccctactccaacagcggcactgccgtgctgtggtgtcaacgacgaggccaccccgtcatcggtttcactttccctggtgccgctgcgcaaggtcgccctagtgaccggcatcacaaggtaggacgggagctacctaatggagcttctgttccggaagggctacgaggtgcgcgcgacggctctaccacatctaacatgacccacacacacaatcatcgatgccacgctagtagatgcacctccactacgccgacatctctaactcctcgtcgctccgttgcgtgcttgatcacatcctcctcgacgaggtctacaacctcaccgcgcagtgccatgtcgcgttgtccttcgaggtgcccgactacaccgccgacgtcacagccacgagcgcgctctgcctcctcgaggccgtccacctcgcccacaagcccattcgctactaccaggcggtcccctccgagatgttcggctccacgccaccactacaaagtgagtcctcccccttccacccatggtcccctacaccgtcgccaattcgccgccctctagtacgccatcaactaccacgaggcttacagcatgtttgcctggcagcagcgtactcttcaaccatgagtcctcacgccatggcgagaacttcagactaacattaccggcgccgtcggccgcatcaaggttggactcaccaaggtcttcctcagcaatctctctgtcaccagggacttgggcttcttcggggactaagtcaaagcaatgtggcatatgttgtagcaggaccagcacagcgactacgtcgtagccaccaaggagtcccacaccgtcaaggaattcctcttggccatcttccccagtagcagctccgtcaggtggctcctgtcatgcctcgtgatgctggtcaccaaggcgaccttccacgatggcaccagggaatgcagcatcaatggctggggtggcctcattgttgtcagcaccaccgttgtccactgttagagtggggtggggacagggagatataagggagagaggggagtagaaagaatggaaaaagagagaaaggatgacatgtgggcccacacatgctgacaacgaatggattaggtcaacaagccacatcaacataaacctcactcaaaaccaccgaggaagtcatttgcaccggttttaatggtcgagggtttaagatatctggtattgcgattgagggataggaattatagaatccagatcctctgacgtagcgcttggacaccgcatcgaacgaaagcgcggagtgtggcagccaaactggctcgcgctcggcccaaatcagcaaaatagcaaaatcggcatcggtcattcgctcccaattcctcaaggccgtcagccggtgaccgctcctcgtcgtctcctccggcccaagcgctggtggagcggatcctgcaggaagcacctcccctcgttgtcagccacctccccgtcaatcgcctcctcgcgcctcttgagagccctgcttcatccgggggatctgcctcgtctgggtctacctcgacgacgatggcttccacggcggagcacttcaccaccacccacatcagagcagtgagaccagtgacaggggtcgcgctgccacgataccacatccgttgctgccatgaccgcagcactgccgccacaacgatgaccaccatcaccacgggcttttggaggaaggcaacagttgcttgagaagcctagttgcgattgtaaattgatgtgaatgcggcaattggatgtcttctttactgattccagactgattaatttgtccaattgagaatgttctattatgcaatttgagatcagtacatacaaacttggcatatatgcatagagacttgcatactacttgcttttgcttgcaaaatggcaaaagatagctgtttgtactccacccgcacctgagccagactggacgggacaacgagcgaccgccggccgatggccacgaggaattaggagagatccaagattttgctggcaaattaaggaaacgagctctttcttctaacggaccgtgctatttcgctgatttgggccgagcacaagccagttttgctggctcactccgtgcgttcgtccaatgcggaatggacgacgtagacgtccatctgacgtcacgagtgatctggatccaaattatactggatgtatatttgagggactcaaaatggacttattctgccaacatgtactgtcaacacaaaaggtccattttgcctcttgtaggtagggatgaaaacggtacggaaacggacggaaaccatctttatcgttttcgttttcatatttttttcggaatcgaaaagcccggatacgaaaatggaatcgaatattatcgaaaccgaaaacggagcgaaaacgaagtggcacaaatacggtaacgaaaatttatcggaatacagaaacccctcaaactgataaatccaattctcaagtctcaacggtcaacaattcatcgtaaaacacaatcatataaatccaattgttaagtctaaacaatatatcacaaaacacaatctatgaaataaattatctatgtttaagagagtaatgttgttgataaatcccaacgcagaaaaaaaatattcttatgtaacttcatatttacataacaaatatttttttaaaaaaaataaaagccaaacaccatcgtattcagtacttaaaaaaagaattcaaagtatttcagtcacaaaatttccggaaattccgagaaaatttctagaaagtttctaactgattccggaaactacccttatcattttcgattccgtttccgagaaaatatttccgaatttgttctatttccgaaaaattccgaccgataaattccattttcgaaaataggtccaaaatacggaaagtttccgtaccgttttcgccactactcgtggcatgttagagaacaagctccatctccacttttcccctctagtactgatgttgttgctgacctgatggctattttttttcttctattttatctctcccatgggagcggcggagcttctcgatccgacggcgacagtcatggggagcagcaggcttcacggccatggctacctcggttggggtggctggctggctccctgcctcgatccctggccgccgggcactgctcctcctcctcggctccccaccacgaacaggactgaggtgtggttgctagctaatgctgcttgaactactttggttttttgtttttgttgtcccccttgttccaaccgaagaaatttgcgttttattggtgttcggttgctccagtgtacaaatccaaccaaatatcattctttgcctctctcgatttgtttccaggcacactggagatggactacgaacatcagactgtatagatgacgtgagagagtcaataatctagacagactgagtattcaaattcgtagtactagaatatatcatatctcttttaaatcctttatatggtcatgttattttctccaataagagttatatgaagattaagatttttgtggcacgtatttcaaactgttaaacggtgcgtaaaaactttctatatgaaaattactctaaaatatgatattaatctatttttcaaatttttagtaattaaaactcaatcaattgtacgctaataccacgttgttttgcgtaaaaaacttaactttcataggaaaaagaccccatctatatatggaac

SEQ ID NO: 14628 - DNA, 743 bp, Oryza sativa
  unsure (1)..(743): unsure at all n locations
tggtcggacgagcaccaccaggcgacgcggcgtctcggcgacggcgaggcggccggccagcgggtaaaagcgggccagcgcgcgggcgaacgacgagacaaggtgttcgacgacgtgctcacctccgccgggaggcttgggcaggacgacgcccttctggacgtagtcgccggtgatcatccggagatccaacggcgtgaggtggtgcaccgtctcgtgctccggcagctcgccggcgtgctccgccgccggccggaccatgcgccgcgacacgatgtggacgccgccttccattctcgactagctctcgagctcagtcgactaatggtgcgtacgtgttcgatgaacaagatcgagttttaggcattgaatatttatatttttttttataaagcatatggcatatcactccgcgaatatacagctttaaatttagctttaacaaacataaccatgtatacggatacttagttagagttttgttacagctggtagaaatccaatttaattatacgtatctgtgaactgatatatctcatattttttataatatattttttatatctagataaaatgcaagaaaacgagaggatgcttgatggggaaaaatccatatacgatgtacagctgtatacgatttgtgtggtttttgaaaaacaaacgagtacattcatgaatgaatgaattgataaagggcatccgaggnnnnnnnnnnnnnnnnnnnnnnnnnnnnnnnnnnnnnn

SEQ ID NO: 14629 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnagcgaattcaatatcatgtcaggaatgaatattatgtttcgatgttaggtaattttatagaaggtattaagaagtaccaaattttgaaatataaaatttgatatcttcagatactccaaaaaacttagtgtaaagtttagatatctcgagttacttttgaagaccgtatatttgaggaagggctggtgtgtgtaccaagaggctgaagccggtgacgccggcgaaggaggtggcgatggaggcgctggagagctcgagctcgccgaggtggccgacgaacatgacggagatcatctgcaccacgttctgcagcagccacccggcgatgagcggcccggcgaggtacagctgcttcctcacctcggccaccaccgctagcctcgagctcccttctttcttctcctcgccattgccggcttcaagaagaggctcctccatgcttggtggcgccgncatggccacgcccccccaagcttagcttcttgctctgttctaacttcaaacagaaagatgagtgtgtttacaattacagatgaggtgaactacttacctgagggtgtgaagcacagcaaatcagtcaataatctgacaaagccttaatagggctttgcgataaattggagggaactgcgaggaaacgatgcacactaactt

SEQ ID NO: 14630 - DNA, 698 bp, Oryza sativa
  unsure (1)..(698): unsure at all n locations
nnnnnnnnnnnnnnnnnnnnnnnnnnnnnnnnnnnnnnnnnnnnnnnnnnnnnnncatgtcctcactctgtttcagcttagccatgtccccactctgtttcatcttctgtaacttgtaactaaccaaaaacatccgctctccttttgcagggcgtcttcatcaatcctgctcttgttgagcctttcggtctcaccctgatcgaggtcttctcatagttcaattctctgacaaccacctgattattattctttcatgtacagcttaactgacaaactcatggcatttatttaggctgcggctcacggtctcccgatcgtcgccaccaagaacggcggtccggttgacattaaaaatgtaagcatccatcctcgccaaatcttgtgtacaaccgcaatatttgtgcaaagaattcatatccgtgtgcgtattcatggtgtttgcaggctctgaacaatggactgctggtagacccgcatgaccagcacgccattgccgacgcgctgctgaagctggtggcggacaagaacctgtggcaggagtgccggaagaacggcctgcgcaacatccagctctactcgtggccggagcattgccggacatacctcaccaggatagccggatgccggatcaggaacccgcgcttgctgatggacacgccggcggacgcggccgccaggaagaggaaaccctggaggac

SEQ ID NO: 14631 - DNA, 723 bp, Oryza sativa
aagctgtacttcatgctattaatggatcatgtgtgaagacaataatttacatgaacccaacccacacaaacacatgcagagcagaccaatcatggctcaatataatatggaaagactaatatggttagatttgcaaatgattgcatgccaattatttctgcatttgtggaattgttttatgtgcttcagaaaaaagaatatataccctaataaaaaaaagaatctaatgtcttacttattgtaacagcatctttggactatatgcctttgcgctttgtaggtagttcatcttttccaaatgcactgctaggtctttaccctgttactaaatgagtgttattgttttttcttcaaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatc

SEQ ID NO: 14632 - DNA, 1226 bp, Oryza sativa
acacgtgccagggtgtggcccccccgggttttgaggagttcggggctctctggactggactgttgcgggtgtgggcccgcatgccagtgggagagattgtgtaagtcggtgggccatggggcccacggtggtctcgtgctcgcgccgcggttgatcttttcgggatgatccgagccgtccgtgcgtcatccggtggttacaaactgaaagatatccgtcagggcgcaaataaaaaggatattccgcttttcgtcgatctctaatttgttatcccaatgtagtacttgcagtaccaaattaaggcattggttaattcactcgttttctcaacaaacttcgttttattatctaattattttcccaaaacactattatgaacgttcaaaaacacacgtgtccattatctttaaaaaaaacacacgtatatatgcacacatgcacatattactactatgatcactttataaattggacaaacatatcgagtagtacatctaccacttaaataattttctttacgttgtctacttttatttttaggaatagagtacagactcgtatgcttacgttgtcgacgggacgtcacctattatttaaaagaataattactcataagtgcaaacacccgtattaaatttaggatttgaatcttagatctaggtgtgttggtagcgtcataaggaacataacgtatgctcacttatctttatctctacgctgtctattgactaagcacattaacaaataacgtagagtagtaaaatccttataaaaatagaacttaaatatatattgcacgtatatttgtggatgcgctgcgtcaccgcgcaatcctccccgtaaccacccaatccttctcccccatggcaacaacacgccgtgcgcgtcgcgtgcatgcatctgtgcagacaagagcgggccgcctctctcacgttcgcatccgccaacaagctagctcgaccaccaccacttggatgcgcgcgtcgatcgataaaatgcttgcactgccactgcacacatttgcacgggacgggacaaacgcatcgccggtccgttgctgccggccctgttgcgccggcgcgcgactgatcaggcgcaaaccttttttttattttcgatggaatattcaggtgagagcattcgaatctgaactggcatgtcatgtagcttggttgttactccctaggcctaaaacaatggacttcaatcctcttaggatataaagg

SEQ ID NO: 14633 - DNA, 451 bp, Oryza sativa
  unsure (1)..(451): unsure at all n locations
tagggcgaattcgagctcggtaccctgaactcgaaggtgaagaaggggagcgcgaagaaggcgacgagccggttcacggcgtcgcactgctccctcgtgaagatccgccaccacctcaccgacccgtagcccaggaacagcgcgaagtagagcggcaccgtcgccgccaccaccttgtacacgtctccccaccctatcatcttcttcttcttctccggttccggcgaactgatcaactaaattaaccctagaaccctagctagctgctaatggagaattaattaattaaccaagtgtaatgcggttgatcgctgtggatgagtgggtgtagtgtgagctgggctttatagcgggggcgagctagtcactggggaggaatatatgcatggatnnnnnnnnnnnnnnnnnnnnnnnnnnnnnnnnnnnnnnnnnnnnnnnnnnnnnnnnnnnn

SEQ ID NO: 14634 - DNA, 1577 bp, Oryza sativa
  unsure (1)..(1577): unsure at all n locations
nnnnnnnnnnnnnnnnnnnnnnnnnnnnnnnnnnnnnnnnnnnatcaacgaatcctaccagaaccggtgctcctgacgccaacccctgccgccgccggctgctgctgctcctttcgcttgagatcaacagacacaccgccaccgccacccttcccgttcgcggccttcttctccttggtaggcgacgacgcaagaaacagcttcttggggaacccgaggtccttgtgaaccgaagcgcaagaacccatctctctctctctctctcccctccactccactttctctctcctctcacacccaacctttttcaaaccacagcgacacacatctttctctcctcttccccgtgcaagaacgagaaatggaagcaacaaaaggagagagaagagaagagtagagagagagaggagagagttcttgggagaagaggaagaagagggacagaggagaggagagagtgggagagtgtgtttctttactgggagtagcgcgtgggcccgggctgtcatgctctcattttgggccgttgtgggatgtggacgggccccacgggtgtaactagagacggtttttggcttttgcagcattttggggcttttaattccagcggcgtttttggcaagccacatcggatattatatagagtattgtattggtatttgggtactaataaaaaaactaagtacagaatccatcagtaaatcgcgagacgaatttattaagcctgattaatctgttattagcaaatatttacggtagcaccatattgtcaaatcactgagcaattaagcttgaaagattcgtctcgcaaattagtcacaatctgtataattagttattttttagcctatattttaatactttatgcagattgttcaaacgtttaaaattttcctactgccgtgaaatgaaataataatggatgggagagaaagtagtaacagaaatgacttcagaaaaagtttgttgtcctaacctaaaggtgtgttcagtttctgaaaaaagttgaaagtttgaagaaagttggaagtttgaaaaaaagttgcaaatttatatgtgtagaaaaagtttttaatgtgatatgatgtgatggaaagttgggaataggagatctaaacacggactaaaaatcaaatccagatagaactttatgtgttttcatggtgctcaacgatttggtaccattggtgagaaaaaaaattatagctttgtcgtcaccggattaaatcgtaaattacaccctctctattttcaaacaattgataatgctgacttgttgtttagttttcaataatatttttttaaatggaccaataggaatataagattataggttcaataaatcgataaacgttaacaatatggtatcttttcaggtattcattcttatttgaaaaaaaatatgagcggtgaaagtttatagataaacaattttcgttaccgctaataaaaacatggccatgttgaaacttatactttgaaatgtatagtagttctgtatgacttgaataccaccattgagaaaaaacaataaattgcacaaaacaaggtgaaaatttcagtggtgaaattggaga

SEQ ID NO: 14635 - DNA, 7217 bp, Oryza sativa
gtagacaagaccacagtcaaacgcggctttggaccgggatgatacaataaactaagtttagggacctcgatgtgcactttataagttcgtggatctaagtgaaacctcctgacaagtataagaaccgctggtgtattttactctaactaaaatcagtactccttctttcaaaaatactaggacgtattctgaacaagttttgataataaatttctcttacactatttcactttcggttacggaatcatagccataagaaaatgctttcaaactgcatatacactatatttgaacggatgggggtgattaattcagataatatgaatccaacaataataatttctttggtcaaaacctaaacattattatatcaatagccggtcaaaactcaaaattggatagccaaaatacgcgctatatttgaacggatggggtaattccattttacgtatagatcaaaatcataattcattttcaaatagaaatgtactagtatctcgttatactacaatctttgatgaaataactactccctccgtctcataatataagggattttgagtttttgtttgcactgtttgaccattcgtcttatttaaaaaattttagaattattatttattttctttgtgacttattttattatccaaagtactttaagcaatactttttattttttatatttgcataaattttttaaataagacgagtggtcaaacattataaacaaaaacttaaaatcccttatattatgtgacggggggagtactaaggttatatgcctcaatgatagacatgtcgatgtctccaatagtagcaatccattataaatttgactgagtcaataatatcttctttggcgtgttacaacttacatgcccgacaccctcaattggctagtaacgcaatacaatattgctcctgacgattaccttttgtctctacctgaaatttttgtcaaacaacggcgaaaaggtagacgcaacgagatgatgataagaaaaggtgacattattatatattttacattttatatttgtaaattccaataggtggaaaatttttccaatatccatgtaagccactgaaattgatcttcaatgttactctaaaaactcgaatacattctcctgcaagggtaattcatacgtattctttattctcatcgatataagatgccatctggatgaataagaataatttgaaagttatataccattttgcatggatgttatataccatttcaatgactatcagcctcatcgtttgcccttaaaaaatcagccgttatcaatttttaaatattaaaacttcaatttttttaggatattttgaacgtagttttttagcattggcatttaagcaatcaaagaccatatataaagttgaaatttaattttttattactaataaaccgttagtcatatgcttaactcttggccaaatgacgagatcctttagaataacaaaaatcgaagcaactagataacatgcacctgtgttattccagaaaacaccatatataaataattggatggataattaatacgcaacagtacatataatcccagctaagttgttttcagaaggacaataatcgagtatcgatcgtgctctctcgatgtagacataagtaatacgcgtagcaagcacagtgtatgttagtcgttacatacaggccacgtcggcaaggtcaccgagtcgtgacatcaatcaaactggcaaatatatgagaaagatatcaacagatcgagctaatcaaagataatattactctcttagtttcaaaaataaaagtatttttataacacgtatcaaatagtggtcaaattataatactactcccttaatctcaaaatacaagtaattttctcataaacgtctcccttaatctcaaaatacaagtaattttctcataaacgtctgattggtcgaagatatacaatttttttcattagtataaatttaaatcctagaaaatatatatttatatttgggagcacatcgaatggcatctatctgcagcgtacacagcggtgagatcagaaacggtgccatacttcgcatgacacttgcatggccaaattcagatcgacagatacgacctgtcaagctgatggaaaacgaccgcctaaatgttctgaaaaatgcagtgaccgatttagtagtaaaactgaaacaaagatagtagaagtgtaactgatcgtcatgtaaggttcatgaacgagagagacatcgagagaattcatgtcctgcacgtcagggaattgaagtaaacactggaaaccctgcaggcaatgcaacacgaccacgacaacggcttggcggttgaattgtggatgaaccgaagtagaacagtagcttttaatatatttgctaatctccaaataatttaaccgtactggtgtactaagagtagtacttgttagctaaactgaaagtcagcagtactaaccaactactgtgagctggcaataagcatgatacagctaaggtagagccttgaatcaccgggcatttcatttatctctctctccatgttacggatcgggtcattcatgagcaactactgctatgatcttatctcgatctgcaagtgtgccactggtacaggttggttgtggtcaacctgcatttgggtgccattttcctgtgaatcactggatcgtcacccttgtatattataggtaaagagaattgtagatgatcctagttgctgcctgctacttgcaagtcacaacacagcatggtgattgccgacctgaaagtgataggtccccatcgtttgtcttattttctaataagtcaaaacggtttattaggaaataaaaatgaatttgtaggtgaaacttttataaatgtgttcttggtgacttaaaaaccaatgttgaaaaagaaactacattgaaaatatctcaaaatcaatcttaaaattaagcttaaaaattcaaaatttggcttttttttggctgattaggccatccgatgggagccatacttttcagaatctctttttcaaaagaaaaggcttttcagaaaaaaaaaagtacaaaatctctttttcaaaagaaaaggcttttcagaaaaaaaaaatgtactggtacttgtaatatcgatctgaattctgaaacgttgataagcttgagttgtgcttcgtctcggttttcggcccactgattccattaggcccatggacttccgtggcttgtgcgaccggcccgagctggaagaggcccgtgggcactgtggagagccggagacccaaccaacacgacggcccacgcaagcgaggcaccgcggcgtgtgcgtcgtgaccgggccacctagggtaggcgcgttcacgtagcctcgattcgattgggccaccgcgttggtgaagtgtttggaccatttttgattgaagtcaaaatgtgccccaccaaaattttcatagcttaggacttgttcagatcgatttcattttaaaccatatcattatttaataaaattgataatcatatggttatattttgtttgttaccaaattttggtgatatctataaaattttgacaacattatattgagcacatcctattaaaacttggtaatttattaaaattttagcattaccaaattttgaaaaagttattttggcatcaatcagaacataattttaaatagaatgttagttaggaatgaaaccaaacaaaatttatagtacccacacttaatttggtcacattctaaaaactttttcactatactactaaaatttagttttatattagcatcgaatcaaacatggactagttaactttcatttaccaaaaaattggtaatgcaaaaaatattttagtactaccaaataaattggtaggctagaattgcgttgcaggagtagtagtacagtacgtacatggtatgatcggtgatatgacaagcgacgaacacaggtatcgtacgaggaaccaccgtcccatctctcccatgctgccaactcagatcatctctcgaatttgtccccagacaaattaaggttcattaggcattataccttcttttaccttagtggaaatgggtgataaagaagcacagctaattgatgggatctctgatgatcgccaccgtactaaacaccttctctaactcgctcttatgtgacagttgattgtctgtggtgacgggagataaaagataaatggtccaaccatcttgactcacacacactccctaagaaagcgccctttcagacctccatgagtcagcttacgcacaatgcgatttgccttcaaacacgttgccagcaaccaactggttagcagatggattagccaccacatgattggattggtcatatatatgaagatgatcgatgataatgatttgacaagtcaaagagatttcattgactaccatgtaatattaggtcacgggaaaaaaaaaaaagcaatatcatcataaaagcattttgacaacctaggtggggtttgaatctcctaaatattaagatgaaggcttggtttaattcccaactttttctttaaacttctaacttttccatcacatcaaaacttccctacacacacaaattttcaacttttccatcacatcgttctaatttcaatcaaactttcaattttagtgtgaactgaacacacccgaagaaaaagattaagtgattcacgcaaaacaaggtggtaataacgtgtgattaattgagttttaattattacaaacttgaaaaatggattaatctgatattttaaaacaactttcatatggaaagtttttacacgaaacgcactgtttagccgtttgaaaagcgtgtcacgagtatctaaattttcatctattttttatacaagaaacgaacgggaccctaatcactcaatatcttctatgagtattttccgtggtaacacgtgctccgctattccgttcgatcgcgccgtatggacagacctacacagtaggaaattaaaattcagtcacatactccctctatccttaaaaaaaaacttaacctagaaacgaatgtgaccctccttttttccagattcattattctataaggatacgaggttgagtttttttttttgacggagcgagtagttcgcatcatatgcatatgttaatatacatgatgttttgaatcaaagtatagtactcgtctactcgatccgtattgatctgtatacaaacaaattcaacaacgcaacagttgcagcgacgtcaactcaattgtgaaaaaaagaaagctggctacaaaaagttctacgacggaagaaggcgattgccaaatgccaattgccacacgacgaaagcagaagagatgcatgggcagacggatgctctgatcgacagggaagggagaaagggaaatgctgcaacgacagcgattgaatttatcgaatagaagcatgcagagaagcatgaaaattctggaattgtgtgctaagccatcgatcaatcgagctaacctgggatttgcgggtgagagcaacgctatctttagtatttttaaaaatctattattgtcttttagggggaaaatgttttttggggttatttgtaaccagtacttctgttggtaggtttcattttataggtgattaatacagcaggacagcgtatcaaacagccatcggtgagtaagtgatcggatacagatgagaccaatcataacatgttacagtgtttcgagttaataaaacattaatgatccatcctttgtcttatgcttatatttataagtggaactttaaattttaaaacttaattttcaagtttatttaatgggtttactttatcgtagtttattttacaacatttgctttaaattgctaagagtatgtataaaaaagtttactcgtaaagatataaaatatttttttatttgttaataagtactctctctatccaaaaaaaagacaaactctggtttctgtgcccaacgtttgaccgtccgtcttatttgaaaaaaatatgaaaaaaattaaaaagacaagtcacacataaaatattaatcatgttttatcatctaacaacaatgaaaatgcgaattataaaaaaatttcatataagacgcacagtcaaaattggacacggaaacccagggtttgcctttttttaaggatggagggagtactatggataagtgtaagtataaacaaaataattggtctataattagggatgtaaataggcagccccgctacccaaataaaaacccacttgctagttcatttcccacatggtagtacaaaatttagaagaaaaaataaactagaagtgacataagcgggctaaaaacatcccgcttgcccgtcatgtttgcatccctacatataacttacttggaagaatatctccctttagaatgtgtaataactcaacaaagattgttcaattgtttctttatgaagattgtgaatgtatgttttgggtgaatatattccatgaaaattatttatattttcttaaagacatatttttttgtttgaatattggaataaatgaatgtcttgtgataattattcgaaagtaccaacgaaacaaacgaattaactgctataaaattttttaaaaaaacttaaaacaatatttaaaattccacatatatattttgtctattaatccatttacccatatttctcattattccagtgatagatgcgcaagatacttgtggtaactttccgattttatgatgcgctagttatttatagagttagggtgtgtatgttgtacttataaggccataggccttgtttagttctaaactttttcttcaaacttccaacttttccatcacatcaaaacttttctacacacataaactttaaatttttccgtcacatcattttaatttcaaccagacttttaattttgacgtgaactgagcacatgccattgtactgtgttaaaaaatactattgaagtaaatgtgacgagcttttatattaatataaatgtgatgagcttttattgagaagaatagagaaaaataataataataataaaaaggaaaataagggtcagggtcactccaataacgcaccagcaccaccttgcccgaatcacaaagcgaggcccacttccaccttttcctatttctcctctccgttctctccgggttcttcgtcgcctccatccacatcgtcgtcgccaccacccacgccaacctcgcatctttctctcacctctgctccaatcgctcgctgatcccccccccccc

SEQ ID NO: 14636 - DNA, 1862 bp, Oryza sativa
gccccggacggcgcccgacgagccgccgtcgggcgccaggttcctcggaatgatctccgcgctcgacatcgccacgttcgtggccgcttccggcgtcggtgaccgggccatgaccgccgtggtcgggaaggtcgtgcagcccaaccctggcctgctccgggaggtcgatccaggcacgaggtgaggtctccgccctccgcccttcgtttcatgatgactaccaatctccccgcgtctgtagtatggtcacacctgtgcttgtttcgattgatctgcccactgaggtttgggggctattttatcataactataaccaattgtgatgcggcggtgttggattgatcagtaggtatagcgtttgtttcaattgatccatgagcgaaatagaaccttttccgcgttttgggtgctaaatcatgtccaacatgtactttcgacgcgctttgtaggcatcctaaagcgattcatgtcgtatgcagcggtaaattgataactctatataatttatatttatgcactgttgttcgtgttagcttggatccgtcactacttaaaacgcagatgctacatcagcccttttgtttaatgtgatctagttggtgattttgtcttctacgtagctttgtagtttgacgtttgattgtataagcaggtcgaaagctatcactaggtccactagaatttttaattgatcacatgggtttgttgtttatttaatcttggatgtgatgcttttgctgattgcaaatatcgattgtgttcctgaagttgcacgggaccttgtttgaaaaagggttaatgtattaagacaaacatattcattgatttaacacgcaagatctttcagatggaagcataatgaatgccaggtagtcctttgcatcttatcatgctaggccacgatacataattggtctgattgatttctggacggaatttaatagtggatcaagatcaagtgtatatttaagttaaaacatatgctcaagtatgcaaattctattccttttatttggtttctgtacacttaggattaaagtaattttaaaggaatgcatataactgtttttccaactttcttcagtttgtaatttgatggcactgtagaattgattcactgttacgtataactaaaagatgctagaaaaagacgtaggcatgcaaaaaaaaattaatatctagatgaaacttcctatggaatgatgcagctaaatggactttgatttgttatatttcctgtagacagcctatattattcaggagtatgcatcattttttcattagccaaagcagtgccatgcttgatagggtaaaattgcatcttagttatcgtatttactgcaacattgtaggtaatagtcactatcaatattcaatagtacagatgtgttaggttattggcatttatgcttcttcatggttcctctcaagcctgtccaggagtatgactggaatcattcagtctactttaaaagtctcagtcccatctaatgtgacattgagctcttatagtaaatcttacaacatgtatattttaaagaaaatgtgaacggagggataactttgatcctcttttctttaagaaggggctttcatttgcactctatttcctgaagaatcttttgttgaactttacagatctgggagatcaatgtcttaaatagtttcgacgtgaactatctctagatatttctattgcacatatcctacttcttgatttgtttagttgacatcacataacttggattttaaggaccccgcaccggcggactgagaactctggtttgttatgttccgttggtcataccatcattaggtcttttccccctttggttggttatatacccaagaatatagttagc

SEQ ID NO: 14637 - DNA, 4624 bp, Oryza sativa
gactggaatcattcagtctactttaaaagtctcagtcccatctaatgtgacattgagctcttatagtaaatcttacaacatgtatattttaaagaaaatgtgaacggagggataactttgatcctcttttctttaagaaggggctttcatttgcactctatttcctgaagaatcttttgttgaactttacagatctgggagatcaatgtcttaaatagtttcgacgtgaactatctctagatatttctattgcacatatcctacttcttgatttgtttagttgacatcacataacttggattttaagacccccgcaccgccgcactgagaactctggtttgttatgttccgttgttcataccatcattaggtcttttccccctttgtttgtttatatacacaagaatatagttagctggcctgcatcatttgtcttctgatgttgaattgctgagttatcacctgaaaattaaaattctttggatctgttttcttgatgtcatcctctatctgcattttcgttaagtaatattgttaggaaaattgaactccaaaagtgcattccactagcagaagtgcagaaagagtataactgaatatgtttcagtagtaacacctcgagaggatagtacttggttgttggtatcctgatgcatattggcggtgagctgagcagtcttctccttttagtatcatgttgtaaaatgatgatgacccagacttaaacaagctatcagatttcaagcggcttgcccttctggttgtgttatgataagggaacaaagtggggatgaggttctatttcgtggtaatgtaatgccataatcaggaaggtgaaaatctatgttgaagctgtacttcatgctattaatggatcatgtgtgaagacaataatttacatgaacccaacccacacaaacacatgcagagcagaccaatcatggctcaatataatatggaaagactaatatggttagatttgcaaatgattgcatgccaattatttctgcatttgtggaattgttttatgtgcttcagaaaaaagaatatataccctaataaaaaaaagaatctaatgtcttacttattgtaacagcatctttggactatatgcctttgcgctttgtaggtagttcatcttttccaaatgcactgctaggtctttaccctgttactaaatgagtgttattgttttttcttcaaggttgatcgacgcacttgatttgatgaagcaaggagtgaagcgcttccttgttcgaaaaaatggcgcctggagaggcatctccaagaggttttcagtgctttacaacgggaagtggctgaagaatatggaagcaacatctccaacctcagctagcagcagtagagagctttcctcctctaccagttccacctacaagttctgctgcctctcaagggaagacattctccggttccttattggatgcctcggtgcccttgcgcccattccactgtctccaatctcttcccttggagccatcaatccacattactgtcatgttgatgcatctgtcccagccatggaagcaattcagaaggtccctccagatccaagtgccgtagctgtagtcgagactacaccagatggaactcgcaagatattaggagatatctctgcctacaagctgtggaaatgtgactatgttgcggctgcatgggcactgataaacctatcggcggggcagtttgtcattggtgccgacgataacgaatcaacaccgatctcagccatcccagtgcctcccatcagctcatcactagtggaagagatcggacctgggcgctcacccagggcaaagaagttcagcagcaggagcatcgggttcctgaacagccaggcgcaccagatggcgttcggtcgaatgaggagcatgtaccgcgggaggagcgcgccgctgatgtgcaagagcacgagctcactcgcagcggtcatggcgcagatgctgtcccaccgtgccacgcatgtgtgggtgacgaacgcggagtcggaggaggatggcgtgctcgtcggcgtcgtggggtacaccgacatcttcaacgcggtcaccaagagcgtttatccggcagcatcttgaatctctggatgcttgatccgtaccgtttgctccgttggtggttccttggttggccctagtgcgtgccgtgaactgtacactgcgcctggttggttcttttttgtctttcgagagttggggagttttttgtccgcatgagactgaaactgaagggtatattgtgaattccttgtggatcggtgctactatggcagactcaggcttgtgctttggtacggtggaatgatagtctactcattcgtatatgtataatgtatcgtttctctgtgctcccttaccaatggcccaatgggatcagagatggggtaattaacccagcagctgccatttcttgtcaacctgttcttttcgttctgaagggtataacttgttgataggcatagtatagctttcatcatcagaaacctaattagtctcaagtctgacgtcttaccactaactagtttgttctgaagttgccaatttcagaaagccctatcgcgccgtcgaacaataaacaaagcaacataaaataatttatgtgttgttatggtctaaaatttaatgataaaaataaactacgataaaatactcttaaacaagtttgaaaaaataattttaatataacaagcaattgatgatggtgtcatattgccaagcccacgaactcgatccagccatgggccatggcgagggccgagatcggtgtaaacagccgtggtgggccatggcgagagctcgacaaggcgatgccgtggtgggcggcgctgagtgaatttggtggaatccattgggcctccgaccaccctgcgttcatgttgggccgagtacacgtgaaagctactcgcggaggcgggcctccctcatccacctgcgaatccaaaatttgccgatggttcgcgtccgggcagagcggtgccgcggtggcatatggcacgccaccccgcgcattgacacgcgtgtagagagagagagagagagaccgaaccgacaagagacaaacaacccacgcgtaggagtacgtacactaggctgccggagcagcgtgtcctacatgcactgcacctgcacctggcacgctgggctgaattctgacgccaacaatcgaatcattctcgcagaatcgcgccagggaggaccatagtcacttgaccattttttttaaaaaaaaaaaactcggtctcggccttgtttctgatgcctccgtccgtcactccaggagcatctccgctgccgccggcctcggtatcatcgaccgcgcctcgcatcgcatctctcggaaagcatatgcacaccgcgtggcggcgccgcttcgaattcgtcgtgcactgccgcttgctcggtgcggtgcaccgcgcgcgctccgctgccgacgtcgcgcgcgcgcgaggtgggacgaggaaaacgcacgcaatcttggcgccacgtacgccgatcgagcagctagaggaggaggacgtagcggccgggtggcacgcacgtagtacgcggtgtggcgtggcgtggggttggctcgggaaagatcgggggctcacacaaataatccttcacatgacacacgattcgaacaaaatcaccttttagtcttttacaaaaacacgaaaagatccctgtgatctactaaaataaaaaggcgatttagacacgctgcttcataagcaaagaacaattcggcttagctttagtccggacctagtctctaattacagataaaaatggaaaaaaatccggatgtaaaatcaaagaaaataaagcagagagtactgtaagggtgaaaacggtcgtgaaaattcctgatcgacctaacattgtttccatataaataataccattttcgaccgtacccttttgcctaccattaaattctgaatttaaattttttatcatattaatatcgttattgagtagtttactccctccggttctataacaattgacgttttggataaggttgaagtcaaacttttataactttaaccaccaataactttaaatatatttagtttaaagaaactagaacaacatacataacaacatactacttcagtactcataaaggaagtcgtttagaatagctacacggtctccaaaacacaactttgacttcttgttttataaaaatatttatttaaaagtgatatatgtatacttttatggaagtattttttaagacaaatcttttcgtataatttttacctttttaaattcaataacttgagagttatttatgatttatattcccaagttttgacttaaacgttgtcctaaacaacttcctttattagtatggatggaatacatagatttatctttcaaaacactataataaaagtaaatatgtatttatttattatatatattataatagaaaaattaaggccaaaggtgtatttttaaaggtgtatttttagaccatatcattatccaaaacatcaattaaaataaatctgaagggactaaatgataaatatattaattatcttatttctaaaaagatgctcccgaccggtttttcaccctcgatggtagtatacgggggagagagagag

SEQ ID NO: 14638 - DNA, 21747 bp, Oryza sativa
  unsure (1)..(21747): unsure at all n locations
cgccactctcctctaatccctctctatcgacctcgtcgcgttcgggattggttccccgtgtgttgggttgggttcgatgcatcggtttgctctgggcgacgcctcgccgccgctgcgtagggatttccggtgcacctgtccccggattggcgcggcgattcggggttcgtcgacgttgcggcatgaatgcgtgtctctcttacccaggattcggtttttcttctcttcgttttgcttgcctcgtctgggttttgtctcaaattctgcgccgtctccgttcctcgtcgccggctttggcaccggtgccaggaatcgtgagattcatcctcgtccgtgtcgcgcgctctccctacgcgcatggccgctgcatctcgccgctgcctcagatcaggctgcaaagatttgcagcttcgccgttcaatcattcgtgcagcatacagtaggtcggtttcactgtatgaactggcgacctgctccaccacggcttctccgttgcaagcaaagtgaagctactagctcgagttagtccctttcacattcatttttgacgccgcatttcaccggcattaaatttgctgggaccttcataccttcaagcttgtactctggaaccatactctccattaatatatcgctgtactgcacaaggaaaatcggtggtacacaacagtatcgatttgaagaacctctttaggggggcttccatggggactccaaggcgttcctatcgttgtcagcccgatttggtggcccgtggtccacagcatggtgatgttgctcgcagtgtcatggaatttaatttgatttgttcttcgcttgttagtaccactggactcctaggtagagatgctttatggcagctcagtgtcgctgacctgtttagttgacgggttctagagtcatttaatacagtatggcattggaaggaggttggttgtgtcctatcctaggcatggcactgaaatggaatcacctccatactccacccctgtcctgggtttcttgatcggattatttgctccatttctctataaaaatgtatttgctcggagtatttatttagtattgttccattttctgatatttacaaactgataccctggaaatcagattgtttttctgagagggtggatatcatagttactgcttaaaccttacccaaagttaaatttttctagttacttccagtagttaaactggcatgaatgcaagatggcagatttgactgcttggtccaattagttccacctggctgatcttatttctatttctgcacaccctgctgcagcaaaaattgtgttccccccagagatgctgcccatgcccagctacagtgatatgcagggcttccaggctaaaacgcgcaggaaagacatccttgctgtatatcaggatttctttagcctatgcattaatacgttcagtatggggagatcctcgcaccataatttatagagcatggcatgtgactgtagtgtggacaaggtcaatgatattagctagtagtactaacctaactgcattttcgctttgtctacctgatgaactctagagaggccaagaagctaaagcttattgcacacttcagttgttgtgcataatctaccgttttgtcaaaagaacagtccaaccataactgatttaattttaaccttaagggaaaaaaatattaggatgaccatcaaactagtacgattagtcttctttatcttgacaaagctgaatggaaaccgtacaggtcaccattctaagcatacctatacatatattttacaactcaggtgtaatctgtttcttttcttttctttgggagggtgttgcttttaacagtgtcccatcagtgtccctcttgtcaaagtttaaccttgtaaatttgtaaatactccctaaattaatgaaatttggccggcctagtctttggccagcctggcaaatgcctaaagctagaggtatattcatcatgtgtctggtagttgctgaaagtttgtttaatttttgtatcagggttgagaacaagaagccatttgctcctccacgagaggtgcacgtccaggttacacattccatgccaccccagaagattgaaatattcaagtctcttgatgattgggccagagataatattttgtcccaccttaagcctgtcgagaaatgttggcaaccacaggattttcttcctgatccagcctcagatgggtttcatgatgaagtcaaagaacttagagaacgtgccaaggaaattcctgatgattattttgtttgtttggttggagacatgattacggaggaagctcttcctacgtaccagactatgcttaacactctcgatggtgtccgagatgaaacaggtgcaagccccactgcctgggctgtttggacaagggcatggactgctgaggagaacaggcatggtgacctcctgaacaaatatctctacctcactggtagggtggacatgagacaaattgagaagacaattcagtatcttattggctctggaatggtaacagttttcttccgcttctttgctagcctagctatatttaactgattattttgaaattgtcattcatgagtttttccctcaagcaattgttttcctcactggctagcgtatattagcatgatgtttttgaaaaactcttttgagttttgaggaagctagtaactccactaactacatactttaggaataacttttacctggcattatcaattttctaattttttagtcttatgttcttttgctctgttctattctgttctgttcacattggactgtttaagtggcaattgagcagagaaatctgtagcacttactcttttgctgcatcatttccaggaccctaggacagagaacaatccttatcttggattcatctacacctccttccaagagcgtgcgaccttcatctcacatgggaacactgctcgccatgccaaagactttggcgacctaaaacttgcacagatctgtggcatcatcgcctcagatgagaagcgtcatgagactgcatacaccaagattgttgagaagctgtttgagattgaccctgatggcactgtgcttgcttttgctgacatgatgaagaagaagatctcgatgcctgcccacctgatgttcgatggggaggatgataagctctttgagcacttctccatggttgcacagaggcttggtgtttacaccgccaaggactacgccgacatccttgagttcctcgttagcaggtggaagatatctgacctgactggcctatctagcgagggaaacaaggcgcaagactacctttgcacccttgctgctaggatcagaaggctggatgagagggcacaatcgagagccaagaaagctggtacattgcctttcagctgggtatatggtagggaagttcaactctgagcatcagacgccattgcgacttcttcgagctccagtgttactactgtccgtgcttgtcgagacacattttgagaacaataccaggtgtgtcttgctacatagttcttcaggttgaccaaatgaactgagggcatatgttcgtggtatctttgcttagagtgatagagagatttgcgtctgtgttttagctctttttttcttttctgccttttcatgtacaacttctggccgtgtggattggacatgtactgaacgtgagtctgtcgttggccgtgtcaatctgctcgtgtgtttaaactggctgctgttcaggtctgaaaattttgtgaaatctgccatgtcgtcagaaatatcacagctttcaactgaggatcatcatcatcactagtagtgtagctgctcgtctgcagtgaattacatcgtacaactgataagccccgactatttggtgcaactgttatgtctgcagataagcagcatacgattcagcaatcagttcactcggtgatattttagtatctgcaaagatcagctgttgctgtcatgctgtgaatcgagatgtggctcaacgcatgccattgttagtgcatttgcatagcttggtgaagagaatatcccattaaattttgtgcgtgcgaattctgttgctagtgtgcctgtacagtacagatggttaaatatacgaaattctctaccgagatatatgcaatatgctcagcaaatgaaaagatatatgctcatctgttgagattcttcacttcgtatagcaaattagcaaccatatgtactgttcaagttgagactgcctgagattgcttctgaccatccaatcttccatttgcagcatttgaattgaacctacagtcattgcttcattgcttgccactcatttacattctgtttttagatcaagaattgcctgactttgttccaaacaaatggcttaggaaatctctgaacaaatgaaatttctgaagatggtgatgcattaagatttcagcacaatacttttgcgagcaacctgaaatgtattccactttgctgcaatatgagaatctgaatagtgccggggtaaattctgtacaaactgctactgacaaatgggcccacgtgttgttcctggccccacctatcagacatagctgagtgttatgccaaaagaagcaattccatttccaccatagctgagtgtgcctctgttcaggacgaatgctgacacaaagcacgcaagaaatatgcctgcttcatttcaatctttcaattgacacaaaaattccatttgccacctgaaaggcagtaaagcataatgccaagttgcagggagtaatgcaaatgcagtgccaatctgcagctgcattattattcagtggaggtagatcgatcagagtaaattgagctcttcatggaacaaagaactgatcaatggattggaacattttctttttcgttttagtggactgacagtaaacatgacatgcatgatcagatgttgcaactttacatataaatggcttctgtgcgtcagcaaatttgttctacgagcaaatagatggatcatgatcatgcatgtatgtggggattaattccctgatcctctctgcagatcagataaggtgagtgggaatatgtggacgtcgctctttgctttactaactattctgatctctgaaattaacagagaatgtacgttggagtgatttctgaatcgtccatcttaggtaattagcgtgaatgcagtgaaaaagagctttgcttttctctgatctttgcatgcacctgcagatgctattatgctaatccgcttgcttttagggtaatctgtgttctgaatgcatcgtggacaattattttaaggtgtcatgttgcttgtaatgattctatttaccagaatgtatataatcactaaactaatcattgactttgccagatttagttttccaagtaaggcagtgtgtgtcaggagagtggagctgaaatgtttttatagcagaatcagtgaactttgaagcttagctgactatggatagtggtgatatagcaggaagttttgctacatatagaaatgcaacactaatcagtcaacttatgaagtactgtatctgatcatatgtaccatgcatatcccaaattttggaagacagagaatatatgcaagtatgcatataccattgaaaatttgaaatggtatttggatataattcaaatgatttgattttctcacaggtagccctttttttccaaggcaaactcacagatgaacagatgatagactgacagttctattacagaagcgtaatagtgtacttaacattattttgtctcatgcgtctgtaactttaccgacaaaactaattcgtgtcaacaagaagaggaaaatacggtatgcaaaggtatagattccaaatcgctctccaggccaacttatgatctatctaaaacaatgcccaacatcttgttcctttttcctttttgtttcaatatcgatcacaaaatacatacatatatacgcagtagtagtcaagcaggaactggaaaacaataatttggacaacatgcatgaaggtatagtagtagaataaccactgctagctgcatcctattcctttgtgctgatatactgatatatgctttctctctctccactactcgatccatacgtctctctctctagctaagccactgtactgaaggttaatccaggagatgctagtcgacctagctagctagctagctagagcacctttgcagcaatactgacctgaccggccacctgatgttgaaactagcataagcatacagtactatagcattgtgctagcatttccttcaaaatatcattaactgttcctttatttgcgttaagtaattattaccaccgttattccaaaatataagggattaatttaactatgaatttgtattgctaaaatttcttatatctcgagacggagatagtatctaagctagttttttatcgggacggctaaggaggcggccgaccaaattttattaagaaagaaagatgttacaactttaacaatatcgacattaaactgtcgagggagagaacgtgggagaacagagagaagagaacaaaaacaaaaaacacacaggaccgctttatagcggggttcttagccaacttatctaaaaataacggcctccctctacaccaggatctcatctctaatatcattgtatatccctaacactgagcactctaaaaataccagcctccctccacaccatgatctcatctctaatatcattgtatatccctaacaccaagcataacctttgctcaaagatcctggcgttcctctctttccgcataaaccaacaaaccatcatacaatgaagtacggtggtgtttgaatcttctgaagatgaagatgaagataaagattaagtgtttcacgtaaaacaagatggtaataacgtgtgattaattgagttttaattattacaaatttgaaaaattgattaatctgatattttagagcaacttttatatagaaagttttcaaaaaaaaaccgcaccgtttagcagtttgaaaaacatgctacgagtatccaaaatttcatccaattcttatcggagaaacgaatgcagccagttgcatgcgctaggtggagctaagtttgatgaaactgaagagatgttgataatcaaaacgagtacgtcctttcagcagagatgattgtctgaaatcaaaatattttagacgacgacgttggttcagagattcaattcatagacatatatactagtaaggtaaactatagattcacgtataatatacatgaacaccctgaaactgaaaccgaaagctagctagtgatcagaccacacagatgatcactacttgcctttcggcaacggtagtcacacacacctcaagaacacatgcttgcttgcatatagcattgccagtttgccactaattgcatgcagtctccatcatcgaagcaaagcaaagaaaaacacacacatgtacacacacacactctctctctctctctctctctctctctctctctctctctctgcacgcgcgcgtgcatgcatgcaaagatttcaaataatcccaagcgcgcgagagcgagaaagcaaaaaagcgcgcgaacaagatcccgttaacctaaccggccgtcgcgtcaacttccaaccccccactaacactcacactcgcactcaccaccatgcagcaatgtcatccgaatcaaaattaccaagctagctaatccaccaatcctccccagccgttcgttcggatcgatccgacggccaccatcccactctgatcgatccatgcatatattcctccccagtgactagctcgcccccgctataaagcccagctcacactacacccactcatccacagcgatcaaccgcattacacttggttaattaattaattctccattagcagctagctagggttctagggttaatttagttgatcagttcgccggaaccggagaagaagaagaagatgatagggtggggagacgtgtacaaggtggtggcggcgacggtgccgctctacttcgcgctgttcctgggctacgggtcggtgaggtggtggcggatcttcacgagggagcagtgcgacgccgtgaaccggctcgtcgccttcttcgcgctccccttcttcaccttcgagttcaccctccacaccgacccgttccaggtgaactaccgctagaaacgcccatggtcttctggctagttccatgagatagtggactagacgatctgggttcgaagcctcactccttctaattatttgatgttagatccttgcttccctaatattcgcgtcttttttaaggtgaactaccgcgccgtcgccgccgacgtgatctcgaaggcggtcatcgtcgccgtcatcggcgcctgggcgcggttcatgagcaagggcggctgcgccgtgagctggtccatcaccagcttctcgctgtccacgctcaccaactcgcttgtcgtcggcgtgcccatggcgcgcgccatgtacggcgagtgggcgcagcagctcgtcgtccagctctccgtcttccaggccattgtctggctcacgctgctgctcttcgtgctcgaggtcaggaaggccgccatcgggatgtacgtcgacggcgccgaggcggcggcggcggccggcaaggacgtcgaggccgccggcgccgccgccgccgcaggcacggtcgtcgtcgccgccgccgcgggcaagccgtcgctgtgggcgctggtgaaagtggtggcgcacaagctggcgcgcaaccccaacacttacgccagcttcgtcggcatcacctgggcctgcctcgccaataggtacgttatgtatacaaattaatttattattacatgtaggctccacatgtcagtaagataagatagataaagaggaacaatttaatttttgcgattacatggcataaccacacaaaaacacactactccacacgtaatatcctcacacatccacaaatgtgcctcctaacacacgctcaaacagatggaaactagtgacacattttatggttacgtaaaaaatatacgtcatcgtgtatccatgagtgtatctgagatcaattgtaattaaatattggttttattaaactcgtagaaaaacatatataggtatgtatgttatatttaaaagtatcaggattaatataaaatcatgcacatatgcacaattgtgcactgccaacgtatcacatagagagatcggtttatgccggtgtgtaatggtatgagtgacaaatgtgtggtggttagctaaccatctgacgtggagatcaccctgacatgacagtagatgcacgtagctaagcatcatgcacgagaggctaatgctattggtagctccacacactggtcatagattattattcttgcaacgtattaattgcgatcgactgtccaattaatatgcgatcgattcgttgtgatggaataccattgatttgttcttccttttttcccctgaactgcaggttacacatcgcgttgccgagcgccttcgagggatcggtgctgatcatgtccaagtcaggcacaggaatggccatgttcagcatgggtacgtacatacatacataagctcgattttttttttggtgtgaagaatacgttaattaattcgattgtacattaggtttatgaagtaattaactagatcacaagttaattaatcatgtacgtagtagtataacaagggcacttgttagtgaaattctacactgatcgttagtattaattaaccttcctttttgtgaatgacttgtatccccacactacttgttccataattcgtatctagtactccagcaagtaatacatattccactagataattacccaaaaaaacacaccaagaatcctataccaaataaaagaaatggaaaataaaatcagcagtatcttcacgaggaaccgttcaaattaaaggcacaagttctgcacgtctgttgcatgcagagagcttgcgatagctagcacgaaaggaaaaaaaaaggggtagaagtatgcttttatttttatttttaaaaaaactctctctgatagtaaatatttgatgtttgagacagtattcaaccaaactttggatattttgatcaattttatacggtgacaagtttataaaatctgataagtttatgacactaatactttctaaacaaatctaattataccatcttattttaattaaaaaagcatacgataatttattataatttgttgatggttggctaaatcttatcgtacatatgaaaatatttatgaaaaagaaaaagaataggacaatagaataaggaattatttgtgttcttgtgctgatagttgcttgcatacagcagcagcagccataagagcaagtttaatagtatagtccactattagctccaaatcatctatagctaatgtaatagccaattcatacaatagttgtttactatactatttcatctgtcatacacacattatgtcttggagtccgtgctgcagctggctacagatttatagcccgctgctcttctctctctttatttatctctttaaaatatgtttatagctggcttatagcatgctattacacctgctctaagtagctatcatttttatttttgattacacgaaagatacttaagaggggcgagacgtgtgtggttttgcatggatgcaggattgttcatggcgcagcaggagaagatcatcgcgtgcgggacgagctttgcggcgctggggctggtgctaaagttcgcgctcggccccgccgccatggccatcggctccatcgccgtcggcctccgcggcgacgtcctccgcgtcgccatcatacaggcaagctacctataccgattggatccatgcacatctctttctctcccctttttgttccttaattctacgcgcatgcacacatatctcacttgctttataatactcaacacgtatactcgtcgttttagataagggtgaggtcaaactttaaaatctttgattatgaatctttttaaaatatttgtccttcaaacatgttgactacatgtatagattgatcttaaaaagtactttcataaaatcatatatttgttaacacttttatacatatagaaaaaataacggtcaaagatgtttttttgagaccgtgcccttattcaaaacgacaagtattatcaacccggagggatgtaccaaacataagttgcactaattgtgtgcaccggaggttttgagctacttcctccgttccataatggagtataagacatatactacgaatgtcgaatttagataaacttccaatttagatttttagtattataatatatcctattcggttcgatttcttatgtttcggtacagatggagtaagcgctaaggcaaggtaatgtttcctcgtatttaggtccatgacatacaaaatacacctctatttcaaactaaggctgtgtttagttcccttcaaacttttaatttttccgtcacattaaatatttggatacatacatggagcattaaatgtggacgaaaaaaaacaattgcacagtttacatataaattgcgagacgaatcttttgagcctaatcacgccatgatttgataatgtgatgctatagtaaacatttgctgataacagattaattaggcttaacagatttgtctcgcagtttacaggcggaatttataatttttttttattattagtctacgtttaatacttcaaatgtgtgtccatatacgtcaaatattttttttttttgcaaaacaactaaacacggcctaaacctaagactacaaagtagaatggcaacgacgtatagacgatgctgggctgatgtcaatctatcagcctttcacaggcatgcaacttaagccatttgattttaccactttacaactaaatgttgaaagcttacttttgacccaaaaaaaaaactctagctgaagattcccacttaacttcccattacaccactagctgatagcctgatacatgcatacaaccagtgcttttagcccttgctgggttcctttgtgtatatatatatatatatatatatatatatatatatattaaccgaacttctaaatgccaacaaagtcatctgccataattgcatttcaccgacattagatcccttcagcaccaaagtattaccgcccaaaggtttttgtctagatatgtcagatgccacacacatagtgcaacactaatggagataaaaaggaattgctagcttaagtacagggctagcaatgtccggaaacaaaagggaagaaaagaaagatgcttgaacaaatggaggaaaagagaatccattgtgaaaactacacattccactgctattcctacgtgagatttgagcttagtttgtcagcacggctcagcaccacactaatcttgaccactgggtgctttaagcctttaaggttaatgttgctcgcagagccacaaacatgaaccgtatttgcacaaaagaaaaggcaaagcatgcacacgaaaggcgcagtagcagattaattatatgttgcgtagtcggtgtgcaagtgcgcattccaaacgacagaactgaattcctgatcagtactaatataatcttcttggaatcttggtcaccttgaccttgcttttaagcaatcagaccatgacgaaaaatttcggcccagcactatatatataccaggcttgaacctcttaccctatcagtgaacatgtaacacgaactggtatccattattgtctgagaaacactcaccatcactttagggcagtgtcttatccatggaatagattggtcttcaatggggcggttcagcttctgttttcatgcaaagaatagtgcatgtccctattgcaccggcacattttgacccctgcttgccaaagagcaaagatcgttgaaattggtctagagatcagatgtgcttaaagtaaagaaaagtttaacaaaataaagtgaagaatgagcatggcacctatgtggaggatctgttcttggcatgttctagagtccgtccccacatgaatgcagtcatccgctaaacaaaaggacaagttaaaaacagcaagtcattagagaccactcattcagatgcttatcgcataatgaatcgaactcaagtgttagttaaacaccaggacccatacaataatatcaagagtctaacagcataatcatgttcaaggttttaaaaacagttagttgctatagtggagtcagcactaataagatgcacaagggaagtcctactcatcatgtcatctagtgcacatttcattcaagagatgggttaacctcgtctgaatcaacagtgggtttactttatgggagaggcaaactagtttttgatgtgcatcacagttataaaactgaaagaataattatcctctttgttccatgtcatcccttaataactgtctacacagccacttctgttcctgtgtatagaattaacaaacattcgaaagtggtaggggctctgctttggggtgacagggcactcctgaatattaaggtaaacaatgtttcggtttacaaaactagagttaaacaggggaatgttgctctgatagtggtccttggaacaagtgtgaactgaattattgtctacaagaatttgtgatcaaagggggggggggggatttggcttccactgaccacccagatagtttaattcaagacaatgtgaaggttatagctttgtacgtgaagccaggactacgcaggttagatctcagacgtcaaatacagtttctctaaattacaatgcttattgtgctctaaagattaaaatgagtgcaaagaaatgacctttctgatttgtcttctaatataataatttttcatatatattcaggtaatttctgtcgacattttgtatcttcctgaaatgatgaaaatgtgcctcaactaacattcgtttgaattcttcaggcagccctacctcaatccatcacatcattcatatttgcgaaagaatacgggctgcatgctgatgtgctcagtactgcgtaagtattttgaactgactacaaactacatattgtcaaaggcatatgtttctgcggacagtgaaatcaaagtttttctcataccattttgttgctcaattttgcagggtgatttttggaatgcttgtctccctacccttgttagtcggattttacatagttttagagctaattaggtagacgcagagccaatggtacatcaggaaaacatagtttttccttgagaattccaaaacatacatactgacaacaaatgttgcaaaatatctcctgccaacattcctcattgcataaaactgtaatgggagtatcgagttctatggaatacttttaacacgttatgtaacaagaatgtatacttattctgttattcaaaagaatgtgttacagtatttcattattgtcgtatcaccttgatacagccatttcagtgatagtaggcagtaatattcaatatgtattgagaactatatcagtattcagagaagaatctgtctcctttggaaatgcaccttagcccgtaagttaaaaaaaaaagaggaaattttccagagttaccttagaatacgtttgactagcttgcctagctcttcaccacggtcctcctgcacatggtgccctgcctgcatgataagtaatgacaccagagaatggcaatcaatgcaatgaaaagtaatgagaaaaaaattaggcacgtaggttacaagtaatcatgaaagaaactcaaaacagcagtgagatattcttgtttttattttactctcttttttcatggaacagggtaattttgaatattttttcccctggtgaggacaagaggagggtgggggtggggtaaagacaacaaaccattggcagttctaaaattttgtaatttgcactgccacaaaaatcttcaactccatcatagttcagccaacgatctctcaagccccaacatactgtcgtttttgttttccatgaatcactcgataatatattcctcatggattcaatgtaaacctgtaataaaacacgccattcagatcatacaaattaaataattgaaaaggccaggtgatagacaagtaagctaccttaaggtcctttttcatagctctactgattgcgttcaatgcaaaaccagaagaaccagagacaaggtatggccttctgtataccattgcatcttcttctttcatcatgtatgggccactactagtcaaggccttatcactagctctgagaggatcctgaagggattcgagaaaaggaattttaatttcaaagcacaaaccaaaaagttacataatgtctaagttcatttcacactatgcctgctaacctgggaaaatatctcacccaacaagaaattgctgaaacatgcaagggtggacggaagcttcgcatgcttatccgttatctaaatataaaagcatttcgtgatcagtctatgactctcaagatataatgaagctttacaagacaagattgcgtagtatgtagcacacaaaaatatcagagaaaacttatgtggctactaataaaaaaaactcaccggtgggttaactaatatcaggtggttcaacttgtcctgatgttcattagcatatttgattacaattggagcaaagtacccctgcaagttgtatgtttgcatataaacaaggatcctagagattcataataggcatatccaggatggctaatgacaagtacttgaacaacaatggagagcttatcaggagcaacagcattgatcagagactccaaggacgatgtatattctggaaaggaaatagtagtttatgttattattagttgaatacacttgttttggagacacaggatactatgtagataattttaccatcaagagtatagtcaaaaccataatcgggttgaggcttatctgagaacccaaaacctgcagacacaaagttctttgttttcaagttaggcaaatatctacatgcttactcctacaaactgagcagcagcattaaccaaaaaggcatggttgttcagtacgatggcacaactttacagaagattataagcaaagccacacaaattatgactcttacgttcttgagtattaatgtcaaaataagatgataataggtactaaagatggtttcctattctaatttgtatgatcagcacgcatagactcctggtcataatgaccagtaattgcaatacattttctaaatgtatttttttcccaaacatatgaatgactttgcatttttctgccaacttaattaaatagtagttttgcatttgtcaagcatcaaacaatgtgcataccactgcaactcaccgagccaatcaaaagcaatggcatgataattgtctgatactacaggtagcacatttcgataagagtatgcctgtaaccaagaaagtccaaaggcatatattcagtattggaagacttttttgtagaaaaagaagaacataggcaaaaacctagtcaaaatcccacctgagatggaaatccatgaataaaaagaacaggaggattcgaagaactcccagcctccacacaaaaccacctgcatcacagtaaaaaagaacacacaagagcaattatcatctttgaagaactaatatacttatcctaaaggagaccaatgacttgaaaatacaaggctaaatgccgtcactattattgtacctgacaccctgctaaccacttatatagctcaattcacctgaaaacatcatttgaagattgtgattcagctcccattgtgagcccaaagatgggatcttttgccttccctttgttcccgtatactggatgagcttttacctgtaatgtaagtatcatcatatttttgactagcatattggaacaatcctactctcatccacatgaagaatatgatgaaatgaaaatgctcatggtgagacagtgcattatcaagcaaaaggcacacggaaaatctaatcactccgtcaaactctggattatgtagtttagatatcaaacagtctgcaagtgatgagtgcacaacaacacatcaaaacagggagtgatcacattataccattctcccttgagcaaaccactcatcggacttgctcgggccatccgtatacttccctgcaccgatcccccgcagaataggaacaagttagcgaataccaatattgacatgatgtcagaacccaactaatgtggactaaaatttgcagcctctgatccgattccccaatgctgaaacaaaacctaactcacccccactgaacgagaagccgtccccgatggactccggcgcatcgatcaagtagtaatcctgcaaaaaaaccccaccgaatcaaaaaccaaatccaactctcaaaatcgcaagccctggtgtggcggctggtgcaggacctcgtcgttgggccgggcggcgcggcgccagcaggggagcttctgggggcgggtgcggaggcggaggcggaggggtagcgcggcggcgtggaagcgcggcgcggcgagcggcggcgccatgggaggtggtggaggattgccatgggggatcgaattccgctggggttttggagggaggaacgaagtggggatagggtttggttggttggcgctcctcccgccacagtttctgaattccccgtgtgggtcccactcgtcagtggctggctcccatttctcacttatttttttgtcactttgtattcggcaaaatttgataagttttcccaattcttttataaggaaactaccaccaggtcttacccagtagttgaaatcatattaaaggagcaaaaaatgttataaatatacaaaccaaaaggaaccgaattacaaggcttataaccagctacaaactgaaaatatatactgaaaaaaataagaggttcattcatcctatataggtgtagaagattttttttttgtttgaaacacctaagccaatcattaacatcatcaggaacagcattctgaaatatgaaagcatttctttatttccagatgtgccaacagactataaacattatttccaaaaacaccttgcttcgaaatctgattctggctagaacaatcatctgaaaaagctctatattatggttccaaataaaaccaatcatctcccagcaagttctccaaatttttgtgtgctgcaaaatgcactagacctcgacaagtactagcatgatatactatctctgaacttgacacctgtacttattctgtttttcttggaataatctgcagccaaattccagctatgtacaagtaaagatgcaacctcacatacatgccaaaatttgattgatcgatatatttcttttttaaaaaactattgtaattacatcgtctttgattctgacatttgcttattctgacgatgagagaaacaaatctgtacatcaagaagagaagctctgtatctatcatatctcagctactcaagtaactagccgtacgcccggtcccaccgccatcgccggcgacgagctcggtcgccgtcgccggcgggctacgggtaggggtcggtccagcacacgtccccctccgccgcggccttccaccgccggttgaatatctgcagctcggtgtacgaccgctgcctcacggcgagccggtcggtcgccgccttcgtcgccgtcgacgaccgcttcgccgccggcttgccgccgccgtcgccgagcgtggggatgccgcggtggaggacgtactcgctgtcgacgatgccgacggcgagcctccggtcgccgccggcgcagtacccgagcttgaagtcgaggccccacgcgtagatggggtcgttctggatcatgtgccacgcgcaccgccatgccgcccgcgagaacaccggcaccatcatctccacccaccccgtgcatggcggccccgtgctgttgtcgtcgcatctcccccctcccctcgtcttgtagaatctcctgttccaaataaattttacggttctcaacaaaaacgaagctgaaattgtcgtcgattcgggggcatatccactctgtgtgttttttttcctactaaattcaatgcaaataaatataaaaaatgataatgtagagtagagtaacttttaacatttttaccaaaaattaaattcaaattcaatctacacattaagaataaaaaagacaaattccgatatactattcatgccaaaatgataagttgagtttatacaattttgtgaaatggcatatatatggtatgaattatcaaacttttttttaaaaaaatatataactatgtgaataagtttttgacaaacgaaaaaaaattgtcccctcaagggatcaagagagtttctatcaatttcacatgaaacagcttgatttgttacctgtgaacttggcctttgcgggcgcggagtgtgaggcggtggtggatctgggagcggtggtcgagcgcgggctgggagatctcgaggcgttcgcggcggacgacgcggaggtagcggatggggtcgaagccgtccacctcgatgtcctcgtcccagaggaagatgtactcatactcggccaccatgtccgggtgtaagaacctcttcccgaaccaccatttcgtctggtccttcgccgccacgtgaatcgcccggtccgaccacccgagttccctccacccgtccatctcgccgtcgtagtggaacaacatcaccgtgaacctgtcaccggggaactgcatgcacgccaaccattgtcgccgacgagaatcagctcaagtttaagtgctaccaggggcggatccagcatgggagcagcggggtctcgagtccccaagctcccacgaagacctcactaaaattttttaccatatgtagataggtgggggactgtaactctatctagatagattgggaactttaactttgagcccccaaactcccacgaagatctcactaaaattttttaccatatgtagataagtgctatctaaataggtaggtaactgtaactctacatgatttactcagatcatattccgccactgatgctggcgttgaaggaaggaactgaagaagaagatatggtattggtaccttggagacgagcttgtcgacgacggccttctgctttatgccgacggggatggcgaggaggctcttcgccggccgggcgacggcggcgcgccgttcggggttgccgccgagcggctccatctcgaagttggacttgtcctgcacgatgcccttcggcaatggctcgctgcctgaaggcctgcactgattctgcaaacttaacgagcagtttagtttgttcggttcattgcctgcattgtttgcattgcaggtaatatctctgttcttttaggttaagtacggttattaagaattttgataaaatattatgattgactaagaagagaaagtaagcagggaatttgaatgctattttctccgtttcacaatataagtcattttagtatttctcacattcatattgatgttaatgaatctagacatatatatttatttagattcattaacatcaatatgaatgtggaaaatgctagaataacttacattatgaaaaagagagagcataagtttatgattggttgaaaataaaatgcgtgtgaaaaaattgttatattttagaggagatggattctaatttcctaggtagatgtccattcgtttcttgatgtaaactaaatagttacaaaaacctgaaaaaattataggtaatatattatttcataaacatgtaagttcgaattcgacttctataaatttaaaaaaaataataaattaaactctaactagtatacgtatattcagttaaatttattatttttgttataatatatagaagttgaattcaaacttacatgtttatagagtaataattcttatctttttttgaaagtttttcataactatttagttgataactatttagttgatatgtaagaaacgtctatctaaatgcttaaaagagtttctcatattttataacaaattttgaaggctcttgttatatattggaatggagtgagcatctgttctgacctcgcagatgctgctgccggcgagttccgctcgctggacgccgccggcggcggcgccggtgcctgcctcttgcacctcgctggtcggagccctcgtctccgtctcttgcacctcgctcgtcggagccctcgtctccgtctcgcttacgaccatttctctcggccgtaactgaagaattgacaaattctgcagaaacaaattcataagctttcagaattcagagaattgattttatcattcatctatctctgtgcttgatgtaaagaagcatcaaggtgcatacctccttgtgatcaagcgtgacgattgcaccgccggcgaacaccagcacgaagaagatgagcgccgccggcggcgcgacgccggagaaccgcttgcgcggcgagtcattcggtgcagctggaccctgtgcctgtggtaatccgtcagaaacagaagcaacttgtgagctcatcataatcgcacatgtgttgcgaatttagtttgcttcaagattgaacaaggtcacagccatgaagcaatctctgaatcaatctgtctgctcgaactagtcttgatcagagagataatatcttcaggtaggaaatcaagaaccggaggagaaagcaaaggcatattccctgaaaacccaatcgaggaaggaagtctattatagcttaggtctaaaactccccctgaattctactgcaagggtgcagtagaagcaaagaaacgttcactatggttaaaaactgagaggtttaaattatggaggagaagaggttcttccagatcaagaagnnnnnnnnnnnnnnnnnnnnnnnnnnnnnnnnnnnnnnnnnnnnnnnnnnnnnnn

SEQ ID NO: 14639 - DNA, 15782 bp, Oryza sativa
gttagtactcagtgcaaccgatggcactgcccagtgcccacccatatcggaatgtatatggaacaagaaatcaatcggattaatgcgtagaaatatgtttttcagagtttaagactgttccattcagattgacacaaattctggcaatagaaaatagtggcaggtatccatgtaacatatttttgacggaagaaggtagagtaggctctaacttatagtcatttcattaatagaaatgaggtttacagattacatattaggtgtgggaattatcagagagaaaaaaaaaggaacaaaaagcaggacaaaccaaaacagaaaaagggagaatttacagatatatgtacatgatccatgtaacatatcagggatattaataaaaaactttggactagtcattgaattaaaacaggggagtaatttatggctcattaataactatagttactgaatcaagtagtatcaaatctaaacggagaaaacaaatggaaaatggcaggaccgcaggtcaggaaagctagattccgtgcgagaagtggcgattataaaaatcaaacctttgaacataattcatggaattccgttactaaatcaacaattaagttcatggaattccgttactaaatcaacaccaatgcgatgtaagcatgacaactacctaaagagtataacgaaagcagaacagctaatacttcagaagaacaaacaaaagacatatggaaagaacttcgaatcgcaaaagaatcaactcaaaaattaacttttagaagacaattgaaatcataaaccatcacgtgcgcatcaatcccggagaaattcgatcttttagcaacggaataaaccgaagatagcgaagaaccagcagcaaagatagcagagcagcgtaaattcaggggaagaacgttacaaaccacaaacttaacgaattttaattcaacctctatcggaatcaactccagtaaccggaacaaataccccaagactctcaaaaattcagatgaaaaataaggcatgaaaggaaaaaaaaacagagaagatcaagaaggcggcggccgtaccatggtgggagagcaatcacgaattcctccacgagccgcaaccgcggcagatgatcatttgattggaaatcgagttcgcaatccaaaaggcgaggcggcgcaaaacggaatcacgcgatgaggaggaggaattcggagttgggagacgcgaagaggagttggggttgcgagtaatggagggatgtttagtgctttagccccgcacggcttttggttttggttccatgctagtgttgcgtttttttcaaaaacacccctaatattcctcatattgtgtgacaaacccagtgggtttaaggtttgaaggtttcacatgattgaccccttgttcacgggtttgaaaggtagataaagcatttatcatgtcatttttcctaaaccaatactgtactattcttttgggaggaaaatattagagaagataaagtacttgttctagaaaaaaaaagtactaacaaagaacttcatcaaaagctacgtgtgacagtgacaccagagaccagagcttgcctttctatattctgaattagtaatttggagaaagttaaatgggtttttttgtgaaatatgcaggaatatagtttatggaagtcaaaaggatactactagttatgtgacgcaacatttttttttgagaaatgcgactcatgatgacctgtttagatcccgctaaaaattttacactatgtcatatcgaacgtttgaatgtctgcatgaaatattaaatataggcttaaaaaataactaattgcatagcttgcgactaatttgcgagacgaatcttttaagcctaattgctccataatttgacaatatggtgctatagtaaacatttgctaataatagattaattaggcttaataaatttgtctcgcaatttactgacggattctttaatttgtttttttattagtgcccgaacacccaatacgatacccaatataatattcgatgtgacgctaaaactttacacccctatatctaaacatcctctcaacattctagggaagcactgagtacactcgtgcacttcccgttttctccacccgctaatacgtccaaattgcccatcgattatgttttaacggcaataaaaaaagcctaaaaagccaagaaaaatggaaacgaactaactggtaactgaaaatgagggattggcagtttgagcaccttatttacctttcttctccgtttctatcgagaaaaatagggccgcacatgttctagcatttcttggtcttatctttaacttcgaaggggagagtcgacctgcaggcatgcaactcgaattaactttttattagtgctcccttaacatagaatatgaaaataaatttccgcaaacaaaaatggaattgataaaaattggaaggaaaaggaggggcatttattatgggtgagacctgtatgatgaagagaggaatggccagaagctcgtgtgtcagtgctaggaagggcccacactctgacaggagaagaatctgaaccccacgaggggctttcgacgtgtggagcccacttcctctgcttctcacacattgcagaaaatcctaactgtaccccaccatgctcaggatcttctgtggccttgcatgctgcaccaatagaaagttagaaacccaacctaatctagcctttggaattttggccatacacaattcaggcaactaggtgtatcagattatttttgtagagtagataaatcgcaatctcacatatgaagagtttaaggtttttttttaatattttcaaagaggaataccctatcactgtggtaggcaataagaatgctccaaaggcatccaaaaggtgtccatgcctggatcataaagttgtgatcttgccaagttgtatagctaaaataaaccaaaaagaattgcttatctttattggatcagaaagctatctccaccactgaagcccaagtcaccttagaaaaggatatatgtgcctctgaataaaaaggcaaatgaaatgatggatatgtggaaaaacaccaactagcataactgtatctgctaaccaaaacatgctattattgtcaccaaactacaataacttttgtggggttctgcatatatcagcgttttatttattgtttgattaaattttgtatgtgttcttgagaaattaatgctttttttcatattgaaaatcaatcaagttaactgcatcccaaaggatttttttgggggcaattttcaagagagtggaagggaaccatattgctaaattaaaccattaaaacaaggaaaaaatttatctgaaaagttagagttggaaggatgatggcaaggtatccactcgatttggatgacattcttttgagtacaaacttataaagcatgcaactataaatgcttccacttgcatatgactaaaaatatggaatagttatgatccaaactgcttagtatgaggtcatcctgccgtggagataagtggcttcatatcacatttgtataactttggagcagctccaattatttttcccttcttgcgaggtaccaccaatgttggtaggcagggccaggagaaaaaatggagaagagaagagacaatttttcagaattaggtgccttgtactgtgttgttttgccggccacctttggttgggagggaaaggtcgttagggacattgaagtacatattttgccttatgatatcttggacattctacacagcattagatcagcataggtagcagcagatgaaatccaaccaacacaatgatataaaagaaagaagaggaagaaaaaggaaaaaaatattttgtatgtcattaagttgattgtgagttgtgacatacccatagttgaccatccagtgaagatattcttttgttgacaactagaattatcacctcactttttataattatctatgcctcatgggtcatagtgtgacaactaacttatctaggtttctaaagagcgaggacaataattaatgtaagtgggctctacaaattgacacatcaggtttaccttaggtaaaaaagagagaagatgagacatgaaaaaaaaattaaactacagatatgtaactagctgcagcccgagatccaatacatcgtaagtacaggtatattaagctgatcgtttgtgatagttgatgtagcagccaactcgtaatagctatagcagctgcagctagccccaataagcagctgctctttgtatgatttttgtttcccttgattttttttaaaacttgttttcttaattaatggctgtgtggttttgggctgcagcctgtagccgatcgatcggcttggttttacggtcgcagcataaaattattatattgctaggttattagataagttatagatgatatgatgattaattttagagttatagttaactatattactattataaacttgtttgtgtggatatgagctgtctctcgctcgtgtcttgaactttgaaatgaattattccaatccaatgtagccgcagccgcagccgcagccgaacaagactttctatgtgggatgcgtgacatgtgtcgcgtcacagatttcccctgttttttcctctgtattttgcactcccgttaacgttgaaaatgcagttgttgcctagcgatgatgaactgaccgatgtaaacgttgcacctaaactgaggtgtccagaagacgccgtggtcatggaggacgttggattggaagttggaacaagcccaactgcgtttagctgggactaattgaggtgggcgacatgatataattattgaaaaaggttatacgtgtttattttttctcactaaattcttatccgtactgatatgtcatgctacgaatgtatttagatttttttcaacttccttttacctaaatcaaacgtttgggatgattgttaataaaaattttgtaataaaaatttagtaggtatagcagtgctcataattattctcgtaaggtgtcatgatcaatatttcatcagcctactgttctgataaacgtggaactgcatgagaagaaaaagaaaccgtttcatcagtgattttaatcctggaaaaaaattaatttgacagattaaggaccatccctgtagccataatccatcgccttaaatacacggcaacatatcctatgtacacaggccctcacgtatacacacgtgtacaccaactaaaaaatgtcaccaaaaaatctagaaaaaatcatacacatactttcaattgtattacacctagggttaaaatcttaacgtcaaatttattatatcttagccgtaacaaaaaaaaaactgacagttttaaggttgcaattttgtcagaattttatcttttttgttattctctatgtagaatgaatttgaatatgcaactttgcacgtagatgtaatactattaaaagtacatgtatgaattttcctaaaattttttatgaaaatttttagttggtgtacacggtgtatacacgcgagggtctgtgtgcataggatacgctctctaaatacacaacgtgagcccgtgatgttatactatacacgtggcacggcgaccccttgctaattattgaatttgatatgatagcgtcttgcgccgcctacttgactgattaacacccttagctatattgtttcttcgattgcattgcagacacacacgcaacatcatatctcatccacaaacatatcctctaacacatacgccatacgacagatctctaaaactcacttgggtgtaatactccatccgtttcatattataagtcatttgactttttctaaaaaaatatttatgtttgatcaagtttataaaaaaaatagcaacacttataacatcaaattacttttattaaatttaacattgaatatattttgataatatatttgttttgtattgaaaacgttgctatatatttctacaaatttatcaaatttaaagaaatttgactaagaaaaaatgttaaataacttatgtaatataaacggagagagtaatatttatgtgcatcaggatttaaatcctacttagtgtaatagctccataacactaatctaggggttaattaatagtagaattaaggagagtgcctgctgcctagctagtactagcaaggtactctagctagtactacctccgtcacatattacttatcgttttgatttttttcttgtaacgtttgaccattcgttttaaaaattaatgtaaatataaaaaataataagtcaaacttaaagtagttttgacaataaaacaagtcacaaacaaaataaataataattccaatttttttaataagacgaatgattaaacattacaaataaaaactcaaagcgagaagtaatatgggacggaggtagctaagcaatatgaaggattttcatttatgcaagggaggcgttaccctagtagtggcgtatgggtggaaagacggagcaggaggggtatgcgctgggtgtcccgtcgcctacgtcaacgtccgtgtgcccaccacggcaccaccacgtcttcttcttcttcctggcttcctgctcgcctgcctgccctctagttatcgtggtcggcgtcaacggaatggagacgtgtgtgttgaacggcgccgttgggtggatgatgcactgcgttgttgctgctgctgcgcgtgtggtagacgccccttgcttcgggctaacgagatggcaacccgttgattgagacctcccccggtcgcacacgccagagatggtcactctgctgctgctaggggtgggtataaacaccgaggatcaaaaaccggaggctgaaatatcggttaaccgaattgttggttcgtatgagtttatgtagataactttgattttggggcatttaactatttgtcacttttaaatttgacgtttactatttgttatctatgtgttaacgatacgtggatccttatgtgtgaaataatatacgggtctcggtgacaaattattgattgccacatctaagagtgataaatagttaaaaatattttctcaattttctgcttttaaagatcgaaaaaattggaccgaaataccaatgatgaccaattacccacccctgctgccgccgcgagcccatgacctcaagagacaaacgccagcagcagagcacagaaatgcttcctatattccctggagcctagagggcaagcacgatggaattttgtccctcaagataacgtacccctgttttagtgccaatagggtaacaaactaaacgtaactttatcattgctaccctaccaaacatcggtaatctggaagtttcttctcacaaaagttctcctaaattttagtaagacttcaaattaacgtaactaacaccaaaactttggtaatgttaaagtgtaccaaaattttgacattaccaatttttggtaagattaatttttctcaacaaaatgaataagtccttaaatagttattaaaaaggtttttaaaaaataacaatatagattaatatgatatatatcactccacaacaaccccagatcaaattaaacttctacatgttttaaaaaaattaaaatctaactacaactcataactcggaattcgaatttgaattatatgtttgtgaactgatatattacacatcaatctatcatcacaatttttttaaaagattttcttgactatttaggtgtcataaaaaaaggaaaatgttttccccacaaaatctagacctttaatagcatggatcatttccacaggacatacaatcgtattcttttaacggatccaacaacagtacaacacctgttaaaactgctccagcaaaacggtatgctagcaagcctgtcaaacattttcagatacaatcatcagaacgccaatgtggcgagagtcagggtgggaggagggacgctgatttccagaatggtggaaaccggcttactccgcagaagggagatacacgcggtggaagttgttcatggtcagcttcctccggcaggtagggcacttcttctgagcctggattgaggccttgatacactgcttgcaaaaaatgtgaccgcagatggtcgatgacggttcgaccagctcgttcatgcagacagggcaattgaaagttggttccttcggaacggccttctcgggttcagggagtgcctgcattaccaccaaacgctgcattatttaactgaacatcacagacctgataggtgtattgaagaaattcaagtttgagtacattgctaggtgtgtcaattatatgtatcacagggctggtgctgatgttggaggatctctgatgaccatgcctaggatacctgcccagagtcagagatagtagtatatccacatgctcatcaactgcatcccctggaacaaagcaacacacaccacattaataaatggaaaatgtggtctaaacacatgcgggaaactttaaagaagaaaagctgcgagaattagtgcctatggtttattttgaggagaattggcagatactgtgagattgaatagcatttatcatatccagcttgtagtttataagccatggcaatatggcatactaaaagagtacatgtctcaaagagacctaaaacatctttgcaacacctaacttgaactatcctacacattttgacaggtgttcggttacttctcacaaccttgacttacacagaacctcgttttttcaattcctatggtccatgtcatagtggaaaaaaccggaccgggccggcggttcaacctgaaaaaaccggaaccagaagtctccacagttcggtccagctgaaagactggacatgcatccaacccggattgaaccggctgaaccggccgggttttgaataaaccgggcattaaaccgccttggtcggaccggtaaaggagatatacatgggctccagtaaggcccagtcctagcccacgcggttgttttttacaaaaatcagagaaatacttgcaggcgcgaggactcgaaccttggtctactaggttagggtctactaggttagagcgcttggctctagccatcccaccgttctttcacttgtgtgataaagaaaatacacattgcttacataagttattgaaccgcggttcaaccagcggttccctggtcagaccgttggaccggtgaaccgagaggtcctccgggtcactcaccggtccggttttttccactatggtccatgtgccagagcttcatacttaggcttagctttagccctcttatggcacttttttttggggggtgggggaggtggcaagtcacactttgccaaaggctaggaagcattagaataaaataaatgatccttagtgctgatttttctgctaatgaatcctacatggtaacttgctatgtctaatgacccaacccagtgacatctacagatagcagttgtaagaaaactgaactttctgaagtcagaaagactactttgtgtttgtggcactcttctccccactaccacacaaggcaatctcaagcggtggtgtgagttcctacacattatttatatcctatagtcaatgggcaatatcaagcagcagcctgaatctgtttatcttacaaccaaatagcgcgtgtataaaactttggttctgataggagtgcggagctgtacaagaatattgtgtatagttggctagtttccattcttgcaggggctcataacaaatgggcacctaagttggcaacagcctcaacagttattcatgtaactgttataattcttgatgctcagaaaccaacaagtggaagacgcactaaccatagatgtaaaatctctcataccttagatgcttgtacaattacatgggctaccacgctgagtttaatggggggcaagtggggatcagggatatggaatatggggacgttcccaccaccacgactcacccaacaggggtagactattcccagatagcataatgttgggaggcaacaaatcccatatctccataccctaaaagaggaatttcctgctagggaatgtggaatgggtacgaattgctatcctatgttggatacacacaatgtaactagcataacaattcacactaatctgatgccagataaataatgttatttgagagaaactgatcactatagaaaacaaaaggtatgaataactagttccgttcaaatgccaacaatatggacggggaaaaggacgtgctggggtacctgcttgtccaggggtagtttcagaatcatcttctatggtcacaacaggttctgtccttggagcctgctgcctcacctgaaaaataaaggaagcaacagcgcaacaatgattctttcatactgaacttgaacaatcatataataaaataaaagagcaagaaaacaaatatgtgtgcatgcagaaataagaaccaagcacaaggatcatacttgagggaacgagcttgcagaataaatcacaacatcatcattgatatcatccacgataatgggacaactactcattccaatgtgcggccccgcaacaactgctggcaccaaatactgcgaggttccagccacagctacagcagaagtctgggcgtgtgagacgagcacactactggaaggtgatcccccatcatcagctccttcagctgggagtgagttcaggtccggaagaagttgcgaaagcaacttgttagtccgccgcctcttcggaacccttcttgcaaaatcatgagagctcatactgtttcgatgcaacctaatggcttgagcaataggagcaggaacctgcaagtttcaaacctcaacataaaaaaaccacaattccaactattaggattgaatacgcctttactcttttaaaagtatgagctagggattatgccctgctctcagtctacacccacctatcacttcaaaatccaaaaacccaacctaatagggaaacttcatgattttccaccacccactttggtattctagcctctcggtctaggatatgccatcaacccatcgtttccattctaattgttaaaatgccactgtctagtgttttgtcatcaaagccctggggtatgccactttgggcatctttgcaaaatattttccacttccatttttctcttttgaacaaatggcaagtttggtgtacacattttgccactggcgaaaggcagcatcaccaaccttccattcacctaggtcccaagaggccaagatactaagtcatcctcatcactaaggtccaagtggtctgtccaacgcgcaaggcgtagataatcgaactagcataccagaaacttgatgtgaaaccttcatatttaatcaagttggaattcttcctattttggtgaattgagctaaatgtgcctgacaatccaagggctgagtatacagaccacactattttgatgcgcaataaaggagctgtagcacgcattgacacaaaggtgatcatgcagtagatatctttgtgagctgggagcagaatcgaacaaaatagatcctatctctgcgtgcgcaagataggaaggcacaagagttgtgtctagtagttatccaattggttagcttttgtcgtttccttttatctatttatttcctaaatagagtgcatgtccttggtacatgaactaactcgagttggtttactagagccgctgtacaaaagtgagtaccacataaaaccagaatggatttattaggaggtcctacacgtttatgttacgattcgcagtttgtttttcttgctgaagacgctagggcttgcgtcatatatactgcaactattgtagcctagggtttgttttattcgtttttgcatggctgtcatcaagcatgtctccccagtacaaagatagatggcactatggcagttcgccagttccatctgctataagttgaagattgctgccgcctctaccactctacagtttggtgaagggggcgagtccagggtggttagttcctggttgcatcacttgatccccgcaggagacctgttttgttcatgatcttggaaggcgcacgggtagaggtttgtctagggtttattagcgcgcattgaggtttgttagaacccactgtaagctggccttcttgatgttttgcttcaatatcaagatactttttggatcgcgttttgccattttattgcatgagaacatcaaaatccctctacttgaagatggaaaatatcttgcatagagctatcataaactaataggtagcatttcaacatttagaaaacaggcgctgtggcgtatcctaaagtgatatcgcaaactatgaaatttcccaacctaattatccgattaatcgtttccgcagctttactcggctcatatcctagacccacatacatagcacctcctacctacaaaattcttatgcaaagggggcggacctaacaagccgattatccatttccgctggtttattcggctcataccctagaccacacacatagcaactcccctacctacatgttcctacgcagcggcggatccaacgtcacgcatgggggtttcatctgaacccccccaaacatccattagcactagggttaagacaagggggagaaaatctcccggatttatttacaagggaaagctaaggttaagtcaaggagaaagcgcgtgggtgtagaggaatggtaaagagggtctgcgcgcgggtgctcaccggcgaggggctcggtcggaggacggcggcgccgctgcctagcgggacggggaccggcggtgctcagcgtcggcggggaggaggggcgaccggcggcgtgcggcggtgcgggcgggcgtgcgggcgaacccagcagaggaagggggacgcgggggtcgacgactaggtcagaagagaagggaggaaaggagttataggccaattaaaagttgtcgctttcttctgtcgctgggctgttcgttgtatgggcctgacgatttcttaggggaatagtctagtttaagttccttaactactgaccacaactattaaaaccagagcaatttaactccgtcgaaggttttggagggtgtaagttcaagtgccttaatttggattcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagaaagaaaagattgaaagatcttggattaaacaatttgtgtaattgttactttggtgataaatgataaaccgatatttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcaatactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatattttatatgcaaccgtttgatcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcagcataaacatggttcaaccggatggtcacaagtgttgatctcggctcaagcttgaccccaagatggatggagcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccttttatccttgacttaagttgtgtttcttggatggatttttcatgggttggatggccctttgaataagctttccatagagtccaagaacgccaaattccgagacccgagtcaagagatatcgccgttttactaacggtcggttgagctgaaaagtgacctgtgatctgaccgtgggccttaggccggtctgaccgggtctgttagccggtctgaccggcgtggtaaggccggtctgaccggccccactggtctgttgcactggtctggtttttggtggcgatacagagccgcaaccggtcagaccgagccgtggacggtctgaccggccactacactgcggtcagaccggccaggttgagtgggctcaatgattgccctgtaacggctagttttctagccgttacatagtagtccggtctgaccggccactctatggcggtctgaccggcggagcacagagttgggtatttcgactccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagccaatccaagtgcgttgcttcattgttatagctagtgtggcacttgatcatactcggcaagcatcctagacttgttactcttggaggttgccgcctcctagacggcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaaggggccgtgcggtggcttcgtggttgagcggtggagttgggctcgcctcaacggggattaggaaaccggcgagtttccgaacctcggtgaaaaattccttatctcttgtctcatttatttgttgcatttacatttgtgctatttacattcatagagacatatttgagcccatatcacttaggtttgcaaaacttaacttagttgcttagctaaccttgcacctcaccttgcctagcaacttaggttagttttgtttaagtgccattaagttttaaaaccgcctattcaccccccctctagtcgg

SEQ ID NO: 14640 - DNA, 1769 bp, Oryza sativa
  unsure (1)..(1769): unsure at all n locations
nnnnnnnnnnnnnnnnnnnnnnnnnnnnnnnnnnnnnnnnttagttttgtttaagtgccattaagttttaaaaccgcctattcaccccccctctagtcggcctccttgatcctacagagggaggtttcgctgacgtgtcacctatgtggtggtgctgatttggtctctgtcctacgtagtgcttatgtggtattagaattaaaaaaaatgtgagactcatttatcattcacataaggaatgttgtgggacccatatatcatcctctctttctcaatcccttcttcctcctccctccctctcccttctctctctttctctttctctcccccttggtcgtctacagggacagctagagcagcggtggcggtgggcggggcccagagtggcgacagcatgtcccgtgggtggtgccgctggccacattcgaggaagccggagacgagacgccgccgagaactcatgcccacaagatataaacggaaagaaaccctactccagccgacgcgccccagtctcctctctctctctctctctcagctcttatcggctccgatgacctaagcgcacacctcctatcgccgccgccgatgacgacaatgagagagatgccgaggcgctgctgctcgcacagcaggagttggacaaggcggcatcagcaccacgatgatgaaatgcgagagcggtggtgaacgaggacgtcgtcgatatgatggcaccatgggccacgacgagacgagaggaagaggaggaggaggaggtggtggtggtggtggagaaggaggggcgagcacaagcgacttctacgtggcggctccagtcggagactaatgaggtgagtggctccctgatgaggatcatctgcgtgagttcttggtcaccgaggttttcgcgaggtcaccaccaccgccgttctcatcttaggtgacaacaactcccagtggaactgatggtcttttgttcgatggtgatggtcaggggggagcagcttcctcgccgtcgttaccccagccggtgtaagtggctcctcatcccacggtgaggatgtccttctcggccgtcaccgacgacaacttgatgttagccattccttttgtgaatgataaatgtgtcccatatttttttaaattctaataccacatgagcgtcatgtcaataccatgtaggacgaagactacattatcatggttcggattaagacatatcttatatcctacgacttatggaatatacgaatacagtataccttcgtgtatacggtataactccgtatacgataaggaaaataacaagaaattatggaaattatcatcacgggcaagtgaatagcagagtcctattcagaaaggattgggtttatactatatcgtgtgtggtccatagtatccgagttctacttgaagactaaggtgattcacggtataaaaggcataccccctgaggggtctggaggagggaatcagagagccagcaccaccaccatagtctacaatccggaggacgtgaagcctattcgccaggagatctcgacgaaaccatcttgtcgatctcaccagtaatctccaaaccatgttttttgaaattctttttggccagagggttggtaattggaatccaagcaattttgaaataaattgtgtagcgagatttataattttggatatggattatgtggataaagatgcatgtagaatccaacccatatttttaaaaggttttgcacagagggttggtaattcggatacaaaccaattttaaatgaattgtgtaa

SEQ ID NO: 14641 - DNA, 3792 bp, Oryza sativa
  unsure (1)..(3792): unsure at all n locations
nnnnnnnnnnnnnnnnnnnnnnnnnnnnnnnnnnnnnnnnnnnnnnnnnnnnnnatccccggcaagtgaatagcagagtcctattcagaaaggattgggtttatactatatcgtgtgtggtccatagtatccgagttctacttgaagactaaggtgattcacggtataaaaggcataccccctgaggggtctggaggagggaatcagagagccagcaccaccaccatagtctacaatccggaggacgtgaagcctattcgccaggagatctcgacgaaaccatcttgtcgatctcaccagtaatctccaaaccatgttttttgaaattctttttggccagagggttggtaattggaatccaagcaattttgaaataaattgtgtagcgagatttataattttggatatggattatgtggataaagatgcatgtagaatccaacccatatttttaaaagtttttgcccagagggttggtaattcggatacaaaccaatttgaaatgaattgtgtaatgaaatttataattatgaatagtaaggaaaaaaagtcccatttatatatgttctcctgtttataatatgccgtagcattttttttcataggaatggaaaattgtctctttttttatcttcatttctataccaaatttgacctttatttgtggatatatagcatgtgtaacaacatatcaatgttatctaaaatccacataatctgtttatgcttttgtatcgcactcactttttcatgacgaatagattttcaggaatgtctaaattacttttttgtcgttgtatttgtgcaacactcatttttttatgtcacatgccggtgcgatgcaacggtacaatggttttcacttggttcgcttttttttttctatatttttttctcactatcatcagttttattaggagagcagcttgtttccgtggaaaagaaagtgtgcaatatataagagggtgggaggaggactactcccttttaagtagcagagataaatttccgaaatattaaaatatattagtcatcatttgtgtcacactcacctcttacggcaaaaaaaaaaaacatggaatgtataaagagaaaaccttttggtcgtccttttagccacactcacttttttacaatgattaaattcatgaaatatagctaatgcttttttttcgctgcgctcactttttttggtaaatagtttatttaatattaagaaacactcacttccctcttgctcctgctagtttggcagcacgggagtacgagacggatgtgacgtgtctttgtggtgacaagtagtggcattgagcggtatggctgacagtgatgactgacgacgaataagagtgttggcatcgggcgactgtggagcctataccaccaagtggacatggtggtgacgacgtgcagcgacagatcgggcggtgctggatggcagcgggggctaagcctctgcccctcactctgccaccggtggcgaactggcgacgatgtgttagtttgcggaggatggtggtggcccagttcagtgggtggcgatgcattagggacgtccggactgcacgacacatctgagatccgatgtggtggggatggtgcagcaacagatagcgtggactagttccacttctcccctcctgtcttgttgtgttgcaccgaacaagaaaaaatcgtcgatggagaacgaagcttagtcttctagttcttccttttgtgtttgtatgttttcctcggtattaaggtttagagtcaaagaactcgtgtatcttttggctgcgtatatcctcaatattgaggtatactcgctccgtcccaaaaagactcaattcctgggttttcgtgtcctacgtttgactgttcgtcttatatgatttttttaattagtattttcattgttgttaaatgataaaacataaataatactttatgtgtgacttatttttttaatttttttttcataattttttcaaataaaacggacagtcaaatgttggacacaaaaactcaggaattgagttattttgggacggagggagtacatgccagattaatgaaaatatattttctaaaaaaaaaaagaaacacgagcatatagtgtaccccttgtggtgctttatcatttaattatagcaaactaagtacagtcactgtgtagtcgtcctgcttcttgggacaactggtctgcagcgagctacaaaagcaagagcgcatgactatacttctgttggatgatttggaaggagaggaatgtgagagtgttccaacttccaagtagaatctcgtcaggcgccgggggtcgcagaattcatcaatcatcaatgagtagtggacatggaggatggcaggctgaggcgccggggtttacatttcgttttcgaagtgaaaatcattttcgtctggtttactgaaaaccgaagaccagcattttcatataaaaacttttttgtgaaccctgagcgagcttagatgcatagagcagtctctgtgtagtccccttgtgtggcatcgcgttgatgcatcttaggtttttccgttcttagcgtgctttgtttaggacaccgcttgcggtcccaagacgtttcaaacttgctgagcatctgtaaaatgtttttactccccccccccctccttaataaaatttattaagcttgcgtaattttgttcaagactcgttaattcaacttaatcgtcacgaacgcgcgtgccagagccatataacttattagtaccataaaaaaacaaatatagaaccaatatgacatattctaatactacgaatttagacatatgtatgtctagattcatagcatagaatgtgtcgcatcgtatactagattggttttttttagagatggagggagtacttgcatattattcacgtgaaaacgctacctaaaaatgtacccgcacatacccactccgtaaaaaaaaaaacccaacctaaaaagagatgtgatccatcctaatacaacgaatcaacagactaagagcctagattgagatttttttttgggacggagggagtactgcatatgtatcaatatactatactctactacttcttcctttccaaaatatgagggattttggagagtgtggcacatcataatactaagaatctgaatagagagtaagcccaaattcataatactataatgtgtcatatctcttcgaaatctcttactttctccgtcctaaaatataaggtattttacatggatgtgtgtacagatttattatgccaggatgttttacatccatttaaaatcctttatatcctaggaggatggagtacaatgttttaggacctagggagtaacaaacaagctacatgacatgacagttcagattcgaatgctctcaactgaatattccatcgaaaataaaaagaaggtttgcgcctgatcagtcgcgcgccggcgcaacaggggccggcagcaacggacggcgatgcgtttgtcccgtcccgtgcaaatgtgtgcagtggcagtgcaagcattttatcgatcgacgcgcgcatccaagtggtggtggtcgagctagcttgttggcggatgcgaacgtgagagaggcgggccgctcttgtctgcacagatgcatgcacgcgacgcgcacggcgtgttgttgccatgggggaggaggattgggtggttacggggaggattgcgcggtgacgcagcgcatccacaaatatacgtgcaatatatatttaagttctatttttataaggattttactactctacgttatttgttaatgtgcttagtcaatagacagcgtagagataaa

SEQ ID NO: 14642 - DNA, 8993 bp, Oryza sativa
taaccaatgccttaatttggtactgcaagttctacattgggataacaaattagagatcgacgaaaagcggaatatcctttttatttgcgccctgacggatatctttcagtttgtaaccaccggatgacgcacggacggctcggatcatcccgaaaagatcaaccgcggcgcgagcacgagaccaccgtgggccccatggcccaccgacttacacaatctctcccactgccatgcgggcccacacccgcaacagtccagtccagagagccccgaactcctccaaacccgggggggccacaccctgccacgtgtcacccgccgcgcctccctctcatcctctctctcctcgtccagtgcttctccttctcctcctcgcaaccgaacgcctagaagcgcgcgtccaccaagccacggactcctctaattctctctcttgctttctctctcctcgcttcccgggtttgatacgtggtacgtgacgctttgcccttttcctctctctctctctctctctcttgatcagtttgatttgatcggttccgccattagcaaacctcgccgattctctctctcgatcgaacaggggtagggaagcgattaaccggcgatcgatcgatcgatgcaagtgatcgcgctcggttgatccaggaattggagagcatcggctgatcgagagatggcggggaacgagtggatcaatggctacctggaggcgatactggacagcggcggcgcggcggggggaggtggaggcggcggaggaggtggtggtggaggtggaggtgccggtgaaggtggaggggtagggggagtcgaccctaggtcgccgccgacggggacgccgagcccgcgtggcccgcacatgaacttcaatccgacgcactacttcgtggaggaggtggtgaagggcgtcgacgagagcgacctccaccggacgtggatcaaggtcgtcgccacccgcaacgcccgcgagcggagcacccgcctcgagaacatgtgctggcgcatctggcacctcgcgagaaagaagaagcaggcatgcatcgatctctccctgtctttttctttctttctcgtgttcatggttgatttaatttagtttctcgtgctctctgcatgactgaattaattatctccgagatacttctgaactttctattcgacagaaaattcagattttgattttaaaagaaaatcttgtcggaactatgttatacggagtgctttaactattcatcaacacgataccatataatatcctttacaaggattcagataatttttagtggtaacgatagatcggctaaattgtcgtgtagggctagatcaggccgttggcatgattcttttctgctttcaagaaaagatcagagtgttcaattaatttcagatatgattatagtcccttgtagatcatgtagtttgtattatgcaccacacacgtttgtggaaagaagaaagtatggcaacccaacggtgtcagtaatggacgatgagtgtgctatcttttttccttttccaagagtaggaaacaggatctttttaaaaccactcaattggccatgccaaaagtgagtttattgtgttcttttcgatgagaaaaaaaattatgactgttcatgatgctcctaaaaggtatttgtttctgagattgcctaaatttttatgtgagcagctggagcttgagggaatcctgaggatttctgcacggaggaaggagcaggagcaggtgcgccgcgagacttcggaggaccttgcagaggatctgtttgaaggcgagaaggcggacaccgtcggtgaattggcacagcaagacactcccatgaagaagaagttccagaggaacttctcagagctcaccgtcagctggtccgacgagaacaaggagaaaaagctgtacattgtgctcatcaggtcttataccgcttactttactcattggtgccattctgtatatgccactaaattgcaaaattttactgagttcctttattctttgttctactttagtcttcatggtctagttcgtggcgataacatggaacttggtcgggattcagatactggaggacaggtaaaacatgattgatcttttcttttcttttgagcagatatttcttatcatctccagccctagttcaaaaaaaaaaaattcttatcacccagccctgcatggttgcgtattactgtttttcatgtcttgcaggtgaaatatgttgttgaactcgcaagagcacttgcaatgatgcctggcgtgtacagagtggatctgtttactcgtcaagtgtcatctcctgaagtggactggagctatggggagcctactgaaatgttaacctccggttccactgacggagagggaagcggtgagagtgctggtgcgtacattgtgcgcattccgtgcggtccaagggacaagtacctccgtaaagaggccctgtggccttacctccaagagtttgtcgacggagctctcgcgcatatcctgaacatgtccaaggctctgggggaacaggttagcaatgggaagctggtcttgccatatgtaatccatggccactatgccgatgctggagatgtcgctgctcttctttctggtgcgctgaatgtgccgatggttctcaccggtcattcacttgggaggaacaagctggagcagatcatgaagcaagggcgcatgtcgaaggaggagattgactcaacttacaagatcatgaggcgcattgagggtgaggagctggccttggatgcagcggagcttgtcataacgagtacaaggcaggagattgatgagcaatggggactgtatgatggctttgatgtcaagctagagaaagttttgagggctcgtgcgaggcgcggagttagctgccacggccgttttatgcctagaatggtggtaagtgttcaataataagcgtaatagtactgtatcatatctgacaaatttccacagatcttgtgtttgacttgaaacttgtggtaatcaattttgttttgtatgtgtgatttatgtttttggtaattattatgcacactcctccacaggtaattcctcctgggatggatttcagcagtgttgtggttcctgaagataccagcgatggagatgatggcaaagactttgagattgcctcgccgaggtcactgcccccaatctgggctgaggttggtttctggatttcctcttcaaatgtataattgttcccttcaaatggatttcaaatgctgatgaaattgtttattataggtgatgcggtttttgaccaatccccacaagccaatgattctggctctgtcaagacctgatccaaagaagaacatcaccacccttgtcaaagcatttggagaatgtcgcccactgagggaacttgcaaacctagtaagcaacagttacttgaataactacatttccttttttttattcgcaaggaagaataactgcattttcagcactttaccagtacaatactagtaaatagtaatattagattatagttgcaccccaaaagctaatccatctgtcatgaacacaaagtacaaaaaatatttcaagtagtatgtacaattgcatactacttgcaaatatttcaagtcacaaaagtagtatatacaatgcttctgaacattcttgtacaattgcataattcatgtattactagtacctagcaataaaatttgccttttgttgcagattctgatcatggggaacagggatgacatcgatgagatgtccgctggcaatgcaagcgtcctcaccactgtcctgaagctgatcgacaagtatgatctgtacggaagtgttgcattccccaagcatcacaagcagtcagacgtaccggagatttatcgcctcacagggaagatgaaggtctgtcaccagtcatgtcctcactctgtttcagcttagccatgtccccactctgtttcatcttctgtaacttgtaactaaccaaaaacatccgctctccttttgcagggcgtcttcatcaatcctgctcttgttgagcctttcggtctcaccctgatcgaggtcttctcatagttcaattctctgacaaccacctgattattattctttcatgtacagcttaactgacaaactcatggcatttatttaggctgcggctcacggtctcccgatcgtcgccaccaagaacggcggtccggttgacattaaaaatgtaagcatccatcctcgccaaatcttgtgtacaaccgcaatatttgtgcaaagaattcatatccgtgtgcgtattcatggtgtttgcaggctctgaacaatggactgctggtagacccgcatgaccagcacgccattgccgacgcgctgctgaagctggtggcggacaaaaacctgtggcaggagtgccggaagaacggcctgcgcaacatccagctctactcgtggccggagcattgccggacatacctcaccaggatagccggatgccggatcaggaacccgcgctggctgatggacacgccggcggacgcggccgccgaggaggaggaagccctggaggactcgctcatggacgtccaggacctctcgctgcgcctgtccatcgacggcgagcgggggtcatccatgaacgacgcgccatcgtcggacccgcaggactcggtgcagaggatcatgaacaagatcaagcggtcgtctcccgcggacacggacggcgccaagattccggccgaagcggccgccaccgccacctccggtgccatgaacaagtacccgctcctccgccgacgccgcaggctgttcgtcatagccgtggactgctacggcgacgatggcagcgccagcaagaggatgctgcaggtgatccaggaggtgttcagggctgtccggtcggactcccagatgtccaggatctccgggttcgcgctgtcgacggcgatgccgctgccggagacgctcaagcttctgcagctgggcaagatcccaccgaccgacttcgacgcgctcatctgcggcagcggcagcgaggtgtactaccccagcacggcgcagtgtgtggacgccggggggaggctgcgccccgaccaggactacctgctgcacatcaaccaccggtggtctcacgacggcgccaagcagaccattgccaagctcgcgcacgacggatccggcaccaatgtcgaaccggacgtggagtcctgcaacccccactgtgtctccttcttcatcaaagaccccaataaggtccgtacagcgccctgcattctacttaatcacaatctcctgacacattgaaaaatgttctaatttgttggtatctgaaattctgaatctgaattctgcttcattttttaggtgaggacgatcgatgagatgcgggagagggtgaggatgcgtggcctccgatgccatctcatgtactgcaggaatgcaacaaggcttcaagttgttcctcttttagcatcgaggtcacaagcactcaggtgaagtctacatacaagttttacacactgtagtgtgattactgtagcatttacggcaacagatggtcttattggcaatttctcgtaaattcaggtatcttttcgtacgctggggcctgtctgtgggaaacatgtatctgatcgtcggggagcacggcgacaccgatcacgaggagatgctgtcagggttacacaagacggtgatcatccgcggcgtcaccgagaagggctcggagcagctggtgaggagctcagggagttaccagagggaagatgttgtcccatccgagagccccttgattgctttcacaaagggtgatctgaaggccgatgagatcatgcgtgctctcaaggaggtcaccaaggctgccagtggcatgtaaattggttgcctgctgggaagcctaatattactctgaagcctggaagaatcaggagtgccagcttgatgaagtctcctggctctttaactgaaagacaagactctttttctctccttaatttacagcataatcttatggaccactaccacgaacttaccttgcagtgagaaataattatgacactgctgatgctactgttggctcaaatgtttatgagctgattcagttatatgtattttttcttttaatcctgcacttggttcaagtacgcatatcatggcaattcttttaataatttcggtccttgttcaggattggattacttggcacgttctctccgtggtttgtgaaaataacctaggacataaatgttttgtaacttaagtttcagtaaacccagtcaaaaggaaacatacaattcaaacaagctgactgataattaacactgtatttctgacactaggttcattttctgagactgtcctatcgctgaaaccttttttttattttttgaaagaactgaaactttaccaagctaactaatactctctccgtccctaaatatttgacgccgttgactttttagcacatgtttgaccgtttgtcttattcaaaaacttttgtgaaatatataaaactatatgtatacataaaaatatatttaagaatgaatcaaatgataggaaaagaattaataattacttaaatttttttgaataagacgaacggtcaaacatatttaaaaaagtcaacggcgtcgaatatttagggagcataaatgaaggttaagttatatttctttaataataacttacaggccacgtggcacactccaattggtcgacaaacaaacgcaaaactggaatgataagggaaaaataatctgctactagtatttatcttgcctacacaacttccagcatgatgctttctgaaacgtccctgaagcatttacataggcaattgattggttcaatatctgcttccctctgcgagacatgtctcttccctaatcaatatcagaacgaaactgccacaattttacaatatatacagggattggcagaggccattgtgcaagactgcttattggttccaatcaagagtgtatactaacatggaagaaaaggaggaaatgaccatgctttcccttggagttggagctgctagcaagcactcaatatccaacagaaaattcagactgaaagaagtgacagatcacaaattcaaccttggagatcaagatcataacagtggccatgtgaggaagaagctaaggcttagcgaagaacaattgactgtgctggaaaatatgtatgaagctggcagcaatctcgaccaagtaagttcaaatttgtgatctctgaacattgatgcatgacaaaaatcccatgtttcctgctatttaatgactgaaattaggcactaaaacaagggcttgcggagaagctgaacataaaaccacgccaagttgaagtctggtttcagaacagaagagcccggtacttgcatttcattcacatgcatggattctaacttctaagacctctgaaaactgaattcatcaagatttatgaactgcagtttttctgatgattgcttttgtcgaaaattttaggaccaaacataagcagatcgaagaagaatgcaagaaccgaggtggttggagggcctaaacaaggagaaccgaaggctgaagatggaactgatgagggtttctcggcctgttttgactcctcacggcagcacccataatgtgtcagaggttactgttacttgtttatcttgcaacaaatcttcctacgagactttcacagtgtgaagaacctggcggtaaaatacatgagggtcaattcagtgatctgaatatagtttctgatcaatggagaattctcaaaggcctacaagattttctctttctttttcctttttacagaatgcgcaaaaagactgtattaagaaagggatacaacaatggtaacaagattattatttttttttttgaggaaaccatggtaacaagaaaatgcttccaaagtgacatagtctcccatgttaaataataaatatgcatttatttttttaaaaaaagtggatgtttcacttattcagatttatatgtcaagggggaacaacagtaacaaccaaggaggaacttttttttttttgagaggaaaccaaggaggaacttgatggaataatttaaaagaaagtgtcagcattttaagaattgcactccaggaccatggggttgaaatttagtacctccggtaatagaaggtacggaaatttagtgcaaattttagtacatctcaacgacggtaaaatttctctttctcttatgccattgatcattgtaaaatggaaagctactaaaacaatatacagcaatatcccccgttataacttcagggaataatgtcttggcaccttcctgacagtacagatgcagagctgctccctataaagttcagaaaataccaataagattgctctatctgcagaaagaatatgaactgaaaaaaagggcagtaactcagtccattgcatgcatgcatatgcgagaattccgaacttgaccttccaaaattgacaatgtctcaccattcgcctactcttaagcaccaccaccacaaaacaaagcgcctccccttaatcctctcctatccactcctctcaagctataaaaggagctcccaagaacacgaagcatccatcgatctccaagtctccacccatcaagattgcagtaataatccaagctcaataaacgagccaatccgtcgaagaaggaagcagcggcgatggcggcgaggtccggcgaggtgcgggcgacggtgctgggcatggcggtgctggcgctgcttctgctgctcggccaccacgcggcggccatcgaggccaacgtcggcgtcacccgccaggccagcttcagcctgaacggcggcgccggcgccggcgccggtgctcgcgctggcgctggtgctggcgctggcgctggcgtcggcgctggcatcggagctaacgtcggcgttggcgctcgcgccggcgtcggtgctggcgtcggcgctggcgtaggtgcgaaggtcggtgctggcgtcggtgcgaaggtcggtgctggcgccggcgttggagcacgcgctggcgttggtgcgaacgtcg

SEQ ID NO: 14643 - DNA, 16488 bp, Oryza sativa
ccggcgtgggcgtgcgcgcgaacaggcagaacagcttcagcatgaacagcgcgtgaccgtctgataccaccaaccccggctggttgatccttcacacgcggccgcatcaaactgatgattcttagtccggcttcgtgttgatcttcctgattaattttgttcgtgtgtttttaattattttttgttaatctctatttgttgcagttgcatgccatgcatgcaggctttttttctttcatcgaatcattcagtgttcttgtgtttgtaatctcttgttcttcttcgtgatctcggagatatataaatatatatatagcgattttaactgttattcgttttgcctctcataactgtcagtcatgagagattaatcagcatcagcaataaaattaaagagaccattcatcagagagagaaaaaggagaatgatccataaatgtctatcaagtatatataggggaaagcatagaaaataaacaggagaatgctgtgaataatctgtgatatatatatggtacaaactgcgacactgtgagtgactgagtacagcaatggccggatctcgcctacacagccaacaaatagtagtagtacatgaagactactctctcaaatgacaaatctcaatgccaatttgttgtgacgtcatattgtatcatactattatatgtgttgtgcttattaaaacaccaaaaaaaaaagagctattcctttcatcccaaaataaattaaactagtactaagttaacttattatggaacggaggtagcagtgggcagctgggcatggcctcaactcttctgcaatacggacccttaagcaaatagagcccacatgtcagccacagtaatgcagagaatctcgttccagtggacacacattgacacatactacgtacaacacgtatgtggttttatgtatactactactcccgtatacgtacgtgtatacactagcagtatgcaaaaaaaatactactacgctagatactgatcatatgctcatttgcgaagaaacttccacggccccctggctgctcccatcctgcagaaattcataaaacattcagtaattagatcagtcatgctgcagttaaacttaaaattgcttccaaattatcgagaacaaaatttaaaattcaggctgattttattcagactgcaaaatcacgaacacagtttgcacaagaatgcacatcttagagtgttaatcaattacctccaggtgctagcaaatgctctgacgctcatgtagatggccaaggcgatccagatcccgacgaacccgccgtgcgacgagagaagaaccaagcacgggatcgtcaccgccgctacgccgacctgcaattgaatcgatgcatcgccgcattgtcagttacatggtgtccattttaactttttaaggtttaatcgattcaaaaagtttaattaaggcaaaggttaatgtgttcgtgccatgaagtatgcaccaaaggcgtagtcgaaggcgccagagttgacgccgtccaagacaaaggccagcgtgtttatcgtctgcgtgccggcgacgaactgatcgatttagagacaatcgtcagatatgttcatgagacaattttttacttaatctctgaagataaatctgttcctgcttatgatgaacatctcaccggaacgcctctgtggatggtgctgatgacgccggcgtcgctggtgaaaacgccggcgccgaaccacatgccggcggcgaggaaggccgtcagcccaacgccaaggacaacggcgagctgcagcacgcgggcggtggtcaccgccaccttgtagtgatccttctttgcaaacgcgctggcaagcaaggcctgagattgatcgatcaatttaagccaaattaatcaagcagccatgcatatcatcggaatgtagctaagctaggtagctagctagctagctcacctggccggcgacagcgaggccgtcggcgaggagcgatgaggcgagccagacttgggcgcagatctggaacgccgccatggctgtcgcgccgtggcgcgccgcgagcgacgccgccagcgtcacgcagaacgttacggccaccaccctcgccagcagcagaaaccctgcagcatcacatattcagatcaatcaccactagcttcctcacctctgagatttgctccgataaaaaaaaaatatctcgagataccggtactcatggtatcaaatcgttttcgatcgttggatactccaaaatgattgagtaccgtaaggtaccgtcgtagcgataccgcgagataatttttgttggacccaaacaaatctattcacctttacttcttctactgatctacttggaagggaaaaaaaaagaaaaaacagacactgcacttcactgtccaaaaatgccgtgccatttttctgcttaccgcatccgaggaaacgacgaaacttgagtgattttagactggacgggatgacatcgaccttcctcacgagcttgcacagcattatcagcgtgatcaggtacctgaaatattaggacatatcacacggttaattttgggggaaattagtgttaacattagtggatataacggtctgacaagtgacaagagtgatcgatccttactgagaaatgacatgggcaatggctgcaccgaccacaccaaaacggcaggtgaatatcaggatcggatccagtgcgatgttcgctaggtcgccggtcactgtagaaaacgtaatgataaatcagtcattaatttcattgttagtggtagctaattaatacgagtaggatgttttatacttaccagttgcatataagggtgtcttggtgtccttgaatcctctgaaaacaccttgcattgccagagacagcagcacggccggagcacccagagatctcactaccaggtatcgcagtgcagggatcatcattggtgaaccctgtcattaatcgacacagtaattcaaacaccggatgctaatacagcaataacgaataatcaaaagtaaaagaataaccatttttttcctgtagaaaactgaaaaaaaatgcaggttattttcggggacgcactggattcaccagtggcctttgcatcttaaagagggtgatgagaaagctgtgaagattgggtaccaaaaattgaaagttaccattatgaaattctactcaaaatctagatagagttggagagtattgaattccaagtattgaattgttaattgaaatcttttgttgtgaggcttgttctagatgtgtttgtcgtctatttgtcttctatggtggtgtttgcttttgaacttgtttgtaaccgcgattgtttggtgatgtaatattgtggctatgtatatccttcgaaatgtagaggccggattttatttaaaacatcataaaaaaagaaatctgaaaacgagcagaaatgagtatatatatatatactgaccggcttgacgcccatgatgcgcagcagcggcttgccggcggcaacgaggaatacggcctggagcagaccgaggaacgcgcctacgatcagcgctgacgtcacggacggcacgaatctcctcctgcatttgccgacgccgacgccggcggcggcggccttcttgtcgtcagtagtgcgcaccgccgccgtcgagacctcggcgccattggtttcagctgaatccacacccaccacctgctgcttctccggatccgcgacggcggcggcactggcaccgtggcctttggcgtcgtggccgtcgtcgttgtcgtcgtcggctccggcggcgcccttgctgaggatggcgtcctcctcggcgacgaaggaggtggtgacgctgacgagcgggtagatgcacaccttcatgaccttgttgaacaccgcgatggcgacgcccacggcggcgatctccacggacccgatccggccgatgaacgccgtgtcgatcagcgacgccagcgggtcggccgtcagcgccagcgacgccggcacggcgatgcgcagcacctccgcgccgagctcgtccagcctcagcgcgctcctcgcgttcagcacgaacagatgcagccccgtcctcctcgccccgcccagcaacgatgtcgccgtcggcggcaagtggtcgccattatcgccgccgccgccgccggcagcatcagcattctcggtcgccggtggcgccgccaccgccaccatctgtttctgctgctgctgctcggtcaccggcatgtcgccggaagcagcagctgtcactgtcgctgtcagctggtgatccgcctccatggattcgggagctgatgaactcctcgccatgcaggtgttgcttagctcgtcgatctgcatgtagcataatgagtgccaaattaacaaggactaattatcatcagcaacttgctaatccgaatgaccgtacgcgcagcttacgtgcttgtgctgattaaggatgaaacagcgtgcttagtatcattaataatgtggatgcaaattaacaaggtagagaaagactaaccagggattaatttgagcaagatcacctagaggaaagcagcggttttggagccgtggtgggtggtggccaattggttcactcagctcggcttaaatagatccaaaaatcaggggagtctgtacgtgttcgtgcctgcactagatgtaacccgaccggccgtacgaaattacgaatggagtttgtatctgtggacagtggacacaaggagtggccagcagcaggcagcaagggaagcttgtatggtaatactcccaacctagtgccggatggaagcggatcctttgacctaactgtgtagttgtcactgatatatgaattaatcctactttgttgtggtttatatatcagtaattcaactgcacaacaagtaggtaagaggatctctttccgtgtcggataagatttatcttattagtattgtcggtgacatgggaccggggatatcttgactagaggtttggggcagccgcggtcacccacgtggcctgaccccctcgggggggtcgggcccgagggtgatgaggccgcccctccctctatctccccgaggggtcgggccgctcccgtttcgtccccgagggctggggcgccccgaccccctgagggtttggcgccacgtgtgtgggttagatgagcacagcggcgctcacctaaccgcgtttattgcgggttggacgagcgtctcacgccgcatttaatgcagcgtagcacatgcttatctagtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtggggactcctggagttggcacgtcagccccggctagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccatcggagggccattcggacggcagccattgcaaatctccgcccattaatgagggaggacagggttatcccggtgtcagacgaaggtacaagccaagttttggtcaaagtaggatgggtccccacccaaaagaagggtaggtagaaatggtgtatgtggtatccccttgagatataaaaggaggaccatgcctaccaagagggggggactgacggactgacggacggggggaaaagaaaaagaggggactgggaaaaagagtagggagagggtctctagagttcgaactctcttgctctccagctctttgtaactccttcatacacagatccaccagaacacaggagtagggtattacgcttctcagcggcccgaacctgtctacatcgcccgtgtcttgtgcatttactctctcgcgaaccattccacagatcaagggcttagaacctcacttagcgcccccggccgaaccggcaaaggggggcccgcgcggtctcccggtgaggagccccacgctccgtcaagtattaagaatctaaacaggttttatgttccagtagtaggttattatattttgttacgaaaagagtatagtataaggaagctaaatcattcgcatgtgagaccgtaacaaataggactactcatatgcgagtgactcgggcttaattcaaatcagcacaatttggtttagcttttcaacgacacataaagtgagataagacattagcatataattaattataataaactttaaagataaatttatttaaagaaatttatatataaacagtttttgaaaaaaaaaacataatactatttaacaatttgtatagtgtgctaacggaaaatgagaaaattgtagtttagagttgaagaaaataaaatatctcaattgtatgtgcagcaacgagggaggatgatgtgctcaatgtcttttgacaattaatgattagatttaaatactgaagtttcgtattctatttgttttaaaatataaatgattttgattgtatatgacacatcataatactataaaattaaataaaaaacatatttagaatcacattactaagttaaaatcacttatatttttgaaccaagagagtgacgtattgcaaaaatgccgagcagcgcagtcgccatcggcggcaactggtcaccgtcattgccgccgctgccgccggcagcatcagcattctcggtcgccgccgcctttgctaaagcagtacaccgccgccaccaccaccatctgctgttgctactgctactgctcggtcaccggcatatcgccaaaagcagcagctgtcacgcagtggcggagccaggatttcagcaaagggtattcaaagttgaaaaaaaatcttacagaactcaaaaaattggactagcaaaatttaaagtataaataatagcataacaacatagtggcaatgacatgtttaaaggtacaaacagtagcacaaaagtaaagatatctaaattataaatggtttgaatgaattacatgacaaatgaaataaattgtgcaaatcctttgtatctaattttgtgaaatcctttggataaaattgtgcaagcttaaccaagttttccttgtcataagcagcaaatgaatcaataggattgaaggacgccatgcaaagaagcaactttgtgtttacctcatcaaatctatcattaaactctcgaagttgtctatcaatgatgcttataaacataaaacatgtcaacatggaagcgagggaaattcttgacctttttgaataatcttttagatcttccaaccggcttgtagaagccatccatatcaacaactttgatgccatgcttcacacaaaaagaagtggcatatctttcagaaaagattaccattcatcttcatcatcctcacgcaatagctgcaattgcatctttgtattaattagttcaattgcattaccaatatcttgatccctcagctgctcagcgtcggcagtcgccgtcgaggcctcaggtgtgaggcgacgaccggacgacgcctcggccgctcggcggcggcagcggacggcctgggcggctgggcttcggcgatggcgatgctgcgtcgaatcagggacagggagtcagggagatgaggccggtggtgacgcgctaagctgccgagcgctgagccctcgatgcgccatcggccgtcgcgacgtcgcccgtcgttgcggagtggaggcgtggattgggaggagtgagaactggactggggacaccgggacagggagccagcagccagggagatgaggccggtggcgacgcgccgtcgccgagctgccgagcgccgagccctcaatgcgccgtcgcccgtcggcgggagtggaggcatggattgggatttgggaggagtgtggacttgggactagggtttagtctctttttgggccagtagcagtgggcttattcgctggggcaatgtggggaggaatttacgggctgctgctaataagtgggctttttttcatttgagctatacatgctgcactttcctctaactttttacgtatatatgcataacatacctatatataattttttttggtaaaattctatgggtattcacgtgaatacccatgaatcacatgggatccgcccctgctgtcacggttagtcatggattccggagctgatcgaactcctcgccatatgcaggtttgctagctcgtcgacctgcatgcagcataatctgagaattaattatttgacttaagtactgaagtttatcttaccgtattgcaaaaatgtactttccttgagaatacagaacaaaaaaaacatttctatttacttcttttttttgttagtaataaaatggttcggtctgcaaaaactgataaaatacggcaccatcctcacctctagatttaaggtggtacttcaagttttcactgttgtttctggaaaaaaagatttaattcactatttctacgcttacaagacaagtaactacttagaggacggttgagtaaaatttctcttgcattgcctagacaaaataaaaagctataggacggtgcatttacaattcgcaatcgttagataagttgactgctaaatacgagcatatactcaacaaggtagaaaaggaggagacaagcgagtacttggtccttcatgatccgacaatctagtacatcaagtaaatttgaagcaaaacggtagcaaattttaaaccccctttcggctggtcccaacatcgcaagtttgcaactcgacataaagtgcctcacactatttagagcttttgtaaagctttctcccatacataaataaagctagctatatgcgaatttcaaggtgagtgaactagggcaaaatgcatgtacgtacgtactcaacgatggtgcgttgcattattgcagagggacgcagatgaatgaactgaaatcgtagggacttgtgcgatctgctcgtgggccggccggccgtggccgtcatgacgcgtgtcatgcatggtgtgtcgtctaggttgattgattggatcgtaaaattcggatgcatgtatgtacgcatatgcgtgcggagacgaaaggtagaccggtgcggacgtgcggtctctgccttttgacgataagcaaagcgatccagggttaggctgagatgaaaagccagcgaccaaaaagaaaaaaaaataatgatccgaagggagagacttctctcaaaatattttttttaaaaaaattatgagtatgttgaaaattgagtacggaatctaaaaattaaaactacacatctttttatcactgtactattaaagtacataaaaaaaaaacagcgatccgtgcatacgcatatatatggctgacgaaaaagatcagtttctgcggattttcgagacacacggcttggaatcgatcgatttcaaggagagattttcttttctggacaaattcaaatccagaacagtaaattttgatcaaaacttataaaaacatggtccaaatttaggccttaacgtttgtacaaaccttgtaacctgtggtcaaaatttcatttataaaaactaattttgattattttctttttatcgtactccttccgtctctaaatataagtgattttggttggatgtgacacattctagtacaacgaatctgaacataaagcctgtctaggttcgttgtactaggatatgtcacatccaactaaaatgtcttatatttaaagaccgaaggagtagttttttagcattatcctctaaatcgctaagaatgaatatataaaatttttgtttataaattatattatatgtttccaataaaagttactctctccatttcatattataaattattttgtttttttactagttaactttccaagttatagaaaattttagttgtgtgtcctcaaaacaaatatattgttgaaatatattcaatgctagtgttttagaagctactattttgtatacacttaactaaactgtaaaaatgtttagcaaggaaaaaatattataatatgtaatggaagtagtatgattttttaaacaactctgatccacttttaccatccgggttcatggtccggtgcaaggttttatcatggttatcacgtaccgtaatcttttttagttttataaatcacggtatattcacggtaacaggaaggttatcaccgtaaccactaaaccatggttgtcgcccaaaccacctccctgagatgcaaaagtgagcagagcagggcacggcgaccagctgcagctatactgtgactgtgaccagtccactagtggacggagctagagacgacgatcaaaccaaccatgggtgacgtactagtaccagtattaatattactgcagatttgcatagttaatttgtgagatagatacggcggtcgggaggagtatacgtagcagcagctttaccggcgacgacgggaggggaggcaaagctttaccggcgaccgatacgtacggagaggagccacgtggcgagcacgaggagatggaatgccatgctagctacagcaaatctatctatcgcgatgatctagacgattcgattcgatgatgcttccaggtagtctcgctccctagcagcagcaggatcaggcgacgcgttgctgaaccgcgctgagatagcgcctggctcagatcaccgcgccatcagctcaaccaaaagctagagagagaatcataccattgttttttttaattaatatactactccatcagtgagatcaatgaggcggccggcaggtgcttcaggacgaagttaaggttagtacgtagggcaatcacaactcatagtgtctataagcagtgtttatggtgccatgtcaataaaacatcataataaaaactgcactctataacccatgatttcttaaagtggaccattaataaatacatcatctctcttttctaccaattatatttattcttcatctattatgaagacactattctctcctaatgcaaagcttgatagtgtctagtgcataggttctcgtgttgaagctgtgtcttgcatgagacccagtttcttcctctcttcactctctctcttaattaatatagtgccacataagttaaaagtcctacatgtcaatatagttaattccatagacaccatcataggtggagggttgggactgcccttaggtaattcaaaagaaaaaacactctactaattaacataccaagcgaatctagaatgtaaattgagaggtgctactgtaaaaatgtaatatgattaatgcaaataaagatatatcaacaaaagtgttttccaataaaaaccagatgcgcatatgatcaaaagaactttctcatttatggctatattaaaatgttcaaaaatatcagtgaatatattgttttgtatactcgaagtaagctatgttttatcagtttggtagtagaagcagtgaggcagcctgcaaccttgctatccggggaatttcttcactaataattacttcctccattttatattataaaattttctagtattacacatattcatatacatgttaattgatctagacatatcattaacatctatatgaatatggacaatgctaaaaagtcttagaatatgaaacggatagagtaattagattagttaatgactaattagagacaggaatggatccgctactgctaccaatttctctccttgcttgatcgaggaacggaattcaggcagcagatcagcgcgtcgcagcgccaggaaacgcagacgataatcacagacatgcataatacaaaatcacaatgcactatacagtaagtaagattttaacgttcgttcggggatgtagctcagatggtagagcgctcgcttagcatgcgagaggtacggggatcgataccccgcatctccactataacctccaattttctcttttgcttcgagtcgagggattagtgtcttttttttttatttgttgggctttttcacacactcgtttgttttccaagcccatcatgctgatctgctacacgttgtacttctgggccggatactgctcggcccaccatgccttgcaaccgcagtcccaaacagaagtgggccgtcacgtccaaaattccctaatcaaaagccacccgggttctcctctgttcggtcgggaaaggaataagttcaccggaggtccctcaaattgacaccgagattttttaaggtccctaaactagaataccagaaatgtgtacccctaaaattactaaatctgtccgtagaaggtccctcagcagtattgactcagtttttgcccggttagcaataacatgtttctctaaatccgaacaaatgaaaactctatgcaccaaatatattcctctatcattatatttgctaaagatatgaaaaatagcattagttggacatggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaatactagaaatagcatgttcattcactagttgtgtcatggatataagtgaagcattatcacacaactcttctttatcataaggaacagcgagtaaatcaacttgtgacaaagaaattccagcatttggttccactaacggttgcactactttagcatgaaaagtggacaaatttacttcgttaacaacgcactcaccttgattaatttcagtaccatttactttacctttgatgtcctcttcagatgatggaggtgcctcgactttgagtgtgaacaatgggattggcggctctttcatgtctctctcctccttttcatgattatgcacttcctgcaaatgattagtaatagaagacaaaaacatagcatgttgcttcttcatgtcctactctattttactttcagcattgcaagcaagttataacaaatgagaaagagatgtatatctttgacaatcaagcatgtcctgaatttccttgttaagcccacgtaaaaacctcaattctttagcttcttcgcattcatctaaaccacaacgtaataaacaagcttgcatatcatgatagtatgaagtaacagttatggtatcttgttttaaacattgcagtttgttgagcagaatatcagcataatacatgggaacataaacatctctaaaatatcgtttcagatctttccaagattgtggtattttgttatgcctacaaagatgtttctaatcattagaagcatgtttaactaaaacactagaggcacacataaccttttgtttctcagacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatgttgcgtatccctgccattgttagtagaaaataagaaacatacacaaaaatatgtgcatccctattaactactaggtagtgtaggttcaaatttcacacacactcaagcttttaactgagctcttacaaattcttaccaaagcaagcggaatggtgacgtacaccgactcaaccaagcaccccaatggaggttggatgtatcgatgccttagcaaacacttgctgtacggctgcagtcaaatctgtatagctctgggtaggctaaagtatgtagcaaaggaatagcaaatgctcaaatcagagaatgcaaagttgaatgatcgttcaaagtcaagtaacgtactggtcctaggctagaacgtactagaaacgcgagcctagacacaaacgataccacaagatagcactaggaacaactcatgcacaactttgatatatgaagttcagctcaaacataacagtattttctcttttatttctttcttctttcttcttttcttttttttctttccttttcttttctgtttttttgtgcggcttttttttcttttcttttttatgcacctttttgcctttttttttctcactttttcttgattttttttaacaaaaactgactcaaggaccttaatgtaaggttacagggactcaaacataaatataaaatttacagggactcaaatgtaaaagtctaaacccaaaattaaaattatacaaaaatggaatgctgaatttatgccggttccgtttttccaaacagatctcgaaaccgacaccaaacaaaaattcaccaaggtgtttgacacaactcggaaccgtgaaagggagggagggagtcggactcggccaaaggggcgagtgggagtcagccaggaggtggagtggatggtagccgataattaggatttggtgtatgggataaaaaggaaactgatttttaactaatccaatctattatatctttccaaaacaaacttgactacttccaaaatcagatatggtaattcaccttcctcctctcatgcacgacacaagcacggccaaaacagaagcacggcagtcagcaaacccaagatgcaactcaacaactccaaatccaaccggtagaaacttttgaaaactacaaaaatagaatcgtggcagcaagccgattccgttttcgtaggtcccgacgataacagagacacggaggcgacgacgactctggtataaaacgtgaccagaactcgaaactctaaacgaactagacgctaagaccaacaacacgacgagacgatgcaacacaaaattcaacaaagcaaaaactgaaaagaacaatgcaatggcacaatatggctaggtaaatgatacggattttttttgtatggctattttctggttatcggaagataaaaactcaccgagtaacgaaagctctgataccacctgatgaaccctgagttcctctcaacactcaaggttgttgttggcccaatctttcagtgagttgtgataactacgatttgggagaaacgttgacgatccaactacaaccgtacgagacattgtgatgcgccttagcaatcgatagacctctccgtgggttgttgatcttgccggtgcagatcaaccctattcctgcaagcaaatcgaagaaacaagtaagaccaagataaaagcaatctgatattgcaaataggaatttaatacaaatgataagttggggttccgcagaacaagcagacgggcgatctagctgacacgcgcgctgcaagcaagtagcaatggctaaattttaatctatcaaaacccaagaaaccctgaaggggtacctagctatataaataggggtggggggacgacctaggggtgcctagggtcgtactccacctgtttggggcgcaccccacatgggccccacctaggccggggtcccaaatgaagttacaagcccataggcccattataggtgacgcaacaccttgtgcctgtgattccagccacacgagatggaattcggagatgaggctggatccgttggaaagagggctccaaaagctttccatcaagtactcacgggccgaaaacggaggtcgtatgcagattcggtggccgtttgaagtcagcagtgtagcaggtggccgaataggattccggcacttgcaggactcgaacttgatatcttgttgttcatccatgatgtgagcaacggatgtatccgtagtagccatggtcacatcaaggtccctcggcagtattgactcagtttttgcccggttttgctgacgtgtcgcgctgtgggacccactgatcagtccaccgttggggagttaatagacggggttaatggaggggagcgcagctagccagacctccattctctctcctttgctcgaaccctagctgagcggcgaccaggaggcgacttgaaggcgacggcgggtttgtcggcggcggcgagctggccgtggcgccggcgacaagcatcgttttcgtccaaatgcgcggcggattccaccccggttagtaccttgttggctcggcattgcatgctattgtagctggtactatgttgattttgggggaagatttaaaatgtggtagattcgttttttgtctgggattcggtgtagaggtcaagtagtatattgtcccatatgctttaggtgtagtaatgtttttgtatacccatgtgaatctgggtggtccttttttaattggtgttaggtgttaactaggtattagggatatggatgtagtgtagttttaatagtagagtagtaaagtgcttctttttttatttttttagagctggcagcatggaacccttgggcactctagcagttaggttccatttcaatggggaatttgtcaatagaggggagacaaaagttgtattgtggggggagagaagcaatgtcatccatagacagtg

SEQ ID NO: 14644 - DNA, 4264 bp, Oryza sativa
atgctgaggagcccattgtaattgatgttgatgaagaggaacacaatgagtatgaggctgaaatgaagttggatttggatgaagaatcagaggaagatggagatgaggataaggatggggatagaaaggttaaagtgaaagataaggacaaagctattgtggacaaagggaagggcaaagctgttgtgggtgctggtgaaggtaaagcaatggaagtggatgaaagtgctagtgataggaggattgtcatttatagggaaaggtcacctttgagggaaaatgcacctatgagggagaactcaccttatagggatacctcacccataaacactgtcctgccttctgacagtgaggatgatagtgattatgtaggaggagatgattgcccttctgaggatgatgaagaggctagggagatagaaagacactacaaagagttgaagaggaatatgagagctggaaaggttcatgagctagatgaagttgtgtttgaggggtttaaaagtcagtcagctagaactgctggaggtccagaagatggcaatgacaccccatatgcagatagtgatgatgaagactcctatgatgaggttggcagtgatggtgagcttgtcagaagaaagggcaagtttccaaggtttcagaagcagccaggggttcctgtttttgagctaggaatgaagttcagctctaagcatcagttcaagaagaccattataaaatatgccctggctgaaaggaaagtgattaattttattaaagatgatcgtgtgattgggctagctgtccttgggtgtgtttgctgtctaagactacaagaagtgatagttggcaaattgccacttatgacagtatgcatgcatgcccaccaaggagggacagtagacatgtttcatctgttaggatagcaaaaaaatatggcaagttcattgttgctaaccctggttggccactatcccatatgaaagcaacagttcaagaagagatgtttgctgatgcatcaatttccaagcttaagagggccaaaagacttgtgatgcagaaggcatttgatgtgaccaagggccagtaccagaagctttacaattatcaacaagaactgcttaggaccaaccctgggagcactgtggtgatcaacagagtgataggtattgaaccacctgtgttcaaaagaatttacatttgccttgatggatgcaagaaagggtttatggctggttgcaggaaggtaatagggcttgatggttgctttttcaagggatctacaaatggagagctattgtgtgctatagggagggatgccaataatcagatgtacccaatagcttgggcagtggtctataaagagaacaatgaagaatgggattggttttgtgacttgctgtgcagtgatctgaaggttggtgatggaagtggatgggtcttcatctctgacgagcagaaggtaatgctcatgatccactgtttgcttttatgttctgtcatttctgtcattacagaatgcatacctaatgtcttgtgcatgttactgtcaaatgcagggaataattaaagctgtctctaagtgggctctagaagctgaacacaggaactgtgccaggcatatctatgccaattggaagaggcacttcaatgataaagagtttcaaaaaaaaaattctggaagtgtgccaaagcatcatgcagaatgcttttcaacttggcaagagcaaagctagcccaactgacccctgctggagctcaagcaatattgaacacacacccagagcattagagtagggcttggttcaggttaggatctaattgtgactctgttgataacaacatttgtgaatctttcaacaaatggattcttgaggctagattctttcctatcataacaatgcttgaaaccattagaaggaaagtaatggttaggatccatgaccaaagaaaatgttctgatagatggagtactgtcatttgccctggtatacttaagaaacttaatgtgtacattgctgaatctgcattctgccatgctgtatgcaatggggctgacagttttgaagtcaagcataatgagcataggttcacagttaacctagatatgaaggagtgctcatgcagatattggcaattgtcaggtttgccatgtcctcattgaattgcttgcatctactataggaccaacacactagatgggtgggttgctccatgctattcagtggaatctttcaaaaaaaacctatgcccattgcctgcagccagtagagggcatgactagttggccagatgatcctagagagcctctcaatgccccaggatacataaagatgccagggaggtctaagactgaaaggagaagggagcctaatgagccagctaaacctaccaaagcttccaaatttggcacaattatgaggtgcagatcatgcaagcaacctggtcacaacagcaagggctgtcacaagcacagtggggcaggtggtagcacatctgctccaggaaatacagtcactgcaaataacaacttagtgttgtcaagcacacctagcagcattgcacaaagcaggaaaaggaagtcagctgagctcagtactagcacatctgcttgccacactaggaagagaacaactcctacaaaaaaggtatgtcagccagtccttattcaattaaacttttgaaattaacattcatttgctaacaacactttgtttcttttccttctagtcagcaaacacaaacatttcacttgtgaaggttgcagccagtgctagggtggcaactgaaaaaggtggttcagccagtgtgaaccttcaggccatagtgccacactctcaatgttcttcttctgcttcagtgaggatcacttctgggaaagcaagtgtttatgtgcaagctcaagaaccagccactaccaatcccaagaaaacacctgtaggtccactgatgctgattcccctatgggaaactgtcacgcccagaaatttaacccaaatttccagactattttgcgttttaaatccctgtccaggaccagccagggtacacaaaacgacaagtaatatacagttccaaacgtaaataaagcgtaaaatacttacggaagaggcacttagtcctcacaccgaaacagaacgacagcagcgaaaaaaggcgatcctagcggggcttcagctctactccacaggcaaaactcaactggggtctgagccttggtcctctaactccatcttcagctcagaagcactacacttctgaaaatggggaataaaagcaagactgagtacaaccaccgtactcagcaagccacaccaacgatgcagtcccctctcgtgcctaggtgaatccggaagcgacagaggccgtcgcagggcccgccctgctccatcacgcccacccttgcctggatgcgtcgactagaggaaagctacactacaagcccagccgttgcccacgctggcttgtggtaagtacgataagttcttctagggcatcccgcgaaccggtccttaactgccatgggtgcaaccagcaaaaccatgcacccatagcccaccattcagtcgtattttagttggataattacgaccacgaagcatggccagatgtctcgagcacgcagctcaacaagatactagaatgtctaatactgcaattatcccatcgactgagctagtggtaattaagcatggctaagcatatagttctagctaggtcacataagtaacatgagctagtcgatttattacccaatgttgacaaaggacatatatcaagtaaacatgacacaagcgagcagataggtaaaaccctgaccccatgtaattagcaaaatatgcatatttatttgcaaacagtaaaacatttgtaaattgggatcaacatgctcaaggggaatgtgtgacttgtcttgcttcttcaaacaatcttccgaactcttatccttgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttccagaattattaacgaattattgtgcaattgttaattattttatcaaaggaaaaggctcctgctggcgtcatcaaagggtagcggggccgacaggcgggccccacacgacagcgggcaagggag

SEQ ID NO: 14645 - DNA, 1090 bp, Oryza sativa
aatcggctggcgaagtggggcgccaacgtggggtggtggaggggttaaccggcgccgattttcgcggggagagtggggggaaaaggtgaaggaggtggaggggatcgatttcacgcgctcgtggggcggggtggagcgcagaagccgcggcgtcgtgggacgaaaccggcggccatggtggcagtgggcgacgggaggttgggaaagaagatgacaggtggggcctcgggtcccacctatcagggagagagagagaggggaaaacgggcgagggaggtaaagcagacttgagggagagagagagccgagcgggccgagggaggaggccggcccgagggggagagaaaaggggcgcgcgggccgcgggagagaaggaagacttgggccgaaaatggcccaaagagaggaagggggattttaattgtttttctttttatttagttggttaaaatgaacttggtgcttttaaaattatttcttgagctccgaaaattcacggaaaattctagagagtacattagggcacaaagaatattacagaatattcccggccaatgatttttaaaggaaattttaatttcctccataattccacttgattaaattggtttaacttttatttaatttctagaaaatgcattattaaatgattttttttaatcccgaacgaaaatcggggcgttacagaaactgacaagctgtgatgccatattgtgctaactaggcaatgttctgtgctttttgtgtattttggcagactctaagccaactatgcctatctgtgaactttatataatttggcagactctaagccaactttgcctatttgtttagtttctgtaatttggcagactgcttgccaactatgctgtgatgtgtgcttgttctggcagactgtaagccagctaagctatgtggattgttatcatctaaattgagtaactttgctcaaatggtgtgtcataacctaatctgatatgagatggcatttactgagctgatctgatgttatgaactgactcttatcaatttgttatgctaaaattatgtgcaaagttaccaatactcagtcactgttcagccaaccact

SEQ ID NO: 14646 - DNA, 654 bp, Oryza sativa
  unsure (1)..(654): unsure at all n locations
nnnnnnnnnnnnnnnnnnnnnnnnnnnnnnnnnnnnnnagagataatattttgtcccaccttaagcctgtcgagaaatgttggcaaccacaggattttcttcctgatccagcctcagatgggtttcatgatgaagtcaaagaacttagagaacgtgccaaggaaattcctgatgattattttgtttgtttggttggagacatgattacggaggaagctcttcctacgtaccagactatgcttaacactctcgatggtgtccgagatgaaacaggtgcaagccccactgcctgggctgtttggacaagggcatggactgctgaggagaacaggcatggtgacctcctgaacaaatatctctacctcactggtagggtggacatgagacaaattgagaagacaattcagtatcttattggctctggaatggtaacagttttcttccgcttctttgctagcctagctatatttaactgattattttgaaattgtcattcatgagtttttccctcaagcaattgttttcctcactggctagcgtatattagcatgatgtttttgaaaaactcttttgagttttgaggaagctagtaactccactaactacatactttaggaataacttttacctggcattatcaattttctaattttt

SEQ ID NO: 14647 - DNA, 624 bp, Oryza sativa
aggacttattcattttgttgagaaaaattaatcttaccaaaaattggtaatgtcaaaattttggtacactttaacattaccaaagttttggtgttagttacgttaatttgaagtcttactaaaatttaggagaacttttgtgagaagaaacttccagattaccgatgtttggtagggtagcaatgataaagttacgtttagtttgttaccctattggcactaaaacaggggtacgttatcttgagggacaaaattccatcgtgcttgccctctaggctccagggaatataggaagcatttctgtgctctgctgctggcgtttgtctcttgaggtcatgggctcgcggcggcagcaggggtgggtaattggtcatcattggtatttcggtccaattttttcgatctttaaaagcagaaaattgagaaaatatttttaactatttatcactcttagatgtggcaatcaataatttgtcaccgagacccgtatattatttcacacataaggatccacgtatcgttaacacatagataacaaatagtaaacgtcaaatttaaaagtgacaaatagttaaatgccccaaaatcaaagttatctacataaactcatacgaaccaacaatt

SEQ ID NO: 14648 - DNA, 1102 bp, Oryza sativa
  unsure (1)..(1102): unsure at all n locations
nnnnnnnnnnnnnnnnnnnnnnnnnnnnnnnnnnnnnnnnnnnnnnnnnnnnnnntgttttaattcaatgactagtccaaagttttttattaatatccctgatatgttacatggatcatgtacatatatctgtaaattctccctttttctgttttggtttgtcctgctttttgttcctttttttttctctctgataattcccacacctaatatgtaatctgtaaacctcatttctattaatgaaatgactataagttagagcctactctaccttcttccgtcaaaaatatgttacatggatacctgccactattttctattgcagaatttgtgtcaatctgaatggaacagtcttaaactctgaaaaacatatttctacgcattattccgattgatttcttgttccatatacattccgatatgggtgggcactgggcagtgcaatcggttgccactgagtactaactcaagtatcgcgtaaaagaaagaggaagtctcctgtctcgtggtctcctccgctccttgcgccgccgccaagacgagtcgcagcgatctccatctggcgagcagagcagggaaggggatcctggtgagcatccacatctctttctgattcatctcgggactacttttgtctggaatttgcttgcgttaacttctcttcttgatctggaagaacctcttctcctccataatttaaacctctcagtttttaaccatagtgaacgtttctttgcttctactgcacccttgcagtagaattcagggggagttttagacctaagctataatagacttccttcctcgattgggttttcaaggaatatgcctttgctttctcctccggttcttgatttcctacctgaagatattatctctctgatcaagactagttcgagcagacaaattgattcagagattgcttcatggctgtgaccttgctcaatcttgaagcaaactaaattcgcaacacatgtgcgattatgatgagctcacaagttgcttctgtttctgacggattaccacaggcacagggtccagctgcaccgaatgactcgccgcgccagcggttctccggcgtcgcgccgccgggggcgctcat

SEQ ID NO: 14649 - DNA, 1697 bp, Oryza sativa
  unsure (1)..(1697): unsure at all n locations
nnnnnnnnnnnnnnnnnnnnnnnnnnnnnnnnnnnnnnnnaaattttaatttcctccataattccacttgattaaattggtttaacttttatttaatttctagaaaatgcattattaaatgattttttttaatcccgaacgaaaatcggggcgttacagaaactgacaagctgtgatgccatattgtgctaactaggcaatgttctgtgctttttgtgtattttggcagactctaagccaactatgcctatctgtgaactttatataatttggcagactctaagccaactttgcctatttgtttagtttctgtaatttggcagactgcttgccaactatgctgtgatgtgtgcttgttctggcagactgtaagccagctaagctatgtggattgttatcatctaaattgagtaactttgctcaaatggtgtgtcataacctaatctgatatgagatggcatttactgagctgatctgatgttatgaactgactcttatcaatttgttatgctaaaattatgtgcaaagttaccaatactcagtcactgttcagccaaccactgcaaagtcagctcaaatatatgcaatgtcagtgtcattactgaatatcaatcacaattcagccaaccacaaatccattcacttaacttagatagtcaaagagcacagctcagtttcttggaaaaatacagcaaaatgcttttagctaccagcattttgacacatagattaacacattgcacctcacatctgaactgaaatcacatcaaacaacacaaacatgcatcccaacaacatcagtacaagccaaactctctgtttctctagcctactgttacttgctctcatagcagccatgttagcttcattctcagctgccacaagcctcaattgtgccacttcattcattgctacccctaattctaggcaccgctcttctacctttggcctcagttcttcaacacaacgttgcagctcattcttctcccttcttagcgataacacggcttcacgaagatcgttcaacagctccctcaaaaaactgcttgttgcgggctcataccagtcaaaaaaatcgcagccggcgccctgaaaacattacatcccaaatcacccaaccatactgccagctcaaacaaaaaaacaagcaagcaaacgaaatctgaatcactcacccgattgcggcatcggtagtaccgtcgaccagggttgtccacgctctaggaaatccaccgcaccgccttcgcaccacaccggcacatcaccgccagctgataatcatagggcccaactcgcgccgggatgggagcacgactgctgggatgcgacgaccccgacgaccggtcactgcaataactcgccatcacctagcctcacctcctcttgtcgcccccgccgccaccgccgcttccgccgccctaagctagggtttcagctcgagaagaggaaaatgtcgcgccaacgcctggaaacggcgaggacagagcctttaaccccgtctattaactccccaacggcggactgaccagtgggtcccacagcgcgacacgtcagcaaaaccgggcaaaaactgagtcaatactgccggtattctagtttagtgaccttaaaaaatctcggtgtcaatttgagggacctccggtgaacttattccgttcggtcggtcccaccaaaccgcctcacagtcacaacgtcta

SEQ ID NO: 14650 - DNA, 5050 bp, Oryza sativa
  unsure (1)..(5050): unsure at all n locations
ggcctcctcctccttccgtttccgttccgttccatttcccgttcacaccctccgtttttccattacaaaggcgacacgaggctttcttcccccaaatctcacgcggcgctttctctctctcccgcgagatggacgccgcggcggcgtcctcctcctcctcctcgtcggcgacgatggcggcggcggcggcgtcggccgcggaggcgtcgttgtccggctcgcctgcttcttcgaggaacgctcgccatcggcagcgtaagggggtccggctccggatgctgcgacggcgggggcggcagcctgtggaggccgagcgcgccccgggcgatgggggcggtggcgccgtgcaggaggatctcgcgctgcctctcggaatgtccttcgccgccgtcctcgcgcaggtgcgtcatggcgggtggatttccttataggcaaaccctgaagaaagtagtagtactagtacttttttcttccttggcgctgttcgtgatcctctctgcgatgttcgtgccatcaaatgtactagcatattgcgtgtagattctgttgctagcgtctcacgaacacggtaatctgagaggttgcgtgctctggatggtagcttagaatgggaaatggaacgttagacgcggcagcttggggccgaggaaattctttgtgctatacttccctcaatggaaatgtcattgagccaaaataaaaaaaagtcattttagttcacagctatatgctcagatttttcacaaataaggggaaaaactaggatgcaaaatgatgagaacaaggaatgattatgaataagacagcagagaaattgggcttgacaatgttgtggctttatgggttatgcaagccttgtacttttgtcaaataagtagtgtggcatttaccgtcttattgcaaaattcaacttcattgctactattattcttcatttccatacttatagtggacatgaaattaaatagtcatttcgataatactaccccgtcatcctgtcattggacattaaattagtcacagttcagcatctcttcatccgaaagcttgcactatagcagcattttgaacacagatgcatatgcatgtgcaaagtctatctaatattcacctgcgtacatctggacatttgcattagtaattataaataaacatgtttgtacaccggtttagccctatgcccttattgttcaggtaacaaggagctgctttcgttgaccgcaggttataaatacaaagaatatttcaggacaaagattacatcctgatttcctctccaaggtacgtgctttctaatttgatttatgaactctgttatccataaacccacaaattgatggtctgaaattgggtttgagtgtagatctgtacatcagcagtcaaggaatctctgacaaatgtaagcccggctaccactattattcagttctcattgtctcttagtattcattgtaatatcctttaattatcgtttctgtagatatatggtgacagttccaacagtttcatcaaaaatttcgaaaaatctttcagcagcacttttaggacgcttcatcttgttaatgaaatacctgtgaatgagagaagtcatattcctgaatgttcttttaaacatgatgattctgtggctgtggacagcttgagctcatctgatttgcaaaatcagacaaacagaatagagcatgaccttgtgaacacagtggaaagtcaactagttctctttgccagtgacaatcagcagttaacgcatcttcggcatagcagatcctctcctgaagctgataatcgcattcttaatgccattgatcgctcgaacgaactcaaggaatttgaaatagggcttaccatgagaaagttgcaactcaaacagtcacagttagctcttagttcccattcacacatgttagagaagattaagctatctttcggatttcagaaagcttccttcaaaggagagaaattcaagactcgcatgcaggagacaagagacgcagaaatccttaggacgctaatagattttcttgttagtgctgtgatagttatgtcagcgtgctttggatatggaacttatatttattcgtatcaaaggataacggatgttacgtcagcttgttctgccacatcaaaggtatgtttatgtagtacatctgttatcactgagtagttttcacttatcgtgtctctttagtaatcggaagctgtttttttcccaccctgtctctttcagggatctaagtcatggtggatgccaaattcagtgtcgaacttcagttctgggtttctttttctcaggtgtcatgtaattgccgtaacacgtatgtgctttggcatactaatgatcctggcaattgcttggttagcatttcagcgttcctcaactactgggtcaaatatgcctataacattcaatctcattttgctgggaattatctgcggctttgctggaaggttttgtaccaatacactaggtggcgatggaaacacttggctcatgtactgggaggttctttgttctatccacttacttggaaatctttttccatctcttttataccacgttctacatggacctatttcagtatctcacagagagcaagttgtctggttaccatactgggttcgccggtgcttgttttatgctgcggtggggcttattcttccagccttgactggcttgctcccgtttgcctctctttctgactggaaggatcattttgtggaagagataaaatccattgttatcggtgacaagattgaagcatgaaatttcttggatgtaaggtggcgcaatacttgtcctgttgtatcttttgaagaagtgaagtttgttcagtttgagattagcctcagagtttagcttggtattgtatgaactccaaaggagattatgctcaagttggttgcacgtagactgacctgttagctgccagcctgccactttgttgtagttggagtgttattttaaacttttttctagttttattcttactttgttgtaaatactcaatagcaagagatgctgtttatctttgttgattgattgttccacctggacatgaggacaatgagtgcagtacaagaccctccaaacggattgagatccagtgcagttgttactattacttcaactttagcagatggatcaaaaaccagcggctcaggtcatcagaaaaatactgttcacgaattactgtacgaagtagcaaatttctcctgtagcgtttactgttcacgaattactgtacgaagtagcaaatttctcctgcagcgtctagtgtgcggtagggtgggagagcaaatccaagctggtggctgcattgatccaacggttataatgtgctctcactgctaaagttaccgtcgttattatgactgcattggatctcaattccctccaaacgtccatgcccagtggcggatccatgtataatttgtagggttggctgattccacggctttttaaaaaacaaccctataaaacttgattttcatgtataaataaaaataataaagaaaggggtttgttggaaccatgccactctatatttgtaaaatttgagatatgccactcgtatctcaatgacatgtaagacccacatgagtcaatgacatgtgggtcagggtgacatatcacaaattttacaaaatttgtgtgacatggttcaaattgtcccataaagaagaaatgaccccacttaaatacaaatcactccccataaagaaataaccccacttaaatacaaataactagtaattgatctcataggtttatatttctggctccaccattgtccatgccagtgatatcacgcacccaaggctcaacccttgagcaaccttgagctcagatacattgttagaaaaatttgcggtcggtacatatacgaacacgagaacaaccgcaaattctatgctgcaattcagcagtttctctatcttggattgaatgaactatgcacagatatgctaaaaacaaatgagagtaatttgtcctagtgccataaactgccaaattaaccattgacaatttctggaactatggtgatggaagtatgatttacaacattctaaaaccagggtctacttttctcacagagaacacatttgcagttcgggatcatatcagacagaaggatgtacatggaaaatacacagtacttcattatacaacaaccgcagcaagcttacttgacatatcaattcatgaccacagcttcaagtagcctcgatcattccagaaagatttccagtcatctaactcttttgcatgagaatgaggtaatcatctcctcgtcccgtgaccgctttccgtgcccgttgatgaagctgcaggagaacttaaccggctgctgtgtttctgctccattgattgaccatgcaatgtaggagcaagttaggaaacattttgatcaatggtcatatttgaagatgagaaaatgttactatctgatagtagagagctttgtcactaacctgtgttgcattctatttgcttcatcttcttagctggattggcgtcatccaattttagtcttctcttcaaaccaagggtgatttcatcgctaagtatatcagccccagttctagacagaactccatcttcggaattcttgctcttcttaagactttttccagcatacaacccaaattttcgctttgggcagacctcggttgtacaatctgaaaccaacccaaattttctctttgggcagacctctgttgtacaatctgaagccaacccgaattttcgctttgggcagacctcggttgtaaaatctgaaaccaacccaaattttcgctttggacagatctcggttgtacaatctgaaaccaacccaaatttccgctttgggcaaacattgattgtacaatctgaagagaagcatattttgcagggttagactctattttttgaaatgaacttcaatacaatgcaaaggcattcttctagaattaagtggataagatatcactgaatattcttgtgctaagaaaaaaaatgaataagnnnnnnnnnnnnnnnnnnnnnnnnnnnnnnnnnnnnnnnnnn

SEQ ID NO: 14651 - DNA, 4670 bp, Oryza sativa
ggattggcgtcatccattttagtcttctcttcaaaccaagggtgatttcatcgctaagtatatcagccccagttctagacagaactccatcttcggaattcttgctcttcttaagactttttccagcatacaacccaaattttcgctttgggcagacctcggttgtacaatctgaaaccaacccaaattttctctttggccagacctctgttgtacaatctgaagccaacccgaattttcgctttggcaagacctcggttgtaaaatctgaaaccaacccaaattttcgctttggacagatctcggttgtacaatctgaaaccaacccaaatttccgctttgggcaaacattgattgtacaatctgaagagaagcatattttgcagggttagactctattttttgaaatgaacttcaatacaatgcaaaggcattcttctagaattaagtggataagatatcactgaatattcttgtgctaagaaaaaaaatgaataaggaattgaaacttgacttgttttcaggaaactgaagcactgggaaaatgccatataaattttacattgtagtctttatcaagttgactcaaatttgttcaagcctagcatacttaactctgcaatacagcaaacttcaacagaaagtgaggaaatactgtgaactctgctttttcttctgtctagtactcaacggctcaaccatatcagcaccagcctttcatacctcaatattatttggtgatatataaatcagcctaaaaaaaccaagtagcccaatttttttcgaggggacaggcaggcagttcctgcaattcactatagaaaaagagagttgaaaatagattacagtcctattgttcatactcttcataagactacaaaaatgagaatcagaaataagctattggcactccaaattccagaatgaagtgtgacagtgtgtcaacttctatctgcattctacaatatgcatgctccagagaccagagtaccagaattcctaaaaaaatttacccaaaattatcaggcaccccacttgactcctgcactttacaatacaactttcatctatgcaaacacatgaatcgatgccacaaaaccagcaagctcacaaacctccagccaaatcgttctctctatctcgtaacagtagtagtggcatgaatcgaaattcgaaaaccaacggttcgtggagaagcgcgcgcgcatacctgacaccgggggaggaggaggaggaggccttggcttgttttggactgctacaggcgcggcgggggcgtcgcccgtgggcagcccgcgcgcggcgaagaagtcgaggagcgcgcgccacgtgacggcggaggagacgtggccgcgcccgcggttgacgaagtagccgttgaggcggacggtggccgggtccagccccagcgcccggccgaccatcgcgaggttcaccccgcacccgccctccaccgcgatcgccgcctccacctccgtctccaacgaagaccaccggagattcacggcccggcgcggcgacggcatcgctgctgctgctctcgatcgaaaggcgcgcggaagcgcggcgaactctctctggtggtgtcttgtggtttcgagagggtttttttttttttctagaagcgtcgccgcgaggtcggtgtcggacacggtcactgccaggtaggccatacctggtccgattaaactgtacatcgaggccttgggccataagtccaactgcaagatgggccagattaaactgcatactaggccttggtccataagcccatgatcagtaccggcagtctaacgaaagccactcctgactgggcccatgcagagtgattgatctcgcgtgagtttgagattattgcatatatagacatttcatactccctttgtttcgaaatgtttgacaccgttgactttttagcatatgtttgaccgttcgttttattcaaaaaatttaagtaattattaattatttttctatcatttggttcattgttaaatatatttttatataggcatataattttacatattttacaaaagtttttgaataagatttcgaaacgaagggagtacttatcataacaaacaaaattaacgcctaccagaaacagcataaccaccatccactatctaaaataaaaactgatttgctaaaaacatgatgctacatttttcagcttaaccaaaaacaacacgcttccctacaagttaaccttaacaccaaaatttccgtccgcatgagctgcacctgcaccaaaaccgcccttatctgcaacggtaaaacaaatgcacgacttctaatgaccaaatcaacggtggagatgcggccagcaacaccaatatgacgtacggccatcctggcgtcaccgtgacgacgacgagtcgggcgatatgccattgttcatcttgcgagcaaaaagaacggccatatatacaagctggccacttcacgaagagctcggtccgtttattctcaccggagaaaaaaaaagataaaaattcctttcgtgttgcattttgtttcccgcttcgctcgcgaatattaaattcgaaccgaaatttcgtaaaaagtggccgagatattcgcggcaaatccaccgcccgttcgtgcgaggaggaggaaaagccacacgtgttcacacgagctggataagatgaaaccaaaaagtccaaattatttctgtgcagcaaaaaaaaaacaccacaactttttttccattaaaaaagggagaaacgggcggggtgcttggcttgacccggtccgcgtgcaaagtacgcggcgggggttacgcggggcccacacccgaggcccgcgggccacacgcgatccggcgccccggacaccgccggccaatccggcgcggcccacagggttcccccccgcaggatagatccggacgtgacgccgacttattaaatgcgcttctgagacgccgcgctatatgagccatcgcgtccgcccgtgcaccagcaccagcacagggtcgtcgtcgtctccttcctctcgccagtgccaccacagctcaagcgtgatccagcgtcgggccgcgcgtgcgagcgagcgagcgtgcgagatgtcggccgccggggaggaggacaagaagccggcggggggagagggcggcggcgcccacatcaacctcaaggtcaagggacaggtctgcctctcttcttgctctcaaactcgtagccttattatccagtagtacataggagtaagtttgttccatagtggatgtatggattgtagaattgagatttgagggttaggttcgattggtaagcccgcaagcgatatagtggcggttgttatgttcggcgatggattcggattgctttgcggagctattagcgtggctgcgaccaagcacttggttcgatggtttgactttgcttgattcgtccagatagggaacgttttgttttatgttgtgctgatgctagtgtgaagttcaatttatgcatgaatcgatcttttgttaggttgttgagtgatgagtttcctgtggatttataatgggaattcgtatttagttgaatgagcatcatcagcgcttggtagtctcacggagtttatggataagggttttatttatggaaggatttgagcttggattactttcatcctaagtttgcagcaacatcttttagatgatttgacaataatgttaactcagtaacactgctagtgtagggtacataaactcaggtttgatgccagcaatctgaggacactgaaattttgatttttgatttttgccataaaaatgctaacttttcagcaaacaagatgaaaaatatggtcagtattgctcgtttaatctgctagagtttgcaaattagtatccatcttccattctttaacttgtatgatatcttgtaaaaatgtggtcagtattccttgtaaaaacttactgtgggttttatgaactgtggggattgtatggttaatactaccttcactaactcttctgttgttcatgctaatgtgtatgctggtctattgaatttgtagcaatagttggaagaatcactcgctcattcatttcaacagattgtatgtttttgttgcatgcaactattgttctgaacgttgtcgtactgcatttttcagtaatgggctaatcttttgcttcctgaaaagtgtggcacaatcgagagcgtactttgttaaatatatcagtttacagtagaaatacgtatcttacaagttacagtcaagtctagagaccataacttcagatgcctttgtttttttccccttgagcatcagaatttcctctgtacatgatattttggttatgcagcactctcgaatgagaaattatttgacaatagttgtgtttttttgtgctcgattcgttaacaatttcctttgttctgtaggatgggaacgaggtattcttccgcatcaagagatctacgcagctgaagaagctgatgaacgcctattgtgaccgtcagtctgtggatatgaatgctattgcattcctatttgatggtcgtaggctccgtggcgagcagacccctgacgaggtgcgtagcttatcttctcttcatactcaattcagtatttgcggagcctagcaaatcatcaccaatccattactgatgaccattgcaaacttgttcagctcgagatggaagacggggacaagatcgacgccatgc

SEQ ID NO: 14652 - DNA, 412 bp, Oryza sativa
gatgtaattcactgcagacgagcagctacactactagtgatgatgatgatcctcagttgaaagctgtgatatttctgacgacatggcagatttcacaaaattttcagacctgaacagcagccagtttaaacacacgagcagattgacacggccaacgacagactcacgttcagtacatgtccaatccacacggccaaaagttgtacatgaaaaggcagaaaagaaaaaaagagctccaacacagacgcaaatctctctatcactttaagcaaagataccacgaacatatgccctcagttcatttggtcaacctgaagaactatgtagcaagacacacctggtattgttctcaaaatgtgtcttcgacaagcacggacagtagtaacactggagctcgaagaagtcgcaatgg

SEQ ID NO: 14653 - DNA, 768 bp, Oryza sativa
  unsure (1)..(768): unsure at all n locations
nnnnnnnnnnnnnnnnnnnnnnnnnnnnnnnnnnnnnnnnnnnnctgttcaagttgagactgcctgagattgcttctgtccatccaatcttccatttgcagcatttgaattgaacctacagtcattgcttcattgcttgccactcatttacattctgtttttagatcaagaattgcctgactttgttccaaacaaatggcttaggaaatctctgaacaaatgaaatttctgaagatggtgatgcattaagatttcagcacaatacttttgcgagcaacctgaaatgtattccactttgctgcaatatgagaatctgaatagtgccggggtaaattctgtacaaactgctactgacaaatgggcccacgtgttgttccttgccccacctatcagacatagctgagtgttatgccaaaagaagcaatttcatttccaccataactgagtgtgcctctgttcaggacgaatgctgacacaaagcacgcaagaaatatgcctgcttcatttcaatctttcaattgacacaaaaattccatttgccaccttgaaggcagtaaagcataatgccaagttgcagggagtaatgcaaatgcagtgccaatctgcaactgcattattattcagtggaggtagatcgatcagaagaaattgagctcttcatggaacaaagaactgatcaatggattggaacattttctttttccgtttagtggactgacagtaaacatgacatgcatgatcagatggttgcactttacatataaatgg

SEQ ID NO: 14654 - DNA, 481 bp, Oryza sativa
cccatcccccgttataacttcagggaataatgtcttggcaccttcctgacagtacagatgcagagctgctccctataaagttcagaaaataccaataagattgctctatctgcagaaagaatatgaactgaaaaaaagggcagtaactcagtccattgcatgcatgcatatgcgagaattccgaacttgaccttccaaaattgacaatgtctcaccattcgcctactcttaagcaccaccaccacaaaacaaagcgcctccccttaatcctctcctatccactcctctcaagctataaaaggagctcccaagaacacgaagcatccatcgatctccaagtctccacccatcaagattgcagtaataatccaagctcaataaacgagccaatccgtcgaagaaggaagcagcggcgatggcggcgaggtccggcgaggtgcgggcgacggtgctgggcatggcggtgctggcgctgcttctg

SEQ ID NO: 14655 - DNA, 688 bp, Oryza sativa
ccaaaatgataagttgagtttatacaattttgtgaaatggcatatatatggtatgaattatcaaacttttttttaaaaaaatatataactatgtgaataagtttttgacaaacgaaaaaaaattgtcccctcaagggatcaagagagtttctatcaatttcacatgaaacagcttgatttgttacctgtgaacttggcctttgcgggcgcggagtgtgaggcggtggtggatctgggagcggtggtcgagcgcgggctgggagatctcgaggcgttcgcggcggacgacgcggaggtagcggatggggtcgaaaccgtccacctcgatgtcctcgtcccagaggaagatgtactcatactcggccaccatgtccgggtgtaagaaccttttcccgaaccaccatttcgtctggtccttcgccgccacgtgaatttgccggtccgaccacccgagttccctccacccgtccatcttgccgttgtagtggaacaacatcaccgtgaacctgtcaccggggaactgcatgcacgccaaccattgtcgcgacgagaatcagctcaagtttaagtgctaccaggggcggatccagcatgggagcagcggggtctcgagtccccaagctcccacgaagacctcactaaaattttttaccatatgtagataggtgggggactgtaactctatcta

SEQ ID NO: 14656 - DNA, 1404 bp, Oryza sativa
gttaaacgtggctttggaccgggatgaaacaataaaccaagtttagggactttgatgtacgctttgcaagttcgtggacctaagtgaaaccttccgataagtttaaagaccgctggtgtattttactcttttagttatcagatatcaagtcatgcgatttagtagttgtaaatttgattgaaaacaaggtgcacgcttccgaactgtgctaagatgacgacaaattagagcctacatcaatttccactaggaatagtatgaatggtctaaaaagatcttgcatcgatcgacaaaatcacatgaggacacgagacggatggctgaatctttgaattgagcatggaagcatacttactatcaacggatgttgctatctgctattgaagaatatatgagaatgagagacttgtggtccaacacatgtacacgtctatggagtgtctgaggccttgttcagttaggaaaaaaaatttaagtttgattgtcatattggatatttggacacacatttaaagtattaaacgtagtctaataacaaaacaaattacagattccgccagaaaattgttaggcgaatttattaagcctaattaatcagtcattagcaaatgtttactgtagcaccatattgtcaaatcatagcgcaattaggcttaaaagattcgtctcgcaattttacacacaaactgtgtaattgattttttttttccacatttaatattccatgcatgtgtccgaacattcgatatgatgggtgaaaagtttttgttttgggaactaaacaaggcctgagtggagaagaaaaaagaaaattgagaagatacataaaacgaggtgagccattagcatataattaattaagtgttagttattttaaactaaaattgaattaatatgaatatttaaaataacttttatatagatttttttaaaaaaacattgtttaacagtttagaaagcgtgtacgtggagaacgagagaaacattgtttgtttagaaaagtttgtagcagctgtagattgcctcggaatctccagctcaactcaaacattcatacttcttttacctaagttcaaataattataagctatagattttaggaaacgaattaatagttagaaactaaaaacctagtttttttattctcatcaattggttactcactacctatttgttagaatctctagctctctagacagaacgtaaaaatcacacgtgtctctgccaagttttccaagatgaaagccacataggggggttgggcattgtactccgtagctatcacacgtaccaacacttcaagtgtcaaattctttgccttgtcaccgattgcttagtaggagtaggagagagaggggactagcagattaattaggtggtgtttggatcagggacttaacttta

SEQ ID NO: 14657 - DNA, 646 bp, Oryza sativa
gaggagatggattctaatttcctaggtagatgtccattcgtttcttgatgtaaactaaatagttacaaaaacctgaaaaaattataggtaatatattatttcataaacatgtaagttcgaattcgacttctataaatttaaaaaaaataataaattaaactctaactagtatacgtatattcagttaaatttattatttttgttataatatatagaagttgaattcaaacttacatgtttatagagtaataattcttatctttttttgaaagtttttcataactatttagttgataactatttagttgatatgtaagaaacgtctatctaaatgcttaaaagagtttctcatattttataacaaattttgaaggctcttgttatatattggaatggagtgagcatctgttctgacctcgcagatgctgctgccggcgagttccgctcgctggacgccgccggcggcggcgccggtgcctgcctcttgcacctcgctggtcggagccctcgtctccgtctcttgcacctcgctcgtcggagccctcgtatacgtctcgcttacgtccatttctctcggccgtaactgaagaattgacaaattctgcagaaacaaattcataagctttcagaatttagagaattgatt

SEQ ID NO: 14658 - DNA, 4101 bp, Oryza sativa
  unsure (1)..(4101): unsure at all n locations
aatgagagcatgccagccgggcccacggcgctactcccagtaaagaaacacactctcccactctctcctctcctctgtccctcttcttcttcttctcccaagaactctctcctctctctctctacttttctcttctctctccttttgttgcttccatttctcgttcttgcacgggaaaaggagagaaacatgtgtgtcgctgtggtttaaaaaaggttgggtgtgagagaagagagaaagtggagtgaaggggagagagagagagagagatgggttcttgcgcttcggttcacaaggacctcgggttccccaagaagctgtttcttgcgtcgtcgcctaccaaggagaagaaggccgcgaacgggaagggtggcggtggcggtgtgtctgttgatctcaagcgaaaggagcagcagcaggcggcggcggcaggggttggcgtcaggagccccggttctggtaggattcgttgatcttggctctcttgggtctttttctgaagtgagtttcagtttcagatggttgtttgattgatcagtttggttgcttagctaggtaagtctattcttgaaaggttaaagagggagatgagtagatgacttggctgatctttctgtggaaaaaaaagaagaagaaaagaggccttttgggtttgtttattgattgatttattgtttgggtctggatttaagaatttgaaagggaagttttatggtgttaaaagtagtttatgaagaataaaaagattgcttattggtattaacaatagcttccgaagatcaaacagactgattgtttcagtaggaattgatgatattaactgaaacggacctctgttcaagtgttcatacaagctggttttcgattcaggttcatccaaatcaggaacttgcttcatggccatttgattagcctgggggggggggggggttgcagtgtgtttgtatctagtattactttgtccaaaatcaactgcttgctctttgtgttaccaatcatcgacgagatgtgcaagttgactgttttgtgtattctaatgttcttgtttgtcaattgggcacttcgttgaatttgtgtgttcattaattaagcctgatcgaatttataccatggttacacatgcttgtctgacctgaatatgcagtttttaatggatagaggaacttaaagaacttaatttgcaggtagcaaggatgaaatgttctttgactcgcgggcatggttagattctgattgcgaggacgacttctacagtgtgaatggaggtaatctaatgatgcagagtaaataggttccttctcactggcatgtctgtagtgccagtgccttgttcatgctgtttccttttcaagtctatcctattattgtatcagtagcatactagcatgaggcctgttctttttgtttagtccaaattgcatgtgcgctgattgatttggtgatgatacagttttatctgtctctctggattctaaggggcttattttagccctttgattgcttgttgagacaaaaggttgaggcctttgatttcgtcttttggcattatcatgtttctagcatctaataatctgttagctgcattggaccccccacctttaacttcggttacctattccatggggtcctttatttcagaagtcttgctatacacttaaattataagaaactccatttcttctgcatcattctggaagttcaatgaacaagtagatattctactgtaccaagtgattttgattgttttcaattcatgtgtaatgtatgttttttcgtgtgcagattttactccgtctcgtggcagcactccaaactaccaacccagaacccaaacagttatgagcaatgtctttgtacctgataatgtacagaattccaaatcacctgaaccttctccaactggaaggagaaaactagccgagctcttgcaggaggcgatgcagaatggttccgaagatagcaccgatgcatctgttccagacatcagcaagaatgagaagcagcaattccagcctgtttctgcagctgtgaagccagtatctgagtccagctccacgtgtagcacagaaccgacgccgatcagagaagcgaagaatcgcaaggagaaggcgtggtacaccggtcgctgttgcttgccggcttttgttcataccctagacttagatgagaggaggcagaagatgacccctgggccttgtgctgtttgacatggctgcttcccttctatgagctgtatctacaatatactacctgatccggccctgagttcactgtaaagaagactagtattgagagcactatatccttgtaataatcaagtgaatagtcactcttgagaattcatgtgctgtatccatgttaaatcaactgtaaggtgaggatatctagctcaagaaatgatcattttgtgcatatctggatgaatctttatggatataaaattttctcagttgtcaattttgtaatcaatctgtgggaagtgcatgtgacatgtgggataccatgccaacttttttcaataggttagcaatgtgattgattggcaaattgtgatggccttttttgtttgggatagcttgattgacgccagacaattggattgctctacccaataccaattgtcccaaacttttaattttttttcctttcattgacaattcagcgtggctgtgtgtcgtaacatcttgcagaatttgtgatttggcatttgtgccatgaatcgaagcctgattcgtgtgggttggcattctgcttgatggcgccaacgtgtttgtgcagcgcttttgatcgagcttatgataatgacaagccaactgccccaggatatggatgattacaccgttgccttcgtcatttctgatatttctaactactacttgatcagtttagtgtcagcgatgcaatatatgtgcaaaaaactcgaattctacaccgttattttgggcttgcaaacctggctacgaactgcaaaaacgactaggtaaaaatgaatttgaatgctcgttttttgtttggatgaaaggaccaatggatatcagccaaaaaacccgtcagatatggcagcccatacgacccctgtacacaaaagcacctaacattatcctctcacgagtatcacaaacacaataaaaacatggtgtctattgactctatttctctctggcccaccatttaagatcactttaatcaatcaggtttgacatgtgacacatgaacactatcaagatatataatttttatgatttcgatcatccaggggcaaccaaagccaacacaacacagtgcagcataacaagctggaagcttccattcaaaatacatttttcaaggttcacatctaagcagggtaaagaggtgtacagactgagaacaggcccaactgcctgcctgacaagagaaacattgtcgacaacactataaatatcactcgatcgttttggtgttgatattacaggatgcattgtattcctgcatagctcctccccacatgatcagcttcgaaccttcatacctgcggctccagtgattacgacaaatggactaccgaagtgaggaagaagacatgagaaaggattggatgcgttgcaggagctctgccttcacagaatcaggcactgatgctgttccagagacaagagataatgagaataatacgagagatagatattttgaaaggaaaaaaaaagaacttccccacccagtactgtaaatttgtaataccaccagcaataaacattgagaaccgagtgatgaacagatgatatgaggcattgaggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14659 - DNA, 287 bp, Oryza sativa
tgattgttttcttacaccatcttgcatgatcttatgtttaggtatagcaaacttggattctctggtaactctgagccatgtttcaccatccctactgtagtacctgcgaatgagtcttttctggaccagtcagagatgtgcagtaatgcatattggatagcacagtacaatgcaggtgtcatggctgacctggatttttgtataggcgatgaggctctatcactatttaaatctagcgggctgtacactataaaacacccaattaatcatggtcaggtatgtttatg

SEQ ID NO: 14660 - DNA, 411 bp, Oryza sativa
  unsure (1)..(411): unsure at all n locations
cagcagcgacttcatttattctagatcgggtacaccgtacatgtacgggccaacatacggtgcatgcagtgcgtggcacccttaacggaaaacgtgcacattattagtactacatgtacatgcgcacgtgcgctcacgctggtatctacgtacgcctcaggccggggcggcgagcacgccgtcgtccctgtggccgggagagcggcggcggcgggcggcggcgccggacttgggggagaagatggcgagctcctgcccccttccgaacttgaccatgcgcgcctncttcctcgacacgccgaacgcgttgtccagcacgtccgccggcatcccgcgcagcgccgacgacttgccaaccaccggcgcgttcatggcgccgtcgctcgtctggaacgacacccacgcgaaccc

SEQ ID NO: 14661 - DNA, 550 bp, Oryza sativa
ttgctaataagaattcaggttatgcattggactgttgttaagctgaggtaattgttcgttgatgatattgaagactttgaaccgtatgacaaaataccctttctgatcaatcaaccaagtgcatgtatgttacggttgcaacgagccaataattaccgagagacgattctatcagaaatgcagatgtgcataaaatttgcatctgaacaatccactcaaccataaacgaaaactttagattcagttgtagtatcgatcatgtggtctatacccctaaattttaaatcttaatatgcacaacaaaaaagacaggagaagcctacagcaatttacatggatgaagctggctctatgcacagcgcacagcctagagtggagtttcagtgatcaactgttcaaaattacatgatgttctctctgtttctcatggaaaattggcatgacgtggattagcggcaaaacagggtgttcatcaggaaatcctcaagagagaccaaccttgtagttctcagatccagcagatgattttaatcctcagaagatcagattt

SEQ ID NO: 14662 - DNA, 868 bp, Oryza sativa
acatccactatccttggcaatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatcatgtccctttggaaggtgctcctgatggtaatcgcgctcatctgcgccctgcatactacttcaggtaaacgagttaataagttttttttactattgtaaatttataattaatgtctactaccttagttataaaataaatttagaatatcttaaattgatgtctaaaatataatttattctgagacggatatagtataatctctattattagagaatagagagaatagactgaggaatttaattgtataatttgatgcagggagacctcccgtcgtgggatatcctgctcctcgtcccaacggtagctcgggcacacgatgctacgaaggctgcaaccctccaggtagagatggcaacagggatccataacagagaccctctgctaccctccaggtagagatggcaacagagatccataaccagagactctataggtttttattttattaggagtcatatatgatctaattcttgtatctatggatttatcaacagaaaaaaaatccttacatgttggatagatgggtattagttctttagccactcgtaccccttacctatgggtaaaaaatacctatatgcttagcgtgatagtttacttactttgaacgttcat

SEQ ID NO: 14663 - DNA, 368 bp, Oryza sativa
aaatcggattttatgactgaggtagcagtggcgactgtgatacataatgaaaaggggaagaaaaaaaatacaaaaaaaaaagctctcgctatggtctgaaaatgaaaaatgcagcaaaagagatttgtcaccaaattcggtgccaatttctgtctatacaaacagttaacgcacgtcaggattatgcgttgcttctcaaaaccatatgccagcgcctagctacaatagcagcggttggcgccacagcaccaagtatggtaggtcctcaactctgctggctacctaacaaaaaaagaccttcacatctccctccctagaataccaattcatccttctcttcagttgcaacggatagtgtgcctgccgat

SEQ ID NO: 14664 - DNA, 522 bp, Oryza sativa
  unsure (1)..(522): unsure at all n locations
nnnnnnnnnnnnnnnnnnnnnnnnnnnnnnatggttacatgcgcctctgagaacagaaatgcaggtaactggtaatatatggttttccataggaatcataattatcagttactagttgagattattgcagtcttcccatggattgataatctccttacaatctctatattgatgcaggttctccatgtacttagccagcacatggatgcctttgtaatatggaaccatagatagaaaatccaacgcgctcatgttgtcagcaagcaaagttgacagaaagataagtttattgatgtgattgtaacattggcaagaggaaatcctagatagtcattcgcacatgtacagcttttgattcagagcctctactggaggttcatatctttttcattgcttagttctttcctttgtttcttgggaagcttgtgaatgtggtggtttgtttccctgtaaacttcagcattctatgagtcatgactgtacacattgttttcattcccttgggttcaatcttcatatcta

SEQ ID NO: 14665 - DNA, 519 bp, Oryza sativa
  unsure (1)..(519): unsure at all n locations
nnnnnnnnnnnnnnnnnnnnnnnnnnnnnnntttcataaatgttgatctctgtttggtgtcctgcagcgtacgaaattcagatagaccggcctaccacaagctagaaacatctggagaagcagctagctgaattatatcttttctgaacttgtgacggctgggagattcagagtttcgtttgatggtggcactgacaaaacctgaattctggttaattacaggtaacgcctaaaccagaatcgctggctcaccacctgtacacatttgtgcagcatatggtctaaactctgaagataatggagcgatttgtttgatttgcaagccggcaggcagctgatcggaatcagacgatacagacaaggcagtctgcagtccgaccaaccagtttagctggagcagttcggcgttttgcagaagctgcaggagaaattcgagaccttggatgtctcaatccgaactcactgttgaaaaccattttctaaattttgccacaaatcacggattaaatctacgtacgt

SEQ ID NO: 14666 - DNA, 1131 bp, Oryza sativa
  unsure (1)..(1131): unsure at all n locations
tcgtgcgctgctgcgaagaggaatggcgcaacatgtgcaccgcacaggagtgcgagctcaccggccccttgcctccctctccttctcgaacggaacaggctctctggtcgcctttgcttccctcacacggaggtcaagagagctcgagcttagacgggctcgccgacgactacccctcatgctacctcctacgccttcctcgcacggaggtcatgcgagttcaagcttggatgggcttgcccaccacctctgcctctctcatatggaggccgggcgagcttgagcttggacaggctcgctggtcgccttcctcttcctcttcctgactctcccgccttcgcttcccttgcatagaggcgccgtgagctcgagcacggataggctcacccattgcctccctcaccgccacccctaaacagcttacgcggttgcagaaaaagataaaagaaagaagtgggacactgacatgtggccctatatgtttttctatttatttttgctggttaggatatcatgttagtgaaaaccagccattcgtaatgtcatgggacctatcttaaacagttttgccaagatgtgatgtgaagatttatagttttacgttttaaagagatgttaattaaactcaatgtaaagataagctacggcaagtggtgttattcctttcatctttctgaaactcctgggacataaatcgatggaccaaacaaaatgggacgcatgtacacacaaaatggccgtcacgtaatcaaaatcccgtttagactaactggtatgggcctcttgtacgtcgaaatcccatttcggcctaatattcataggtcccagtctcgttattgggccgcacgcacgacaaaagatggaataagttcaccggaggtccctcaacttaacaacgagattatttaaagtcccttaaccacaaaatcaaaaatgtgtacccctaagcttacataaaccgtgcactaaaggtcctatggcagtatatctgggtggtttcacgtggcatcctagtcagaaaaaaagaatttaaaaaagtatatggggttcacatgtcagctgcacatatctctctcttctcttttcttctccctccnttctcttttctctcttctctcttctcttctttgg

SEQ ID NO: 14667 - DNA, 624 bp, Oryza sativa
  unsure (1)..(624): unsure at all n locations
nnnnnnnnnnnnnnnnnnnnnnnnnnnnnnnnnnnnnnccacatgtcagctgcacatatctctctcttctcttttcttctccctcccttctcttttctctcttctctcttctcttctttggtcagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtggagaggggaggcggccggcggaagatgggggaggggagaggcggtcccttcctccagacgggccgacgctgtccgtcgtcgtgcacgacgccgcagccgcgtcgaaactccaccttcacaattttactcggataccatgataagagcagaagttaatttcacatggacattcggcacaactctggatacagacacctcaattaacaaacccaaatgtacacatttagaatccgataccaattaacccgatcaaagagcaaacatatgaactaaaaaacatcgattaaccaatcaaagactgaaaattcagattttctgacaccaattaaccaatcaacgaggttacctt

SEQ ID NO: 14668 - DNA, 289 bp, Oryza sativa
ggcgctttgactctggtcagttgtgctgagttagcgtgggacccatgctagcccgtgtgttagtaactaactctttcctcctctctcccgctctctcctctcttcccaatccccaaccaggaagcaggtcgcaagcagcgtggataaggttggcagccgacgtccagcgggtgtgtggggagaagggcggccaagcccgatgcgatgcaaggagccatgtccaatttgagaatgtaattcgaactcaatgttaagaggacagatccccggctgtgttcgggaggagggg

SEQ ID NO: 14669 - DNA, 21713 bp, Oryza sativa
  unsure (1)..(21713): unsure at all n locations
nnnnnnnnnnnnnnnnnnnnnnnnnnnnnnnattgatccagtcaagacgatgtgaaacgacgcaagcttaaaaaaaactgcagttatttaggttggattaagcatacgcgcacggcgcatcatatcgctcactctgcatggcttcggcttcttctgtcagcttaatgctgctcgtggctgcagctatggcctcagccgcctcggcgcagctgtcggcgacgttctacgacacgtcgtgcccaaacgcattgtccaccatcaagagcgcagtgacggccgccgtgaacagcgagccccgaatgggagcctcgctggtcaggctgcacttccacgactgcttcgtccaagcaagttttgatcacctaatctaatcagctgtacaagtagttctccttagactgtactttgagacaaggaaattaataacagaggatgtatctatggacttcactgatgatgcagggctgtgacgcgtctgttctgctgtccggccaggagcagaatgcaggcccgaacgctgggtcacttcggggattcaacgtcgtcgacaacatcaagacgcaggtcgaggccatctgcagccagaccgtctcctgcgccgacatcctcgccgtcgccgcccgtgactccgtcgtcgcggtaagatcacggatgagattactacatgatgcatatatttcttgtagactgtagtagtacgtactcctaatcgctcttggtttggtttggaatccttatatttgcagctcggagggccgtcgtggacggttctattgggaagaagggactccaccactgcgaacgaaagccaagcaaataccgacctccctgccccttcctctagcctcgctgaacttatcggcaatttctccagaaagggactcgacgtaaccgacatggttgctctctcaggtacatatatatgtacacagattatatcagtgattgattctcttacaaattttctgataagaatcataatacgatgagaacttgcaggcgcacacacgatcgggcaggcgcagtgccagaacttcagggacaggctctacaacgagacaaacatcgactccagcttcgcgacggcgctcaaggccaactgcccacggccgacgggcagcggcgacagcaacctggcgccgctggacacgacgacgcccaacgccttcgacagcgcctactacaccaacctgctgtccaacaagggcctcctgcactccgaccaggtgctcttcaacggcggcagcacggacaacacggtcaggaacttctcctccaacacggcggcgttcaacagcgccttcacggcggccatggtgaagatggggaacatctcgcccttgactggaacccaggggcagatcaggctcaactgctccaaggttaactagccggtgatgacgagtacgtgatggtctcagggaataaagctaggccccgacattgctgccaatagcgtgcagctagctgtggccatctcatcactttcatggttcaatggtttcatcagcaagtgcacggaacagactagagagtgtaggtgtatgcatgtgtgatgtcatgtaacgagttgccatgcaaaggcatgaggattacggacctctctttcgtcgtaatcctagcagctacagatttcaactgtcgtgttaaccaagtgaagtgctagtttcgaatgtattggcccctctctgctcttctctgctctggcgatctggcctctgcgatggtttcttctggggaataagttcatctaagttcccttaacttgtcaacgaatccgatttttatccttcaaccacaaaaccagatacaattggtccctcaactatcaaaaccggtgcatattatgtccctcggcggtttcgatagtggttttggctgacgtggcgcctacgtggctaattttgactcggtcttgatctgacgtggcactgatgtggcgcttacgtggcaattcgatccggaaaataataaaccccgtgggacccacatgtcagtttcacacacaataataataataatggtgggacccacgcggaccccacatgtcagtctaattaacccctcctcttctgcttcctctctctcctcctcccctctcttcgtctctctcttgcgctgggtcattctgattctcctcttccccatcttctctgtcttcatctctctcccctctcctctctctcttctctccggttcacgggcggcggggagaggacggtgtccggctgggagaaggggcgcggcgcggcggctagtgggagggaaactagcggatagaagggaaccagcccggtggcggaggcagcgccgccgcggccgtggctgcggacgacgtcgacgtcgacctcggcatcctcggcggcgggatgaacgtgtcccgccgaccggccgacacacgcgcgcatcctcggaggtggctgtccacgtgggcgggtgagggggccacctcgccggcgggagaggggagaggcggccggctgcgaagacgaccctagtgatgatgacgaccgtgcggcgcgcggcggaggccgatcccgtgagcaggaagctcttcgtccacggcctcggctggggcaccagagccgacgacctccgctccgcgtttatatgcctaatcatacaaaggtagaagaaatagcgactagtactagctgactggagtatattttgcttcgtcatcatcatttgcttgtgttatgacggggttgatgaatgaataaatgatcattgttttgggcaagaaaacaccgttccggccggactgacgaggaacccatatcgatccgctcgccgcggcccatggaaacccaacaggagatggcaacgctaccttccgccgtcggcgactactaatggtgggtgatgctcgagcacattgatgaactcgaggtcgacgacgaggactccaactacaactcctgctccgccgctgccgacgacaccgccaatcccgtgagtccatgacgacctcgctcacctccaacggccacgtcgtaagagtctacttccgcctcaaagcgcccccggcgacgtcacacctatgcctctggcaatcactcttctccatttccgccgccgtcgtcgtcgccggccgcatcccctagtgcaagagagagatgaagagaggagagaatgagagagaggaagcagaagaggaggggtgagtagactgacatgtggggcagcgtgggttccaccattattattatttttttttgtgtgtgaaactgacatgtgggtcccatggggtttattattttcccgggtcagattgccacgtaagcgccacgtcataccacgtcagatcgagaccgagtcaaaattagccacgcaggcgccacgtcagccaaaaccgccatcgaaaccgccgagggacctaatatgcaccggttttgatagttaagggacccgttgtatctggttttgcggttgaaagacgaaaatcggattcgttgataagttaagggaccttagatgaacttaagaagtccgcctggagagctgaaatgggctgcaccttttagtgtccccgtgatgtggcccaactacgcctagttaatgggctactggtctggaaagtggattgtagtccgcttgtgtacgctggaataagttcactttgcgtcccgcatctttgatggcaagtttgaaaattcgttgctgaaccgcaatatcaagtatagcctgtccccgaactcgtaaaaccgtgttaactttcgttctaatatagtatggctcctgatttcgtccgatgtggcgctttgactctggtcagttgtgctgagttagcgtgggacccatgctagcccgtgtgttagtaactaactctttcctcctctctcccgctctctcctctcttcccaatccccaaccaggaagcaggtcgcaagcagcgtggataaggttggcagccgacgtccaacgggtgtgtggggagaagggcggccaagcccgatgcgatgcaaggagccatgtccaatttgagaatgtaattcgaactcaatgttaagaggacagatccccggctgtgttcggaagaaggggttgggaacccctcctctccggcaggtataacgaaacaatcattagtgtataactaattaagtattaatttaaaaattttaaaaaataaattaatatgatttttttaaaaaaaaccttcctgtagaaaacttttgaaaagaacgtatcgtttagtagtttgaaaagcgtgcatatgaaaaaaagaggaaaatgagttgaaaaaaaaagggaataagtggacttattcctgtgtacgccttaaatcgccatgtgcatgtgtatagcagggttgtatggcgtccaaaaaaacacgcacacggatagttttgttcggtttggcataacaatttatagcatgttgactgttgacctcatcctgtcagtcgctcggttcatcatttcaactgcttgtgcatcacccaaataattcgactggctaaggtttatcagaaaatgtgtgttcgtctattttttctggtagaagatttacttcggaaatagttgtggtccaaatactgtccaaactcttttccaaacgagtgagaagagaaatggtggccaaatggaagatgatcacgtacaccaaaaaatagtaatcttatagatatatcatcaactagtagtgcacaagctcccacgttaattaaaaattttgatcaatttattgtctacatgcccaattaattaatgtttgaatcctaatacatgcatggaagataaaattagaaccagataataaaagcaatgatgtactcactccttcccatgtttatccatcatataatggaatttaaaatttcttaaatcgatcatcatataaccgcatggacacagattttatcaaaatacaattaatacagcatgaaagaatgtgtacatgctaagatgtaattgacatggtgttttaatcgatacatacattatgggagaatgtgtgcatggtgttttgattaatgtgatttaaattatacttggtcctcgtgcataaacatatatgatgatcaatttaggaatgaggaagtatttagtttgtgtgtttatatgagcgtttgcacgactgtactatgtttttaaaaaatactgttacctttctactccctacattctcccatgatgtattaattgtattctgataaaattcgtgtccatgcagttatatgatgatcaacttgaaaaattttggattccattatatgatgattaaattgggaaagagagagtattagctttttcaaataaatataggggggggtggttcagcaattaaaatggggctaacctacctgtaaactctaaacagaaatctgtgcctaaagtgaaaaccacttatgtcggacaggtatagaaactaaaagataattaaaattgtcaacatcggtttatccagccaagaggaactagaatgcaaaattactttacagcaatgcagctctggcgaaacgttgacagatttggccctctcccacacgaatgctgcatatgttggcttgtagcagccatcgtttctagcaaatcaagtctggtgttatcagacttggacacatgcgtactagtaatattagggagtccctacagagaagtagagaacgaccaagattttgcacttttgctggcatatgtgaagacataactcccgaatatacttgttggctgtttatctccaatgtatctactatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtgatggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcacgtttccatctcacaaaccaccctgttttttttttttactttgatttaaggccgaaaagtagctaacaggtttgcctgtctgtcagactacgtgagttagcagcgttgcaagaaaataatcgtggcttaatttttgtctgaatcaacacagggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcggtaaccatgcatgcatatatcaacgacacaagatatcgagctcgcgattacgaattctgtgatgctgaattgctttatttggtttttaatttggcatgcagcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcacacaatatatataactcctcgatcgatctcctaatcaaccatggaagtgtagtaaacaacagcttgtgttgaaatttgaaaacgatatgtttttgtttcaattatgcaggtgcgcacacgattggtatggcacggtgcaggggcttcaggacgaggctatacaacgagaccaacatcgacgccgcctttgcggcggcgctcaaggccaactgcccggcgacgccgggcagcggcgacggcaacctggcgccgctggacacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaagatggggaacatctcgccgctgaccgggacacagggacagatcaggctcatctgctccgccgtcaactcgtgatctgatcgaccggtttgtatatatccagacgctgggcactcgacaacatgattaattaccagtgcacgaatgcatcaaggaaagaattccagttgcaattaattacaggtgaaacatactactccgtcttagaaagaatccaatcctaacaatgaatcttgacacatgttcgttattaggattggatttttttttttttggaacggaggaggtacgctcgtattagcatacgcaattatagtcctttaaaatcgtagagcattcagtgaagatgtcaccgagaatgtcacggggaatgttactgaatctgcgtccgtttattagcaggtttgcatgcttcttgatctgtaccgacttctctctccaatacaaaatccactcctgttacaagttattttttccctctctctttttttttgagagagagaggactcccgctcttgcaatcttgctagacctgttcgtcctccatcttgcagtagcaagattttttgttttctggattgccgtcggccggtgaccacacgcgcgccgccggcgcgagttaagatatctccaccgcctcggcgatattttgctccacgttgcaaaggcccgtgaaggtgacgatttggcccatctatgccggtgagcgtgctacgtggtggatggggcgtgggccggcttattttcgcggcgcaaaggcctactctttacttggcaggctgccactacttcggcccattaaaattcaccagcggcagaaattgaaatgcttttttttggcgggtagaaaatgaaatgatttgtttttacaggaaaaaaaatgaattgaaaactaaaaaaagctgtcaacgtcgttttaaacattctgaaggtgaaaggaaagcaaaatgactgcacaacggtcagaaaaggagagaattatcttggacaaatgctgaccaatcgattcatctagggttgtgtttcgtctgttagtacggagttccacaccgagtgcacatccggtggattatgttggacctgcacttgtcatgaaatatattgggtgaatgtttctcgtatacgtccttttttcattttcttcgcgaaccctttatgttttttcttcttctaaatcatcattcatatgctgctggacacgatattgtaaatacatgtgtttgtatttccagtatttgatttcagtttaagaatcataatgagtgcttaaattttgactaattgtttctgccattcttctcgaggacagtccatatatttgaactaatctagattctgaacggtgaagttttacctgtatattgaaaattctccaaaaaaaattgacaacattcacaacatatatatgaactactctaaaaaaaatcaagtaaagactcaactcacacattgagaaatgaaattaaaaaacaaatccagcattaattggtactattcacatatgaatttgtctttttatttctcaatgcgcggatcaaatttgaatataatttttggtagaatggtatatgctgtttatactctacattagtaattttttaaataattttacaactatttatattaaatataaaagaaaaggttatacgcgttgatattctctcgggggattagaatccctcttccgtgaaagtaacttacaacttcagattcttctgaatctttgctgatcaactagtataatgtacgggtgtacagattctgattaatcacaaacagatactgagagcagaagaaatatcaatatattgtcattacaacttaattcagtactggccttgattggctgcgattgctgctacagacgctgtggctgaggtagttgaaccgttgcaagctacagccattttgaactgccgcaataacggctgttatggtagcaatcacatccgaacatgcccacgtatgtgatagatcgaaatggcaatggagttcggccccagcttaactgaaatgaactctgcttgattgcatggcagacaaactcattatcatggatgcgagagctgaacattcaactgttacatggtttaaggcgaggcgtggtgtcctaactgttaggacattctcttggatcagtgtcacaacagttactgttctggtgctacctacagtagtagtgcactgtactgttatttgtttcctacgagtatatactggtagcccaaagactgtttagtgaaatggatgaccagggatggtggctgttctgttctcctcactccgttttttaatagatgacaccgttgactttttctcacacgtttaatcattcgtcttattcaaaaattttatacaaatgtataagatataaatcacacttaaaatactatgagtgataaaacaactcataacaaaataaattataattacgtaaattttttgaataagacaaatggtcaaacatgtaagaaaagaaagtcaacggcgtcatctatttaaaaaacggatgtagtattccacacttttccactcacttgctcatagaaagttcacgaacacagctgtaactaaagtgacaaagccatgttacgccattgtttcacagacttttcctgcaagcgatgcctgacaattccaaggatatactataattttgcccggtgaaagagggaagcaggggttagtgttggcggttgcaatttaagttgggcgctgtcacccgatcatgtctctcttgggtgcatgcaagccaaattacttcaccacacaacgtgagcacgtcgaatgccaacacacgttggtcaatactgttcatacccacgatcaaaatggctgcacaacgacagtggattgtgaggactaaccctggactggtaaggcatcaaatctgaatgttttgtctctgctggagaagtacagagatatgcaggtaaccaagtgggctaattaaatctctagctataaatatgcatgggatgcagcactctcctcgcaagccacagccaagtgcagatagctcattgctaggcagagataaacgtatatatctttggttaattgttagcttagcgatggccaaagcaacttgcatttccttgcttgtggtcgtggctctggccaccgcggcgtcggcgcagctgtcggcgacgttctacgacacgtcgtgccccagagccatgtccatcatcaagagcgccgtgaccgccgccgtgaacagcgaaccccgcatgggcgcgtcgctgctcaggctgcacttccatgactgttttgtccaagcaagttccacacataaccagcgcctttgttccattttgacttaaacgttactgcagtatatctctagtcaagcaacttgagtgatatttgaattgaactagaaaagttaaatatatattgtacatgtgtgcatgcagttagatgacatgttcagacaaataaccatatattgtacatgtgtgcatgcagttagatgacaattgacaagcaagacaaataaccatacattcttcctgtttgactaactgtacagggttgtgacgcgtctgttctgttgtcgggaaacgagcaggatgctcctccaaacaaggattctcttagaggctacggcgtcatcgacagcatcaaggcgcagatagaggccgtgtgcaatcagaccgtctcatgcgccgacatccttaccgtcgccgcccgtgactccgtcgtcgctgtaagatcactttccctgcatgcatagcctgcacgcttggtctcgaactctcctctcgatcgattcctgtatggttgtacgtgggaaacggatcctctaacgtgaacttcttcctaacgtgatcactaacagtaacaggtgagcccgtcagtggtggaactcatatatcagttatcacgttcctctggttttacgtcagatgatcccgatccatatatatgacattattaggcttcggcttttgtacttaaccaatggagtaataatcatatgaacgcgcatgcagctgggagggccaacgtggactgtcccgctggggagaagggactctacaggtgcaagcgcggcgctcgcgatcagcgacctccctccttttaccgctagcctccaagaactcgtagacgcattcgccaagaagggccttagcgtaaccgacatggttgctctctcaggtaaagatccaccatatatgctcacaaaccatcaaaccaagcaagcttaattttctgcactcctatttcaggcgcgcacacgatcgggcaggcgcagtgctcaaccttcaggggcaggatctacaacgagaccaacatcgactcggccttcgcgacgcaacgccaggccaactgcccacggacatccggcgacatgaacctggcgccgctggacacgacgacggcgaacgcgttcgacaacgcctactacaccaacctgctgtcgaacaagggcctcctgcactcggaccaggtgctcttcaacaacggcagcacggacaacacggggaggaacttcgcgtccaacgcggcggagttcagcagcgccttcgcgacggccatggtgaacatggggaacatcgcgcccaagacgggaacaaacggccagatcaggctcagctgctccaaggtgaactcgtaagcgagtaccctgcagacactgcagtaagtagtaacaacgtttgtagcagtatatgcagttatgcacgtataagacgatggagtgcgtgaaaaaataaggacccccacaaccactacgactgaatgaatagcaatgtgtacgtggagatgtggtacatgcagatttgccttgctctgtttcttgttccatctgtatgtgcatggaatacagaggacagaggggcatatgcatggcgtatatgtaacgaaatttctggtgcaaaggcacggaggattatactatactcatcttctaaatattattcctacaagctactagtattccacacgagagaccgagagacccatcagaagggatcagaatgcgtgtggctgggctgctgggtcatctccacatgagacattttttattgggccgtgaactttctcgttcgtaacatgtcggtgcttctatgaaaaagcccagtataactgggtcacgtcccattaaggaagtagctcattcacactagtactcctgtgtccaccgtcggatccgagtttcaaaaataaaagggaaaggtctgaacagatattaaatttttggttgaaatggaacataattttcaaaacaattcaaatacaagagcaggccatcacaaaatcagaagtacatgcaagcacacccttcaagaaatcagcagctaccacaggtgccatgcaaattcgtggcgatgactcgtgtcgtgtgtcgcttgaccacaccaggatcgatcgatcactcactggttaacaacccggcagttctccctgatctcgccgtcgtcgccggtgagcgggctgatgttgcccatcttcaccatggcggcgccgaagtcctcccagaacttgtccgggttctcgccgtagtacttgaccagctcgtcgctgtcgccgccgccgccgccctggtacagctgctggtccgtgtgcagcagcgcgcggccctgcgtgaggccctggtagtagtcggtgtccacggtggtcggcgtgtcgtccagcgaggcgagcgcctcgtcgtcgccgacgatggggcactgctcctcgagcgccgcggcgtaggccgggtccagcgtgtcggtctcgttgtagaggcggctgcggaagaagaggcagcgggagtagcccagcgtgtggccgccggagagcacgacgaggtcctgcagcgacaagccgtgggactcgaagttgtcgacgaggtccgggaggtccatgaacgggttcgggatgtcgtcgttcgcgtcgtcgatgctcgccgtcgtcgcgtcgcgccgccccaggagcacctcgtacgagcttcccccgagctgcaaacaaaatgaatcgtacgtgtcacgttgcattgacatcagggtctgtttagttccctaaactcccaaacaaaatttttcgtgctgtcacattaaatgtttgacatatgtatgtagtattaaatgtaaaaaaaatcagttacatagttcgccagaaaattatgagacgaatcttttaagtctaatcgcgtcatgatttgacaatgttgtgctacaataaatatttgctgatgacggattaattaggattaataaattcgtctcgcagtttcctgacataatctacaatacgtaaaagtggttgtgccttatattttacgatggatggagtattagactacgtttaatacttcaaatatatatctatatatccgatgtgacatgcaggggcaaatttttttgccaactaaataaaccctcattttggcctcaccaagtcaacaggatcaggatgtgccgcagtttttcagataagtgaatcacgactcattctcttgtgaaaatgatgtcatgaaagccggttattgggtttaggttgaagaaagattttcaaaaggagcatggtttgtcttatggtcgatgacgttgccctgttcgatagatagctttctactactagtagtacctttcaatcgacagtatgtgtaacgtggataagttttacacttgtactgaacttaccgcgacgattgaatcacgagcagcaactgccaagatatcagcgcaggagacaacattccccaagcaggccgtgttcaccgccaccttgatggcgtcgatcacgtcgaaccctctcaatgacatgttgttcggcttcgccagcttctccccgatcatgtcgtcggtgtcgtccagcagaacggagccatcacaaccctgcatcacgttcgttcatcaccaaaacatctcatctgcttgtaaaatctgcagcaattaaccactaagttgaagcgtgcatgatttagtagctagctcacattgacgaagcagtcatggaagtgcatccggaccaaggacgcgcccatcctcggctccttcaagatggcggcgccgacgacgagcttgatggtcgtcagcgcctgcgggcacgtctcgctgtagaagtccggggtgagctcgccggagccggaggccgacgcaaaagccgcggccatgacggcgaacacaacaagaaatggcgccatttttggcaagctgctactactgcttccagtaccagcgattagctagtgagatggtcgaatgtgctggtttggagtgtgatgctgatgagactgtgtgcttatataatgggctaaatatgtgcgattgacccgtcactattagccaggttaacaaccggtgctttttttcggtgtatgatagagatctaatgcaaatccaggctttcagaatgcgtcaatgcgaggcttgtcaaagaagagatcagtttcttctccatcttatcaattaccaaattgtgacaggcatgtaaagtgctactggtttcttgcgagtaatgccgacctctttacaggatttttctttgtttattttctgaaacataatacaggctttttcttaacaaaatgttacttattacacggatatttacctgatgaacctttttggtaccgaattgaatatgagccatcgtccataagtaaaataatgaggaactacttttgttaagcaagtttgttagcatagttttcttgcagaaaccagcaaaatcgactgatcatatcctcctttataatgagccagtttaacacgataagaaaccatccgaacgctataatctatgctccagcactgcgtataaaatgctttatggaacagctgtttttgggttgttttgcaggttaataaactgccactgctttagaacagaggcatgtatcaaggcgatgcttgacctaatcaatggatcacaatcacacggtttggtcaatcacttgccgcaaatatttaaacgcgtgctttagacataggttgaaacttgaaatatttctctctgtttcctccttggaataagttcactttgggtccctcaatttgtcacccagtctgattttcatccattgatcgtaaaaccgggtacgactggtcccccaacttacgaaaccgtttaaataaggtccctgggcagtatttgacccctgttttggctaaggtggcgcctacgtggctaatttgacttggtcttcatctgacgtggcagtgacgtagcgcttacgtggcaattcgataaaaaaaataataaaacctacaggacccacatgtcagtttcacacacacacacacactaatggaccccacctgtcattctcactaccccttctctctatcccctccctcttctctctccatccggagcggtgggggtggcagcggcggagcggcagggaggagtggcggcggccggagtgggtggggaaggagcggcggccgccgaagtggggtgggcaaggagcggtggcggtcggagtgggacgggcaggagcgggcagggcacctggcggcgacagcccccgcacccgcgacctccctcgtggcgcgtcgatccatgggtcccccgccgccgcgtcgcgaagccagagcacggcggagacgtaggcggcggggaggcagtgctcaggcgcgaggcggtagtcgagggagatgacgatggctggcacggccgcggccatggcctcgcacgaggcgtggtagaagacgctgccggtggagaagaggacgaagccaccgccgtggaagtagacaatgacagggagctttgacgctggcggcggtggcgggacgaggttggggaggtgtcgagggaggcgtcgagcggcccgtcgcgggagaggacaaggccggtggcagacggcggcgcgtcggggacaaaggggcgcgtgatggtgccgcccgggtgaaagaaggggaagggaaagctcctcgctccggcgggcggccgctgacgagcttggtggcggtggaaaaaagaggggcgacggcgaggttttattctcctctctcccctccctctttctctagatccgcgcaccgctccgctgctgccggcggcgtcgaagagcgtgaggaggcgacagtggtggaggctagttgcggcggagggcgtgcgccgcttcctctcccgtcggcgccgccgcgtgccgctccctctccatcacgcgtgagagaggaggggagagagatgaagaaaggggaaagaggaggaagaagggggaggagtgaggatgacatgtggggcccacgtaggtcccactttttttattaatttatgtgtgaaactgatatgtgggtttcacaaggtttattatttttcttagatcaaattgccacgtaagcaccacgtctgtgccacgtcaaatgaagaccgagtcaaattagccatgtatgcgtcacgtcagccaaaaccactatcaaaaccgccgagggacctcgtttacccattttcgtaagttgggggacgggttgtatccagttttacggttcagggacgaaaatcagactggacgacaaatagagggacctaaagtgaacttatcccttctcctttatgttgatttcggaccatcaggcccctgtatcgatactctgtgggccttttatggcctgtcagcaggctcttttacggccgtatatcccgtcccgttgtagggccgaaagcggaacattccggcccatttactgcaaaatctcataatctaaagctggcacttttgctagcttttgattggtccacttggcgcctcttaccttggagaaaaattataaatttatactagagaacaaacacctaacaatcatatgtgagaaaaaatctagagaaaaatatcacatatagattcggcttccagatcttctctttccaaccacacgaacttctactcccttgtcttctataaatataccacgcctactcggtactactcctataactctacaatatataataaacctaaaattattaagaaaaaacaaatctaaaataacgaatttacattcattttccttctttaaatatcctacgtctactcggtactattcatataactctagaatatacggtaaacccaacattattatgcaaaaaaaatccaaaacaaagaaaaaaagaaaatcttgttttcttatatcacagaataggatcattaatacctactcagctaaaaaatgattgtgtttttttgttacacaggatatgttaaaaaaactctaaatataataaataattgatctttcaaaaatttaaatccacaagtaaatatatttgaaccaattaattctgatgaatcttaaaatttattttacttgtttgaattcatcagaatttatgcataaaatgacacattaaatttagtacaactttggcctataaactatgaatagcaggaatcatttgaaaaacacatttttcttacttccaagcaatagaaaaatcaaatagagccgcatatgatcttgctgaatataagtaacttcaattttaggactaaaggcagcactactttacaatttcagagatcaagtactttacaattttagagatcaagcagttcataattatgcagcaacccaaatttagactctcaatgccgtgctttcacatgcgtgtccctgtctcggtcattgcatagtcatgttgtatttgaagtcgcggtatgagtgcagccatgaaatttatgtctctggtgagacgagtattgcggcaatagtgcagcacaaaccaatcgtcaatcgtgctaaaaatacaaacatatttaccccaataaataagataaaaataatataaaaaagttgaactagatttgcatcttacctgcaacgatataccctcatgcacaggcataagttgagttgtagagagaactccataatcgcacattgggaatgttgttattgacctaatatcaaaatagcaatttgtataaaaaaaacttattttctattcaaaacttcattcagtggccattatttaaaaatgtttttctttttaggatagattacataaaaatcgataaattcatagtttgcaaggaattacctaggcgacgactagtacataatcccgtgggcgcatttcttttttagatagattacataaaaatcgataaattgatagtttgtaaggaatcgcctaggcgacgactagtacataatcccatagacgcatttcacgactaaagtattctgtgggccatatacggcccaattatgaggaagttaggccttacggtctaataaatcgacgcgtgcatgatgaactttcatgaaaacgcttcgtgtaagacattcgaccgtgttcggccccaccatcatttacccatctcttatgggatcatctgtacatttgtcgacaaattttctcctaaaaatttcgcatccaattatagtacaatcgtgatgtgattatattgtaacttgtatataactcttaacaatctcttcgtaacatgctattttggtgaaacggagatcgtgggaatgaatcctctcacatgtgtgcgtgtagtgacttttttccttcttcacttgcacatgaaacaaatctaatggttcaaaattgttggaacaaagtctaaaatgcatggcaagggccctctcctctataggagagagcccatgcttgagttctttaggagagaggttgagagaaagaggataaagtttggatggccgagaatggagtgggggtgtgggggggagatcctcttgtccttggagggcttattttattcatatgtaacgggaaattacatctttacccttaatttactatatatgtacaacatcctcttgggggtattttaatccttttatacattagtttatacgacactctaagtatgtggttattccccaacaagaaatatgtgaaagttacatgcaagttgcattatagttacatgtaagttacaatgtaattacatgtaagttacagtgtaattatactatgatagtacttaattacatctgtcaaatttttaagaggaaatttatagacaaatatatagcaaaattgtctctctttcacgcgatttccatctaacacatcaagcctctttgaccccttccctatctctctctatatttttcgtcggcctgacatagggggcccaaggtcgtttgttgccatccccacaatctccggtgagcgaccaaagattgaaagatcttacaataagggagacagatccatttgtcagagtggaggaaggatgcaggaggtaggccatatcttattttttctttttggagctttttgtgaggatgttgcaagctattattttcccatgcatgttacgccttggtgtaattgaatgttttactatattttaattgtatgttgcgcactttaattcttaggtgttgcgactagcttatttaaatattgcatttggttgaacatttttctctaaccgctgaaacatttttaccgaatattgaaacatcttaaatatttttattgtaacatttcggtgaaacatctaaaacatttttgtacggacgtctgggccttgctcctctccggactttcaaggttagtgctgtagaactctggaactaacatgcggctgattaaatgagttgatgggcagcttaattacggcccgcctgtttagccaattgatactcagctcacatacggcctaattaagttagattaactagataaaagaacatccaacacaggggcccagctcccagctagtagtactcagtactcgtctcgatgctacgaaaccccaccttacagaagcgtaaaactgcgtaagcccatcaggactgggcccacatggcagataagcatggcccgagttcgtagtaaatcccccaagtcctgcacggggtgatcacatcaacagtgtgttcctcaaggagcgttgtcacgctacaacgtgatggtggcgcgccacggcggagaaatggcactcactgtttcctcgtgacgtgcgccaaaacaggctcgccacggcacgccccttgccgccggggaaatgaatgatccagggcggcagcagagtaccagaccctaagcttcagacgcggccccatctacagccactgtttcgcaatgcttagaaagatggcagcctgaaataattgaactcgttcggccgggccaacccggcagagaaaaaaagggattattgaactccaaaagtgatcaaatgcggtggagcagagctctcgtgagtctaatcccgcaacgagaacgcatatgaataatggttttgcggcgggtgcgttctgcaatgacaggccaacggtcaaagcatcccaactcccgcctcctcctcgtctaaaaccactcgcttccaaacaatccaaaccttccatgccatttggcatttttggctttgcttctcttctcttcctttgctttggctcttccccaaaatcacaagacccaagaaagaaagagagagagacaaaacaacagatcatctttgcagcactgtattggcactgtaccgctcgacatgaacggcgaggaggctccggccgggagcggcggcggcggcggtggaagggcggagatcgacacgtcggcgcccttcgagtcggtgcgcgaagccgtcgaccacttcggcggcggcgccgccgccgtctggagctcctgcctcgtcaaccgcatgctcactcccccgaaggtgacgcctcctacagtaatcttcccaatattcgtgcttcgttctccatttctcccaagtccaaacaccgtgctgttgagtgtcgaacgaactgttaatgtttcagtacagttgggagtgttttgtactactagttttgtcctcgttgtattagcaaaatcagcttgcaaatctgcatcagtatttgtatgctcccttttgtcttatgctactaatccgattgcaggaacatgaccagatgaatgggcagacctttgcactagagaaggagctcatcatcaaggaaagccagacgcttgatgtgctcaaagaattagagtcctccaaaaggatcatttcggacttgaagctaaaagtgcagaatgattcagccatcactggacacccgggccaaactgaagcaccaggtgcagggcctgaggagaggcgctcttctgaaaatgttgaaactgatggggaattgggtggcctggattcacagaatctgcagcctccaagttcagtgctaatgcagcttgagcaggcaaaagcgtacttgaccagaaccacagctgatctagccgagataagagcctccgttgagtcgctgtgcaatgagatagcaaaagagaaaatcttggtggagagaagtcgagagaaggtttgctccaacacatccttgatctcttcgctggagggtgaattggatcgcactacacataagctgcaaacgctgaatgataggcaaagaaggcgcgaggattcgtcacacattctgatggagatcaagaaggtgacatcagagatagagcagctcaagagcgcatcaaatgcatcgaaatctgaagctacgatgttggctgccgaaattgagcagacaaaggcaagcattgcaaccgctgaggtgaggtgtcttgcagccaagaagatggaagatgcagcaagagcagcagaagctcttgcacttgctgagatcaaggccctacttagcggtgaagcttcagctggagatctccagggtactgatggagtgaacttgtc

SEQ ID NO: 14670 - DNA, 19211 bp, Oryza sativa
  unsure (1)..(19211): unsure at all n locations
nnnnnnnnnnnnnnnnnnnnnnnnnnnnnnnnnnnnnnnaagctacgatgttggctgccgaaattgagcagacaaaggcaagcattgcaaccgctgaggtgaggtgtcttgcagccaagaagatggaagatgcagcaagagcagcagaagctcttgcacttgctgagatcaaggccctacttagcggtgaagcttcagctggagatctccagggtactgatggagtgaacttgtccttggaaaagtattttgagcttgcttcaaaagctcaagagtgtgacgtcagctcgaggaagaagattgaagcggcaatgttgcaggtggaagaagccaaccgatcaaaatccaactcgctcaacaagctggaggaagctaaattggaatttgagaaatgcaaaattgcactgcaggatgctctgaagagggcacacgctgccaatcgggggaagctcgcagtggaagagtctgttcgtagatggctatctgagagtggctacaagaggcactcatttcatgattcttccaagttaaaaaatgcagcagatatcactgacgtttcaaagagcttcttgaagccaacactgtcaattgggcagatattgaatctgaagctaatgggacctgatgggtatgacaaaagcgtttgggatgatacaactgaagcttcaaatgtttcacttggtcagatcctgaaccggaggaatgctgttttctgtaacagtgatataacttctcagaagatattgtcaggaaaaaggaagaaatttgccttcacagggctttcagttttgttggcaaaacaagccaagaggcaagagcaagagaaatagaggatcagattagagcctatctgcccaaggtttacctaagcctgaaacagtaggtgatgaatgttgtgaccactatttccatgttcatgtatgttagttggttctggccctgcgtcctctgaatctgttattgccctctcacacatgatttctctaggatgactggttgcggattaggaacgtaaaactgacggtattgcagtcctttctataaatttgcaactatgcttaacatgagtgaggccacaagatgagctgttagtactttcccatgcttgattttaaccgttcatattgtgtgcaattattaatccctaataattactataagtctaaactttaacttatttattacccaccaaatataggtattgctaattattcttgctcatgattgttacctacaagtgtccgtagaaacgtgcgaagttacacatagttggaaccacaaagttttatcacgtactgcgtgcttttgaagtatagcgaaatgcatttcttgtggcccttaatagtacttgtgttcagaattaatagatataaagacttgaagtcgagcaaaaatcataccgtcgatatgtccgagtggttaaggagacagacttgaaatctgttgggctacgcccgcgcaggttcgaaccctgctgtcgacgcatgattttttgtccctcaactagctaatttaactcggtcttcagacgtgacaattcgatccgaaaaaacaataaaacccgtggatccgaaaaaacaataaaacctgtggaacccacatgtcagtctcacacagaaaataataaaaaaatggtgggcctcacatgttagtccaacttacccctcctcttgttgctgctcactcccccatctcccctcttttcatctctctctcctctcctctcctcagacgacggagaggcagcggcacgcggtggcagtgcggtcggacagtggggcctatgcggaggagctcggacgagcgacgacggcgccggtgcagcggggcgcggctgagcggcggctcgacgcgagcgtggccgtgcggcggcgccggccccggcgcgggtacagcgcgggtcgcggcctcaacggtgcgcaagggcaacggtgccgatgcggaggagctcggcctagcgacggcggcgccgatgcggtggggcgcggttggaaagaacaacacggaatcaatcgacaccaaatttttatcgtatttcttttatgctgtttttccttctctacgttttgctcctcccgatctactgcaggcagctgtcatcgtcatcgtcgtctctccggccggctggtggtgacgctgcctcgaagcagctgctggctgctgcgtagatgcacacgcagcagcgttgctgcatgagttagacgcagcagcaggtgaatttttgtgttgctttcctgggataaattttggtggcaacattttcttcttctttcctcggttctcttcttcttcctatggcgccggtcgccgtggagtggcgctcgcggctgctcgggcggcgcggctcctccggccatgcgccccaccgcatcggcgctgtcgtcgctcggccgagctcctccgcatcggcaccactgcccttccgcacccccgagggcgcgacccgcgctgtgcccgcgccggggccggcgccgccgcacggccacgctcgcgcggagcatccactcagtcgcgccccgccgcatcggcgccgctgtcactcggccgagctcctccgcataggcaccgttgtccggccacatcgccgctgcctctccgtcgcctgatgacagaggagaggagaggagagagagatgaagagaggggagatgggggagagaggatgaaaaagaggggtgagttggactgacatgtggggcccatgtgtgtcccaccatttttttattattttctgtgtgagactgacatgtgggtcctatgggttttattattttttctggatcgaattgccacgtaagcgccacgtcagtgccacgtcagatgaagactaagtcaaattagccacgtaggcgccacgtcagccaaaaccgccctcaaaatatcgagggacctaatctgcaccggttttaatagttgagggacccgttgtgtgtggttttccggatgagggacggaaatcggattcgttgacaagttaagggacctcagatgaacttattccttttttttatatcatttttaccgaatttactgggtcttgtgttgccaaatggaaaccttttttccttaatgggctgggccttgtgttgacatatgggccatttttctcctaaatagactgggcccagtggacatataggccctttttcctaatggactgggtcttgtgttgactaatgggcccttttcgtgatacaccgggccttgtgtggacatagggccgtttcagcaactcgttacttactatcctctatcggttctctattgcaaaaatttcttcttgcttgctgctttgttcatgcaacacccatgtccccgaattcgccctactgcagaagcttggattggagccaatttttccctgccaatattttggcactaccaaatttaatacagcactagcgtaaaatttgactagtgagagaaaaatgggtagcaaaccaaacacccatgtagctccgatccaaaaaagccataaacatgatgacgtgcccttttcatactacagtagcaagaacaaatgaacaattccacggcgtaaaccatttactgtctgtctgtccgtagggttatgattcccaaattacgtgcttgggttgggttagaccaagcatcgctgcctgcaagcagcagcttttcttcaaggctgaactgctggaatcagatcagaagttttccgagttcacgtgcaatccaatgcgtctgaaggtgaatcacgttgtttgcgtggatggaaaaaatatgttgctccgccttatcgtagacggacgtgctgtctgtccaggttcaatacacttgcctataaagtataaactccattctctcatgtgcaattcgaaataaactagtgatagtagtactgaataaacaagtcgtcgacactgcagcattatagtactgtactacatttctgaaccggaaacggctggtatactcgattgtaggaaccaaatcgaccaatacattccatgctctcaaatgggatggatatatcaaccttcgtctttctgctcgagcagttgaaccgaacgcgagccaccaccggttcttgagaaatatcaggcctgaacatcgacccaagtccccgacatgaatacatgattgatgattgagtatgggtcactttactgaagatacgcaatgcggtggctgtttacagttcagctccggccagcttatcaatgatggcagagcaaatttctattactttctccgttttatattataagattttctagtattacccacattaatatatatgttaataaatctagatatatatattaacatttatataaatagataatactaaatagtcttataatctgaaacggaataggtacattacatatatgccgtttcaagaagtatatgaaagcaaagcccgtaccatgccatattgccatacacctagacgaacagtccatcaccatggttaatcaaggagcacgcatcagcgaaaagcagcacacgtatgatatgggtggtgcgcattagcgtcaagtatgatgaggatggagcatcaatgaaagcatcggcatgatgtaacgccacggagacatatgcgacgtggacgtgtcgagagtagcacgaacgcagacgctgttcctgattggatatttctttttattagtgtactagaactactatcttgccaatacttgaaaactataataaactccaaataattgcgatgatgttgaaaaatatagtactaataaactccaaattataattgcgatgatgcactagtaacatcacttacacgtggggtcgtacgttctccattattggagctggaagaattctctgggcagctgcaaacgtaaccaaactctctttgggctggtggtggtgggatcagaactcacgtacaacactgctggcccaataagcaaagatgccacatgcacgggatttttccggtggatgcccaagcatattccgagcagaaactgccggcttgcggcaaccagaaactctccggatccagccaggaaaacgaaggaattttactacttcgtccgaaattatagacggacaaatcccatactggaaggagtacgacacgctaagctcgtagcgagaaatctgcgggcaatcgagccgtggaatcgtggttttgccgtgtgcgcggcgcgccgcaccgtacgcgcatgcgtacgtggtccaggaaccaggagagcggtcgcccacacgtacggcgctcacatggatcgagccgcgcgtacgggggaacagcgactagcctccctccctcccacccacggcgcggcggcacacggcccatccgcatccgcgttcgcgctacgttgtcgtacacgaatcatcgtgtggttgggacttgcttgggcgcggttgggtcacgtttcaggcttcaaacagttgagtttgagagatacggtacgagaagattttttttttcacttattcctttttcacgaacacacaaaaggtttacacgttaatatattagaagaaaaagagtttttattaaataatgcaatcaatcagactggcttatgccaatgaaagagagaaaaagaaaaacaaaaaccgaagccaggaaaagattactaccgcggttaaacgcaactcctaatagcgggaaggggcagagccacgctacactcccaacaaattcccaaaagcggcaacgccagctagaggccacatattaccctccgaaaggatggactacagcaccgagatcgaagagagcgcggagttgaaaaccctagagtttcattccttccatagctaccaagagaacaggagaaccagggagtcaaaattggcgtagagatgctcaggcaagcaggccctggaggaagaccaccagtcctggagctagctgccacgggagggggagagagcaattcagccaggagtgataacacatggagccagacttgccgagtgaacacacaatcgagaaggatgtggttcgccgtctcaagctcctgatcgcaaaaggggcaggccaagtggccatcgatgccacacttctggaggaggttgccgtccagtagcgctactgaaatgcaaaaaaaaaagaacatgtatttagcaggaccctttgcatgtcagaggagatcaacacatgcaaaaaagtgttggccatagaagaacgcctggtacaccgaacgcaccgagtagcgctggtcactcatccaacgccacacaagacgatccccgatgcccgacaagagctgtatgtgaagcaccacatcccaaataagaagaaactaggagatgacatggacagtgagggcgccgcggatgtcagaaacccaggaattgttcgccaaacaggccaaaagcaactgtgcgtgagcctcaaaggcgttggggcacgccgaagaggagatctcgaaccaaggaggccaccgagcggtcgtcgatccattgttcaaaccaaaaagagtattgactcgccatctcccggcatgaagaaggtggacgcctcgaacatgtcgaaaatggtctgctcggctggggccttcaggccatcccagtagggatgctctgaacgctgaagccagagccaacgaatacacaggggcacagggcaaaccctgccatcctaagatcatgaattcccaaaccactaaaagctttgggacgacagtcattcgtccagaacactcggcactgcccccatgagccgagtccatacccgtccacaagaaggcgcgacgcttcttatcaatggccttaataacctggactggaaggcaggatcaccatagacacatggactgaattggaggagagaaccgactggaccagcatagagcaaccaaccagagtggtgagtcgtcccttctatggtggaagtcgatggaagactttatccacaaacggttgcagggcccgtctttggcaacttgcgaacggacagcggaatgctgaggtaggtgcaaggaaaataaaaaatcgagcaaggaaagcaaggctgaaccagttccaggtccttagccgagcaacagatcggagtaaccaagcatttggcaaagttggtgcgtagcccggacgctgcactaaagacggaaaggatgctctggatgaactcaagattaaggcattgatgcggtacaagattaacatgtacttagtagtgatagactgatgagtaggtacttttttttaatgtaaatttaataactcttagtatctagatactatgagatactaaatttaatactaaattttggttcctcataatatcttcccaagaattgtaaaattactctagactgctagcctcacatagtagcaggctgcaagaaataggccacaccgaacgggacttcacggttgtactgcatctgtgactgtgacgatggcgaggcttaatttcgtggatctcgaaccttcttaatcttgttttctcgcatgacaaacaaacgaaaacaggtggagctactgaatcattagccttttgttaccaaaacagaaaaaaaaaactgaatcattagcctttttctatggtggcgagacacgtacggccggcccgtgcgacgtgccaagggctaaactgtggccgtgacgcggtgcacggtagaaaaaaaaattgcaccgtagtaggagtaacaattatcaccaaacaatattagcaagtacgctttgcgaatgcctttgttggtatgatcacgacgtcgcgacgttgataacatagagtaaggggccatgacgtatttcgatttgacataaacgacaatacaaaattgttttcaacttttttagtgaaacagacagctgattccaccctctaattgggtgtcattttccagcgggcggcggtcgatctgctagatttgatcaatcgtggattcatcagtgaattcgtggaaaaactggggtaatttgtgaggtcaaaagagagctaaacggtacagtaatatctcaggaaaccaccaggaaagatcgatgacgttgatgcttcatagatagggtaattaattagcagctgtatattgggaggactttggtcctttttggctgcatgcttggaagaagaagaagaaacaacgtgtacaatgcgcaaaaacagtgacagttaaattgttggtccattatttatttatttcctggacatatggacttggtacagttccttaactcggacaaaacacatggaaattccaagccgccgaaatacactggagagtttagttgatactagatcgaacatgatgtttttcttctcgatcggcggctactaattattttctcaaagaaatgttcgtagtacatacgaagtagactatagagtacgttttactagttagagtacttggaagagaaggtgcaagacgtgcacagtacgtgtagggaggatgaagcaacagtccaaaccgccagggcgacggtagcacgccatatacttgtttttttgagagaagaactatgtatatatgagtacttgtccatgttgccagcaacgtatcagttgtggaccacaattatcatttgataagcttgttcaattctcattacaacagctggaaccttacatgatcaaacaaagcagccagctactgtacgctcctctgtttgaccgaaatcaccatctgaagctggaaatctgcatttgccaatgccataagcttgcattcccaattcgtcgagcttgccggccggtttcatgcatctgccaattgctcatccacgcaattgccgaatgcatgtgacactctgcccggcttgagcaaatatcggggagagaattaaacactctagctactagattgggccaaaagacgtttttagtgtgaactattttctggttccgctttgcacaaccaaatcaccttgtcatggtcatccctgtttcgttttcagagactccgacccattgagagacgaacaagtacactccatacccttcatgatagtttcacaacacccattgtacagctagagaccgataaagatcactagctagtacaatgaatctagatagaagatactttctaatacaacgaatctgaacatatacagattaattatttttaagataaaagaagtgagtagaacttcggtagaaacaaggtactcgtgttcatataataatataaacgatcacgtttttactgtctttcgtaaaagaaaagaaaaggaaaacagaagaggcattgaaaaggaaagggtggatttgtgctgcatgctgttttcccgtggtgaaaatggaaccgtgcaacaggtgggaatcctccgcgtcgttggacgcatacgtacgtgatgctcccctttgcgtccgtctgctccacgagttgtatctctatcgatcctctctttctcgagttgtgcgatgcagatatcggacggatggatatatctgtgacggtacgcgactgtagatctatatatatctagattttcgctttgagatgtttgtgtcacttgtgtgacgtatacgggcttcgaaacgttttaaactcgactatacgaaaggacttcgatctttatggtgctggaaagtatttttgccagcaatgcaaagacgccttgcttaaatgtttgttttaaaattgcacttgttccaactggagcttaaatgttcgcttaagtgaaacaaacattgctgttctacatcaataacaccttccaaatggtactatttcgggcatcaatttattcctactcgatcagtgctacccaaccagtccactacaataatttatttaagtgtttttcttttcaaaagaacaatttaattagaggcgtttttttcctaaaaaaagaacaattcataatcgtttcttctctgcaccaaacacgcacgacagcacacatgattttaattttaatttgaaaatcagaacagtacacataatcataagacgtaactatacagctagtggtaccactccatctaagagagatactatccacttatactttaaatgcaattttctcttaaaatactcatccgatatacgatccgattgcaccgttgtgttcgtaacaattaattctttataacaagatcttacatgattatattttgatgaaaaattataaattacttttatcatatatctaaattacttcttagacatataaaaataaattcaataaagcctaaaagtaatttacatatattatagaagtaacttataataaaaagaaagtaactctaatgaatgccttttttcattggacgtgaagtcatatttttatccctacaacgaatttacttctaatgtcgtgacaaagttacttctgttttgtttttaagttacttttataatatatgtgcattacttttagactttattgaatttacttttatatgtctaagaagtaatttagttaaatctaaaagtaacttatatacatgataaaagtaacttatatatataataaaagtaatttataaatataaatatttttttatcataatataatcatgtaagatcttgttatgaaaatttaattgtaacaaacacaatggcgtaattggattgtagatcggataaataatttgagagaaaactttgtttgaagaggaaaaatacatgcatgtctattaaaaaaatgcatgcatgtagtacgagtacgatgtagtagactccacgtcttctccatatttaggcgtcgctggttaaggcaaaaacgggaggcctctctaaatagattttatgataatcatataatagcaacgcaatcacaccgtatacgaacaccactaaacataatccctccgtcccataatatagcaacgggtactaggttgctatattatgggagagagtaataaacattgataagtacgtgttgtgatgacgtgaactttctcggttgctaccattgccaatgtgccgtcgggcccacccggcagtgtcaccgagagagtcccgtctcctcccgcagcgaccaaccgcgagacggataaataccgccacgcgctcgcacccaaatcttctccaactcaaaacgagcccccaaatcccagagaggagtcgcgagcttttcatcaatcctctgattttcccccaggtttccccacccgcaaagagcctcaaaattccccctcctctgtcgcgaccgatcgcgacgacggcgccggacgagcagacaccggcgccacgatgccgccctccaccggctccgtcccacccgccgcatcaacgccggcggctggggacgaggccaccgccgccgggagggtactcctcggcaggtacgagctcggcggcctcctcggccgcggcgcctccgccaaggtgtacctcgcccgcgacctcctcaccggccgcgacgtcgccatcaagtccttccccaacccccgccacggcggcggcctccgcggcggcgaggaggatgtcctcctccgccccgcgcccatcgagcgggaggcggccattctccccaggctgcgccaccgccacgtgatgcgcctccgcgagattctggccacgcgcaagaaggtccacttcgtcctcgacctcgccgccggcggcgagctcttctccctgctcgacgcgtccggccgcatgacggaggacctcgcgcggcactacttccggcagctcatctccgccgtccggtactgccactcccgtggcgtgtaccaccgcgacatcaagccggagaacctcctcctcgacgacgcgggcgacctcaaggtggccgacttcggcctcggcgccgtcgccgacggggccctccaccacaccctttgcggcaccccggcctacgtggcgccggagatcctgtcgaggaaggggtacaacccagcgaaggtggacatctggtcctgcggcgtcgtcctcttcgtgctcgccgcggggtacctccccttcaacgacgccagcctcgtcaacatgtaccgcaagatctacgccggcaagttccggtgcccggcctggttctcgccggagctccggtgcctggtccgccgcatcctggaccccaacccggcgacccgcattgacacggaggagatcatcacccacccgtggttccgccaggacgcgagccacttcgcgatggcgcagctgatgcagcacggccacgacgaggaggccaaattcaagaccgagttcaaggaggacgacatggcccgggacatgacggcgttcgacatactcgcatgctcccctggctccgacctctccggcctcttcggcgccgagccggggaaggagcgggtgttcgtcggcgagccggcggcggcggtgctatcccgagtggaggaggccgggaagaaggaagggtacatggtaacgagagaagggaagaagggcaccgggccggtgtacgtgaaaggcgagaacggcggcattgtggccaaggtctgcgtgttcaagatcgccgacgcggtgtccgtcgtcgaggtggtgaaaggctacggcgccgaggccgcccggttctggaaggccaggctcgagccggcgatgaagcctccggcagccatctgagctgccgacgagagggtgagctggttcgttgccgcgtgcttgcaaattgcaatcgagatttgttcttgtgttgttcagtgtaaccgtgtgagtgatgtctcccgtcggcgaattgtttgggtttttttgggatgtatttgttcatggacggcgtcatggaggtggtatgtaagcacgatttggtgatgtctgggctggaaaataagaggcaaaaaattccctgctatgatgagcggacaagaatacaagatactgaagttcgtcgactcgtcggcgtcagatgacacaggatggacgaaaatcttgcctctcttgtggacgagagctgccgttcgacttttcctccctcgatcgattgcccgataaaacagtcgaccagttcttagtttacacagcttctcatggaacgatgccaattggttcgctgaaaattgttggaagccagagtcagctatgcaagtggcgttaaaaaaaaaacagagtcagctatacaagttgctgctggtgcgaacccgtcgcggatgggcagagagagaggctggcactgcgcttttgtggcggttctcgctatcatcgtgtcgtgcgtacctcgaacgcgtcatcggaacaccgttcagaggctactgtctactccctccatctataaaaaaaaaaaaagacaaaccgtggttttcgtgtctaacgtttgaccgtccgtcttatttaaaaaatttatgaaaaaaaattaaaaagacaagtcatgcataaaatattaattatgttttattatctaacaacaataaaaatacaaattataaaaaaattttatataagacggacagttgaagttggacacgaaaatctaggatttacctttttttcttggactgaggaagtactaggcgccacttgcaaaagggaacattatcccctacctaacgttgttctttctccaggcttcagcagccatccgttcgtttgggctcctttagaacgtataagaaattaagaaaaaaaaatggaaaaatagaaaaaaaaacacagtaattaaatgtcatgctatatgaaatctgacataaactcaaaataaagacatttgtcaaattagtcgtttggatacttcacaggaagaagaaaaggcattagagtagtcttagacttctcaaaaggaattcaaactatgaggtttgagatcatgtttaaaattgttcatagtaggagctgggggatgataagagggccggcgagtcgatgtgtgcattatcgggtagcttcgagatctgatctgatatgatatctccatggatgatgatactagcacggggtgacctggactgtagcgataggccacacctactgtttggccgtgctctaggcgctgatcaccagagtacatgttggtacagttgccatgtgacctggtcgttggattggccctgcgtgagagcagtataataggggctataaaaagatttataaaaagattgaatgctgaggtagatgaaagaagagagaaaagatgaaaaacgagctataaacctaacacagatttagacatagaaaaaaaatatataagacaaacaagtaaagagctaaccactatatttgcatgcaagagactgcatgcagccatgaacctgaccaccgcccggcccggtcccgttggccccatgccccggcgcaaccggacgccgacgcttttcctgcgctttattgcggtggtccgccgccaccctcgccgtcggcctcagctcccggaggcgttgccgtgcacgggttcgtgtgacggcgatcgcctggcggcatgacaagttcaaaatgtaatgtacatgccgatccaagttcagataactgtaaaaggacgccaatcggtttcaattcgcaagcgcgtaaaagttcagtgtccagtcggattgatggcgagaataataatgcgtggtgttctaatttcctctctgatggcgaagcctgtggccgagataacctcttcgaagaggtgtagttatccagcagggccttatttatggccaagtgataaattctacgtacatttctatgaatggatgtcagttcacgattgtactatcaattgaaatccgacgtctcactaatcctgaaatgtaacaaccaataatgttagtaaggaggatcacggtgataaaagaagtgctccaaatcattctcacatcaaaatggtacaaagcgatcaactggaatcgtcaaaacttgtggatgtcacaaaactactgatcaacgaaatggcacacttagctactgatgaatagtgagcgaatacaacgctagagtagatgccacgaattttcacaggctccttgtttcaagccaatactcctatagtctgtcatcaacacatctccacgttgttacctgggttgatgccgtcagagggagcttcatgatggtgcagagttggagctcggctgcttgggactgtagtaccacagagggcggaaggtggagggacgagacgaacggacgagccggcgtccccgacccttcatttcatgttatataatgtctgtagcatcaaatatattatcacatgagaaaaatctgatatggcaagagagttaacgaggggagaggtaaaaagatgaagaaaaaatttcttatgcaagaaaccatttctacacaagaattaagaatgaaaacaagaggataggtagataaaaaaaaaagataaaggagatgattagatgataatttaatttgaagacaccatccattggattcgtagtttctatgcatggtgtctatataacatggtaaatatgaaaaatactttatagtttctgggttggggatggcctaagagagaggggaggaagtaaggctagacccaaaaaaaaagcgctcgtcggtagctagcttactcagctcgtggctagtttcggacatgtttggcggagtttaaaattctgaaaaattgcttgctggtatccagattctgagaatatgaaaaaatgcttctagtttatttttagattctacaactataatttctcagaatctggcttaaaaaactgactgtttgggggatcttttgaatttggagaatctacagctaccaaagcttctcaaacaggcccttagttcaaactcgttttgatttgttaatgacttgagctaaggttctagttcgttaggtgtaatgaggtagctcctgacctgcttgcaagcaaaaagagccaaggcaagcaacaggttaacaaacacaacattctaacaaagaaattaaaacacatctctaaccctaggattccaatcctagtacatactatctccgtttcgaaatgtttaacgccgttgactttttagtacatgtttgaccgttcgtcttattcaaaaaatttaagtagttattaattcttttcctatcatttgattcattgttaaatatatttttatgtaggcatataattttacatatttcacaaaagtttttgaataagacgaacggtcaaacatgtgctaaaaagtcaacggtgtcaaatattttgaaacggagggagcatgttatcttcacctatgacatgtggctttctcgagtctcagactcatccttccgtccacttatcgtcttgcgttgctttgttcgatcatagaactgtatatttaaattgattatatggaagttttggttgattgtatagaagtatggaaataatgatacttttattaattcgtatattagtttgctacttagactgtatgcaaatatttgtatacttaagttgatgttgttctgaatgtgttggttcgtgagcttaacaagccagcctaagcaggcaaacaatccgatccgagttagtttttagctcgataggataacaagccaagctaacttgttatcttaaaatgagccaagtcaaagcaggctctatgtacagccctaaggacaagggatgagcggatggttgaccgattttagctacgacgcacatactaagtttggctagctagataaccagccggttatagtttcactttttgttatgtactgtaggtaaaatttggtatggctagtcatatagctggcctgttagagatactatgcatttggtctagataatctctactgcgagtaattattcagcaagctttcgatgtagatcataggacccttttgaatcgtatgaatgaaaaaaatagagaaatagaaaaaatatataggatttttataggaatacaagtgtaaatagagaattgcaaaatacaggaaaaaaaacatcaatgaccatttgattggaccacaggttgaacctcttgctaacttttcttcaaaatctatatagtattactcatttcatagggatttcaaatgataggatagatccaattctttgtttcaaaggctttcataagaatttctttcgtagaattaaaatccttcaaatttcctccgtttttcttacaatacaaagggcccgtaaaggtcagttcgcagttatcagcctgaaagctgacgcctcactaatcctgaattctgtcgaatcggataaagaacaatcccaataatgttcatggggatcacaaaggcaaaagtgctcggaatcactcgcacatcagaatacagtaataacgcgaccaactgcaatcaccaaaacttgtggctgcaaacaaaactagtgaccaatagatcgaactgcaaacttcgctaccgatgagtacttaacttaacgagtactacaacgctaggagctgatctatcgatgccacgaactttcacgggccccttgattcaagaaagcactcctataattgtagcaatcgtactacgatatattgtcgtataaccattagtccttatcaaatctctgccacctcacctctcataataggagcaaacgacgaaccatgaaaacgttgctcgcatgcctccaattattggtgctccacatgctctgaactggttaaaataacagcacatcggttcacggaagcgatgctgctgacgagcccggggattctctttaggtggtgttaggatctggcgatttaattttagtccatgtatttagatactaatttagagtattaaatatagactacttacaaaatatattacataaataaaagctaattcgtgagacaaatttttcaaacctaattaatacataattagagaatgtttactgtagcatcacataggctaattatggattaattaggcttaatagattcgtctcgtaaattagtccaagattatggatgggttttattaatagtctacgtttaatatttataattaatatccaaacatccgatgtgatagggacttaaaagttttagtcccatctaaacaaggtcttaatttggatagatgcacactaacactttactgatctggacagtacgtgtgcattattcagttatatactctacatattttgagggtttggagaacttgtggccatgtgacgaagtgtgtgacacggggagatgtaactcgtcagctaccatggctaatgagtggccaatatttttatccaaagagagaataaattgaagttccttgttttttcctcactagctttgctggtgtaggggtaggagtattaaccaaacttgtgggttgtctgtacatgacttgatgtatttgattagggttgattaggcacaacgatggtgatggacatttgggtgtgaaccgtcgactgcctgaaaatgcgctaagccggcataatcatagcgaaagaaatgctagactgttgacgtcgctattggcaatatgtagacaaggccttttagtccataaattaacccattttgcttgtggaattcaagctctaattcttttggttttttggctagtaaatggtggcacatactattctgaccgggtacgacgtgacaacagccaattagcctaacctttaaacgcttttgtgttccgacaatgcggtatgcaggctgtcaggtctcaaagtcgtatggtggttcgtgagtccccatctttgttcccagaagcaagataggtaatgctgcatattttcaaaataagagataggtaacagtacgtattttgaaaagttggcaaacaaatttgcagcagtagaaaattagcatgggaaaacgagatcaactgtcaagagtgacgaatacgaattcaaattgatactccctccggttttataattctcgatattttagacaatggtcttcaaaatatagggtctgttcactttgatattattttcaactatacctttttttttaagttgctaaaattttggttacgtttagtttgttaacaaattttagtaagtgcatatgaaatcttgccaaaatttgacaaccttgccaaaattttgacaatattaccaaaatttggtaatgccaaaatttggtaaggttgaaaatggtagcaaagtgaacaagcccatatatttaaccttaattttctattttaatatatacagtaaataaatgcatgtttacatttattatagtacgttgaaagataaatatatatatatatatatggtgttatagttaaacaaaataattataaaattattgatagtgaagttataaaaagtttgaccacaaccttatccaaaatgtaaagaatgtaaccggagggagtacaacttctagttttcactccatggtatactaaggcgaatacgagttctaaagagaagtcagggaagctggctactctatcgctctccattagcatatttctcaaactcctaaacgttatatcaataaactctctcagttgtatgtagactgtttttttacatatgacagattgtatgtaagatgactaga

SEQ ID NO: 14671 - DNA, 2564 bp, Oryza sativa
caggactaaagataattggagcctgaccctacccaccaatttctttaaaccggcactaaaaataatctttagtcccgattgtatgagtgggtatcgtagtacttagattaggatcaccggcgactggctcgccatcccactgcccatgagttcggcatgcggatcgagctctgtattaatttagtgatgggtcttcgacgatgcatagtagatattttgcctcacctccggccacaaagggagtagatcttttctagtagtccattgaatagttgtgctatactaataaaaaaaagagagacatttaactatttgtcattcttaagatgtgatgataacagatttaccactcgatgtctaacatatgggccgcatgtgtctatgacatgtggacccagtgacaaatctgttatcactacttataaaagtggtaaatagttaattattccttaaaaaaaaagaaggcaaggaaagagtagcggaacgcggaagagaataaatgggctgaagagaacacaaccagcctgcaggtttcgatgcaaagaaagacgtaggtgattcagcccgctttacgggcctatccaccaggatttggttgggcggcctagcgtgactacagcccatgcaagggaagcacgattgccaccgccgatctccatcgcaagttacggcctgtgcaacactgagttggcgctaggattaaggccgagcgagatcggatatcacatgaaatggaccgtactttctccactaaggagaaggagagaactctatgcgggccggcgtagcaaaatgcgtggcttgcccacaacttttctggggagtaagtccactttgactaccttaattaattagtggtcgaatctgattcgtatctctaaatcagaataccggatatctcgaccccaactattaaaaccaatgtaatttaactcacatcagcgaaattgcattggttttaaatagttagggttcatgtatactaatcaaattatgtcactaaataagggagtcaaagtgaacttattcctatttactagagaaatctatggttgatctgaagagggcccagaaaaccgatgggccaacttttaggcccagtagagctgggaggaactcgtctactgcacgagaaggattttcccccttctattcccctttatctttgctggcctagacttttttctatcgtattgggctttttgaggggcttttagggcttttcatctagatcaggacaaattcaataggtgggaatgggataccaacctgggctcctaatcggcgactggtcgtgcgggggcgtgggcgtgggcgcgcgaccagcaccactcccacctacaatcctagtactacttgtcccgtagtacactagtactactcctaattgctgatgctgcctcctatactactactactcctaactactccgtactgctgatgcctcctacactattactgcctacgaggagtcggggcgtggctcgcccgcgcggcgcgcctagtagtactacagtagcactactattagtagtacctaataaaaaatatattttttatatgtatatatttttttatgtgtaaaaaatatatacaaactttatatacgatatatacaaattttgtatacaacgtgtacaaactttatatacggtatgtacaaactttgtatacgcacgtattaaaaaatcgaaaaaacccaaaaaacatcatgtatacaaactttgtatacatattaaacccgaaaaaccaaaagaaccaaagaaaaaccgaaaagaaaaaaaaacagaagaaccagcggaaaaccaaagaacaacaaaaaaaccggacacacgtaagtcctccagccgcctagcccgccgcgccccccgcgcgcgtggccgcgccgcgcgggggagtaggggcgcgactagtcgccgattaggcgtttcggataacaaccgcttggatctcagcacacacatgtgtattctatatttttttaagttgatttaaatttaatatttttaaagtttatacggataaagtttatacacctaaaatttatatagtatgttataaactcaacccgaatttggattaaattcagataaaaaatgttccaatgtatttatttacatgtataatgtttacgcacacagatatttttatattttttttctttcaaaccttttttttttgaatttgttatcaaaaccaatcaaaatgcatacatgcgtaggaagaagagaagaaaaccgcagtgtcctggtgggtgaggccaagttgactgtgtgcggtgacgcggtcactcatgcataagagcatctccgagagaatggctaagtgactctccaagccaaattttagccatagcagagaaaaaatagcctccaacagcatctccatcccactggctaagctatatggttagcccaatacttccccccactggcttaatctagccagccacaaccacattccttaggcttgccaaatgctttccccggtacctctttgatgcaaggcgaggagtaacaacgttgccttccgtcgcaaaaacgcggtccctttgagtagccttt

SEQ ID NO: 14672 - DNA, 8183 bp, Oryza sativa
ccgcctccgcttgtcgcaaccgcggcctctgccggtcgccccgccgcgggcccgccaccgcccgccccgttgctcattgaagcccgtcccgcacgcccatcgccgcagcatcagaggcaagtccatgaggaggaggaaggtttatgtatgagtggggaaaatggggtggaagaggaggaagaaggttatagagactgacatatgggtcctatttgttataaacttgtaatggagagggtagatagagaggctgttgaagcgagcaacgactttgacttgctaaatcaaatgggtagctggctatatgtatatttgaagagtctattttagagaggctgttggaaatgctctaaggcggacccagcctccgggccacggccatttggtggacggctgcatgggactgggagtcgcggctatactctccgctagggataaaaacagtcacggaaattatcgactaatagtgctacccaaacaaatcatacgtatgactcaaatcatgagacaagtcaccttgttccgattacatctatgtggactcatgtctttcatagcttagttatagtcgtacagtaggtcattatgctcgtattagttatataattaatttctattttttttagcgtgatgtttcatcgaataagttaaactagtaaatattagtctattagtagccgatggagaatagttttttaaaaaagattctaccgttttcatcccacttaccgcgtgcgtaactcgtgttcgacgtgccgcatgctaaaccatatgccaaaattttcttgctcaaatttgtttcaaagaattttctagctcaaactgatcgaagcaatttgttggccgactgcacgagcgaactcaaactgctctgctcttgggccgactcactccatccagcgtcctcatcaatgtctgcatctgtccgccgactaaggtctctctctctctcgtccgtttcctgacagcaacataaccgtacaattattgcgaggaatcagacggcgggggacgcaacgacgcaaggcagtttcgggaagaaaaaacccccgcagcccaccgaatgcaacgtaggagttcgctccagtacaaacctgtatggtttctgcatctctggaggcattccattggaaggccagccaagcttcagtgtttccatggaccacggctcatcgttccggtgtgatgtgccatcgacccttctgttgctgacagatagtctgacttcagttgcctggtaaatttaacagtaattgcaactgcctaaaagaagaggttaacagtaattacaggttcgcagggaacaccggtggttactgacagtgaaatgtacgttcctcggatgtatatttaactgacaattcatcaacggcggcgagcttgattatcgggactgacaatgttgatcaatgatcacagtatcagaatcgaacatgctggaaacgtgatattcgcatccaaatcgcgatacttctcatctatgaacgattgatgaaatgagagcagcatcgtaatctccacagtgagcattcatttgctgtccgaggtgctcgaggacaaagcattggcaagttgtgttcatcatgctttaacagttagccatgcattgtggttcagcggagagacttctcaaattattgttgtggggttaggttaggagcaggaatcctctgctcataagaaaagatcaacaaaacaaccaaatcatatggggccggtgagaagtgatgtatgaagaaaatcacaaacaaatgaagagaagatataacatacttaaatttttctcaccaacatgcaagattccggggagccctggtatagaatatacgagcaagcttaattttataataacagatgttgctatcaacttcaactacaatactttgccctttattcaagcagtaatacaaatatcacagatcaaataaaacttttactgctatgcgcttcttttcatttagatcataactagcctagacacccgcacacctgagaagaaaaactaatatcactacatgcctattttttattttcctccaaggaaaattgattccaccaattacctaaaactaaatgtaaatcataggtccttgcttgagtgactttggaggaaaaaaacaaacctagtacgttgcagatcatagcaactccaaacgaacaacttgattacttgttccgattctcctcctcttctacttaccttttccccctctcctcctcttctatttaccttttttccccatccagacgaacaacttgactacttgttcagattctcctcctcttctatttaccttttccctctaaacttgtccgggttcatcacatctactgattatatttgaatagttcatcaaggtaaacgaagtttagaactacagaaatgcatgaatctgggcctcatgtgtccgggttcatcacatctactgattatatttgaatagttcatcaaggtaaacgaagtttagaactacagaaatgcatgaatctgggcctcatgtgtccgggttcatcacatctactgattatatttgaatagttcatcaaggtaaacgaagttttgaactacagaaatgcatgaatctgggcctcatgtgtcttgttctgtagcagctgcatcctctagtatgcgtctagtactctagttcagcatcatgttaaattgtatatttgtgtagctgtatgcatagttctgcatcctctagtatgcgtctagtactctagttcagtatcctgttaattgtatatttgtgtagctgttgtatgcatagttcagcatcctggtaattgtatatttgtgtagctgtatgcatgtaccaatacataaaagtctaccacttaagcccgtttgatatatgcaaaacctgtgattttttacttcaacttgaaaaagtagagagtgaaaggagaattttgcagaggacaaaactctcaattacatctgggccacagcctatgtttgctagtgcactctctcactaaagcgtgttatgaaataaaaagcattagcttttagaaaatgagtgatgctacccacctagcaagctttctaatgatatcttctcggctacagatcaaaggtgcgatgtatttaatcatagtgcagatcaaaggaggttagctcgagatattacttggaattcaattttcagcacaaagaagtggactgagacctacaaaactgaaccctgtctgcttgcaacttagtcagctgaacaaattttgatcgattttttttttataatatgcatctttttgcgtcatgataaatgaaaaatgtcagtattacagttctccatgagcaaaaacagtaacatccagaaacaaactcaacatttttttcaaataaatcctcatttgaagatagcatcgatattaatattaacaatacatgaggaatgaaaatgaataacaagaggaacaaaagctgcagaaatacataaacgattggaagtcgactcaaattgcaaaaaacttgcccttgtcaaagttttttagcacgttggctgctgctgctgcttcggttgctcaccctgccaagcccagactatgtccttcaaagctggtctcatctcttggttcaagaccttacggtattcaagtgtatcaccatttgtcttctttagctccacaagatgaaagtttggggtaacctcgaatatctctgcatcaatgcccataacacctttccttccaggcttggagccttccatcttcaacagtccaccatctttctttgtgagcttcaaccgcaagcccttggcaatatcctcaatcttagatatgattgttgaagctgtactggtggatgtgaatttggactctttcttatcagactcctcaaacataccagagaggtcaagtccagttgacaaagaaattatatcaaaagcattcaagttggacggcttcttctccaatgttggagcgctattgaaggagtcaaaatctgtgctcatatcaacaggaattgcatcctttggttgtagattatatctgagcagctttgcatcgagacccttcctaaaccaaggattttccatgattttgtccattgagatccttgtacttgggttaggatcaagtatcctgagcaagagccttcgaacatcggtattaaaccaacttggacatttgaattctgctttcccaatcttcttatacatatccatcaagttcttatcatggaaaggtagatagccggccaatagcacaaagagtatcactccacaagaccatatgtcagccttagcaccgtcatagcctcttctgttgatcacttctggagcaacataagcaggtgtgccacaggttgtgtggagcagcccatcctgtcttttgcaatcagcaagagcacttaggccaaaatctgaaaccttcagattgctgttctcatcaagaagaagattttctggcttcaaatcacggtgataaacacccctgctgtggcaaaagtcaacagcgcaaatcagttgttggaagtacttccttgctgcatcttcctttagtcttcctctctgaactttgttgaacaactctccacctttgacgtgctccagcacaaaatatatcttagtcttggtagccatgacctcatataactgcacaatgtttggatgcctcaccaacttcatcacagaaatctcacgtttgatctgatccatgagcccgcctttcaaaaccttctctttatcaatcatcttgatagcaacactctcagaagtctcggtgttacgggcatggtaaaccttggcaaaggttccttgcccgagtaatttccccatctcatactttttcatcaacatatttcctctctgctccgccatcacgccaaagaaagcagtaatcccaaagctcaaagtgtggtaaccaggagcctagaaatgataggtgacttcaaccgtctccaccaagatggtgatctaagaagatggttgagttgccacgtcgaaccccatagtgcgagagcacatggagcaagcgctgtatatactcttgtgttccaatgtcatgaagagttgtggaaggagaaatatggcttgctaccctgccaattccctcacaaggtagctctctagcatgcaagcacatctttctgcattccctaaggtgtttccttcttattggaagtctagtaattctgccaaaagaagaagatgcaataaggtcagtcatggacaactactagttggaatcaactaacataaaactcaattgagaagttctaggtaaaaggattaatctactgcacagcacatatgcatgaaaacaagacatgccagttaagactgtttctacgcttttcaaccagaacttgttttaaaagaaagtaacaggaaacacaatacagttacacagttttctgtactacataaagctaccctgaattaaaaggttggatccgaaagcttcgctcaacaaccaggctagcagataacaagaggctaattataattcccacgctatgcatctccagtagaaaggagattatttttttctttttttacccttccaagtatgtatgacagattaagttttcgcatgaatcgcatcaaccacaacacctcgcgttgcagaacaaatacagatctagaaacgagcactcaaccagtgtactggagactcgacctgagaatctgaaacccacccctcgctaacccaagatgatgtttttcacatacagacgaatcaacaaaccatagatccatatagattatcaacaaccagagataaggagaaccgtaccagatcccgacgtctgacgacgcgaagaacacccaacgccgccgccgccgccggtagaccgaaattctcacgacaggagactcaccctcgccgcagtcgcgagaaggagtgagaagaaggaagagcggtggtagtggaattggcttcgccttggtgcgtgcggagatcgagatcgagatcgagatctgttcgagcacggcgcagcaattcgttcaggcgtcaaagacggctcctttttatagccaagcccaagtgccgtaggatattcgcttccgtttcttctttttttcttttttttttcactgcgaagcgaaacctcctggagcgcccgcctgccgttggtgcggcgggtaaaaaaggccggtttactgtccctgattagtggggcccaccaataattggtgggctgccttggctggctttgcctacgtcgcgtaggggcaatttgtttgctgttttcttctgtttgttccagcttccagggccgtccgttttgctactagtggaatgatgatgataggcggcataggccgacatggagatctgtgtgccaccaaaccaaaactaccttctccaatctcccttgctctgatttctctccatggttccaggtatatttgcccaacagatttaactggagcaaaattataagtccacttagtgattctgagcttacacaccattacagaggatgattatgtatgttactctctttgtttcgagatacttgtcactattgaatatcactatttcaatttttggtcgcttaataatttaaatggtttagactacgatgaacgaaagattactacttatatttcaggcgtaatacaccttcattttgataatatggtaagtatagattttctcttaaaaacggcggacgatcaaagttgaaatgtaaatagtgcctgctaataaatatttacgaacagagacgaaaatcaattacagtgtacatgtcaaactgaaaactttggaattgtacacagtatagtagtactctctccgtttcgaaatgtttgacaccgttgattttttagcacatgtttaaccgttcgtcttattcaaaaacttttgtgaaatatgtaaaattatatgtcttcataaaaatatatttaacaatgaatcaaatgatagaaaaagaattaataattacttaaattttttaaataagacgaatgatcaaatatatgctaaaaagtcaactgcgataaatattttaaaacagaggaagtattatataagaacagttatacagatacaacattgatattatcgcttagcttagctccttcttggctcacgtcaggatcaaccgcaaaataagcgtaaggagagaaatgtgatttggtctaccggttagtcttaggcatgtgctggttagctagatctttgccgatgccagtgaagtgtgtggaaaccaagaggaagtaaccaaaacacggcaggtttcgcccgctgtaaacactccacgtagtcaagtagaagctagcacgtcatggtcggcgacaattaaacagtagaaaatgtagtaaacgttttggtttaattttctctactaatactttgttttcttctactccctccgttttaaaatatttgacaccgttgactttttaagtatgtatttgaccattcgtcttattcaaaaaatttaagtaattatttattatttttatatatttgatttattgttaaatatattttaatgtacacatatagttttacatatttcacaaactttttaataaaacgaacggttaaacatgtgttaaaaagttaacggtgtcaaacattttaaaatggagggagtatatacgagtccagaaagtaaaatctgctactactagctagttgatcagtttgtccatctctttgtcagctgagaaactagtaactaatactggcaatttttgacaaaactgcacagtgacaatgctataaaacgtatacatatatagcacgtgcatacaacattttgtatggcaacttttatagtatcctcacccacaataataatacactttattttagtatcaataatagtaccattcttaattagccatatattataacaatattatctaatatatatgaacattgataaaatatcaaatcgcaccacctggccggccgggccagctagattaattaattaggttgcttctgatagccagtttttgatcaatttcctcttaggatgaagaaatccaattaaccagacatgtcaggtcactggtcgagaaacatctttggtcggtccaccaaattccacaatagtctcggttctattaaaaaccggttagtaacaccaaccggttaaaaaaatttgatctttagtcccggttagtaacaccaaccggttaccaaccatctttagtcccggttcaaaaagtcaccgggtcgaattcaggccctaattatctttagtcccg

SEQ ID NO: 14673 - DNA, 6545 bp, Oryza sativa
ctgtgatgtatttctttaagaatttgagttgtagttttttgagaatttgtgatgtgaatgattcattgatttgaggatgatactttgattttgggatatttgggatatttggggagatttgggaaggagcaactatttggaaagaaacaatgaaaataaaaaaaagaaaaaaatggtgaccaaccgggactgtgctgctatctttagtcccggttattatttcaaccgggactaaagatagtgatctttagtcccggattcatagtcccggttgaaaatccgggactacaaaggggttgccaaccgggactacacggagcttgctgcaacttatggtaaataaaccacggttaatcagcaaatagttaaaaatgtgcctgtgtcaaccaagaatagttagtagttgagttgttcgcggtgatgttgcctaacatgaggtgcttcaatcttcattagcacactcgtttcttgtacaacgtcctattcattctgttccgtcacgctagggttcaatgacaacagttgatgatcgattaggcagcctttaattgctgtgatcaatggagatgcacgtgtcctaaaaacgaacatagatagagatgcccatgtgtgctgtgacgtcgcataaaagtacgcatggacgctagccgttaacataccctcacgtcccaagaacaaatgattctaagataaaatagaacatttcatagtaaaataaatctgaacataccaaaacaaattcgttgtaatagaaaatgttatattctatattaggttagtttattttaggacgaaatgagtatactgattgaatgcctttgatacttaacagatagcggttgtgtcaactaaagataacaattttagtgaaaagagatggaaaggtagcattaaccattgttttttattctaatgagacaacacaacatatatttttcgattgccaaattgccagaggtatttggaaggccgtatgcatagcttttggctcgaaccgcctactattgccgctaacttttttggtaattggctaaatatcaattctttgtgagaattgcggcattgtgttgagctatttagacctctagaaataattggtgttcaatggcttcaagattaagttatttttgcaggttatcttcaaaaggacctattgggcgaggcaatggtcttaatcgaagatgatagcaaccagtgaaagagggttgcaaacttttgaagttaagagtaagtttagtggtatttgtatcatgttgggctaatggttgtttggaccttgtgtaaggtgtttggagactatgcgctcgtgtattggccatgtacatcctgttaaatttagaggctgggtttatcgcgttttataagaaaaaacagatggaatgactactatttcacatcacgtaaagctccaggtgagatacatcggtgcttgcaacttactagccatgaaagacaggtgtaaaatttaaatactagttagtgtatttttagtattttagtccacttctattgcacatatgaatctctatattaagttacattgtactgacttgttcacccgaagcaaataagaataattatctcttttttttcatgtgtgtataaagatgtcagatttgttaaggagaatatcacaaagctactaagaaataagcaaatatttttttttttgcatatgtgtatccagaagtcagatttgttaaggagaaaaatataaaaactactaaagaaaataaggacctcatgagatcaagatagcctaaaaaagggaggaagttcacagggcttgagggcaagttttatagtggaggtggatgtcacatctaatttagatcatgtcatcttctcattacttaagaggcaacacataaaacatatcacatctaatacacaaaccccaatattaatctactctcacatcatcttgtacttttcttggatattgtgtagaggttgccccttgcatgaggagtggctcattctctctctcctaactcctctcctccacctcatcatctaatcttatatggtaaatttagaagcaatgtgtagagactcgtagtacttgccctcaggggttgccttctagacctttttaccttgtctgaaaaaagggcctctagggagtcagctatgaaggaaagcatgcgatgttcatagccaaattaatgctaggatgttgattttcatatgctttctccgaaaaagaaaaaaagggacagcaataggtggtactaaggttgttttcaccttggaatgaatggacatggtgatgaccagattcgattctcttttccggagatacacatacaccactagtagaagagactgtcatagcaccttgccttcctagaaattgataccagagagggaccatcttatatgtcgtgatcagtaaggatccatcaccaaacagttgggatttctcccaaagatgaatgagacgtccatcaaagtatatactacccagtactacttactactcagtagtttgttcattaaggtaataaggccttatttagttccaaacttccaacttttccatcacatccaaattttcctacatatataaacttctaatttttccatcacattgttccaatttcaaccaaacttccaatactaagacgttaagacgttaagttgtctgaactctgaattccactgaagataaagtacaggaactatagcagtggagtaaccaaaccttctgcagcttacccttcagaaataaaaatggtttctgcagccgttcttcagcccaagattctaaaatggagaaaaatcagtatgtggttatgtgcagtgtaaacaattagacaaaataaacaatagtaatggtggggcagtaggggcatgggccatttgttggtatgtggcaagtctccctcaagctctgctagctcccgtgatgatccagaagccgctgcttgtcccctgcaggatgatgtcgccgtctctgaaggtgcaagtaattccagtttggctgcttgtttacggtggacgaacggccaaaacatggccattctgaaatcattttctgggctgcgtcgctctgaacatttcaatctcttggaccatccgcacattgctgttgactaactgcattctccgaatcaaaattttgatgtctgtttgctgctgcaatcatggcttttcgaaccttagaggcatctgaatccgaataatcggttcctggaaatgcatgatgctttctgctttctcccgggctgtaggttgatccatttgtcctgtgattaatcagggccaaagcgaatggtacactgattgcacaattagtaggtccaacctacatcgaaacagtgattgtaagtagatgaaagctctgtccatcgcatgtttgcttgtcgccagaattattaatgagtataaagtacgtgtcgagcaattaggtcgcacttaactacacgctttaattaattatttgcactgttttatagacttcgacaagacagagaaaacagggtcctaaaatctttaccctacatgttgcaggctcgacaaatactgattcgtacctttcaaagcttctgaaactgatacgccatatgcccatatatattcctggtctggccccacataccatgctgtgcaagtgcacgtctacgagccacatgcacccacgtggcaaggttgggcccacctctcagtccttggttgagctgattctgataccgtgggcccttttcctactgcagctcgacacctgtacccttcttgagtggcaagttgagactgaccctgagcagttcaccatcacacctcatgtcatcaggcagaaaacaaatagttaggcgagctaagcatctcaacaagttagcttaagcagttttgacaaaatcagagggaaattcggattgataacatgatcagagtcactgatgttgtagtatctcttgatctgcaactcatttatttccccagatagtgtgtgttctccatttgttcagacaaaacaatggacagaaaaccagcacaacctggacaggtgacctctagtgcctggatccagtgttcctgagctaaggtccagtttttcagtttttctcagaaacttctgcatattggtgatgcttgggcaaacttattccctgccataggattatgaaattgacaaattgtagagaacaagtcattttcagcaacttagactaatcgactgacctaacaagacattggcgacaataggaatcaaattggggcctaatcatgttcgcgaacattagactttcttattcaaatgtttcctgtctgaatcaatcggcaaattacaattgcacaacgaaatatcttccctatttcatattccaggcactggtagtattacgtcattcagcctaaataagacaggcactaagctttcaccatggtataaattagttctcagaaatgatgtcacagttcagaaaataaacacagttgagttgttattgacttctaaaaacaagcgatgtacagataatcatgccagaaaactaaattattctgttatttaaagttgtacattatcgttgtattaagaacatttcgatagatacaacgtgatgtcatatatgaaaatgtagcatatatacttaagttctctcaaatgatgtcatagttcagaaactaaacacagttgagttgttattgacttccaaaaacaaacaatgtacatataatcatgccaggaaactatattattctactccctccgttccaaaataagtgcacttctcttcaaatttgaactagaggagtacacttattttgggatggaggaaatattatttaacgttgtacatcatcattgtactaagaacatttctatagatacaacacgatgtcatatatgaaaatgtagcatatatacttaagtgatagtatagtttataagtcaaggtaaataagaatgtgaaatttgacttggaaacaagaacaacaatacaaattataaggattaattgtaccttaacttgttcatatccagaaccaccagacaaattaaaccagtcccttcgtggtgctttcacctgaagcaagcaactaggcctagaataaacaaacataaaggatccataaatatatctgaagttatgagaagctcgggaattgataccatcatgattgatcaaaaaacaagagggaaaataaattagtcttgtaccaaaacaaccattttatactcgctcgttagatagagaatatgatggagcattacacaactctccatattgcgctactaactccataattgttgtttttcaatgctccctttgtcgcaagagctcttgtgctctcaagcagctagtaactggagcaggcttctactagtctattcggctattccatcaccgcatgttcagttcagctgcataatgcaatgcaaagacaacgagaagttgtcttgtacttcgactcagcaccaatctgccatttgatgggaaattctttcatcctaacaacttctaatcatgcactgttcaagggtgcctaacttaattgtcatagttgtattaaagtacatacaggattcttcagaacatcgagcacttggaaagccctgggactcttcttttaaacaatgtaagagtaaaaacaagtcagaaagaagtaaaacatatgttgtggacaaaattcttaaggttccatgtttcgcaatttgttgcatctgtaaccctttgtttggagtgaactacaaaataaatgatacatatactaaagttagagaggtgtgcacttgtacaatcaaaatactcacctcctatcgtgccaaaatttctaatctcaatgcaatcaaacaagcagctgtactgctattcttgttctgaacaaaagttgttctcactcaaaaattactgtcaggttaactccagcaagggattcaatcagaatatcgctgatcttaaaattagaacataatgctacggcacatgagcagttacggaaacaaggaacgattctcatcgaaggaccaaggggatagagattagtaaccttatcgaggcggaattcaaagcagaacgaaccccggaagcctcgcctgcatcgtttctactagggcatatatgctctggcgctcatagaacacagaattcagatccagatggagaggacggctcgattagatgaaaatcgcaacgtatttttttctcattttcgctactccctctaccccgccagcgatctagactggaatttctcacgaggatgcgccaatatccgcgcccctcctcgaattttctcagatttttttggtggcgtttgatcgagaaagaaatcggacgagacgatgcgtgaagtcccaccagtcggcctgcctcgtaggacgaatagctttgctggaccggagcttgtacccggcccgctattaagacctggaccctttttctttcggaataagtccacttacataccttattttccgtcgagtttaattcgcgtccctaaaacgtataataccagaaatcttgccatctactaacttgcaaaaccagattaaattagatccggacgaggtcgctggcgtgtgagcttggcctggg

SEQ ID NO: 14674 - DNA, 9669 bp, Oryza sativa
attcctttcatctttctgaaactcctgggacataaatcgatggaccaaacaaaatgggacgcatgtacacacaaaatggccgtcacgtaatcaaaatcccgtttagactaactggtatgggcctcttgtacgtcgaaatcccatttcggcctaatattcataggtcccagtctcgttattgggccgcacgcacgacaaaagatggaataagttcaccggaggtccctcaacttaacaacgagattatttaaagtcccttaaccacaaaatcaaaaatgtgtacccctaagcttacataaaccgtgcactaaaggtcctatggcagtatatctgggtggtttcacgtggcatcctagtcagaaaaaaagaatttaaaaaagtatatggggtccacatgtcagctgcacatatctctctcttctcttttcttctccctcccttctcttttctctcttctctcttctcttctttggtcagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtggagaggggaggcggccggcggaagatgggggaggggagaggcgtcgccttcctccagacgggccgacgctgtccgtcgtcgtgcacgacgccgcagccgcgtcgaaactccacctccacaattttactcggataccatgataagagcagaagtaaatttcacatggacattcggcacagctctggatacagacacctcaattaacaaaccaaaatgtacacatttagattccgataccaattaaccgatcaaagagcaaacatatgaactaaaaaacatcgattaaccaatcaaagactgaaaattcagattttctgacaccaattaaccaatcaacgagtttaccttgcggcatgggagctcatcgccgtcgcccctgcccagaccgcgctccatgcgcacaacttcctcgccacgccgccgctccgcggtccaggagcgcctcaccgaggagggaaagagcaaggtaaactcgtcgcttatttccctcaggcaaggcggcaaccaaaccactgttctacctccaagccgtcgtccgtcatcccctatactgctgctccatctcgtcggcgtgcggccagattgccagaagcagcagcttcccggcggtggttcgcgggggcgggcgcctagcctaaaggtcaccggagccgccgctaaccgttgccgacggccgctccgcgtcgagccgtcgactccctcttgagtttgctcgtcgtgccaatgacgacggcgacgttcgctgcgaggcgtgcaggtctagggagtcggcggagcagatgcagacgtccccagccgaggccgccgacgccgcctccttaccgcccctagttggcgtcgcctcctcgccggcccaagccgtcggccgtcgtcggctcgtcgttggcgtggtccccagccgacgcccccacgccacctcctcgccgccccggctgcaacgaccgccgccaccatcaccttgtcgagggaggagccgaggagagaccaagagcaggggagagaggggaggagggagagagagagagagcaggggaagagataccgtgaagaatgaggatgacaggtggggcatgctttcgtttttaccacatcagcacgagtggaccgggtcaaattgccacgtcagcaaaaccacttatctatactgctataggagctagattgaacggttttatactccctccgttttaaaatgtttgacaccgttgactttttagcacatgtttgatcgttcgtcttattaaaaaaaatttatgaaatatgtaaaattatatgtgtacatgaaagtatatttaacaatgattcaaattatatgaaaagaataaataattacttaaattttttgaataagatgaatggtcaaacacatactaaaaagtcaacggtattaaatattttaaaacggagggagtatattttaggggtgaagatttctggtattgaggataagggatgtcacacaaactcggtgtaaagttgagggacggttattccacaaaagatccccgttcaagcccatgggtcagccgagtcgaacaggctgcatcaagtggacgttcatgggccggacattaaatgggccgatttctattcgcagcccacgttgcccgttccgagtgtttgaccggcgtctcgccgtcgccggtttcatcacggaccaaaaaagcagctgaaaaatcggagaaaattcgcccaattttcttccaatctgcttcttaattcttatacaagcagagagatttgattttgaattttttttacagggtattgatcgatgagatctcgtggtgacgtcataggacgtagaccatgccgacctcgagcagcgacgccggcggcacgcgcagcaccacgtccgggccgcggcagtttcgccggaggaagttgtacccgacgccgacggcgagcttcttcagcagcgacgagcccggcttggtctgcacgtgcgagtgccccaggatgaacgccgtgccggccttcctcgcctcgcacagcttctgcagcttcttcaccacgccctttttcaccttcgggctcgccggcttcaccacgaacctcacctttttcgtcaccggcgccgccgccgccggcggcgggaccttcactatcccgttcgggctgcgcgcggcgtccaccgaggacacgccgtcgtgggaggcctcgtagctgaggcatcgccggagagggttcgtcccgatcaccgtgagcgcgttctcgcgctcgtagcggccgtcgtcgagctgctcgctcccgctgccggcgtcgctgcagcggtggtacagcgcgtccagcttgatgaaggtggcgaggctctcgacgagctccgcctcgaacgagtccacgttctggtgcacgtcgcggtagccgtaccgcacgatgcaccggtacgaccggtgccccgccgggccgacgcgggcgacgaggtagcgctcggcgggaagcacgtgcggtaccgggacggacttgacgcagacgaacaccagcacgcggtggaacgccgggaggttggtgacgaagcgggagaagttggccggcacgccggaggtgaggtcggtgtagacgaggccgatgcccgggacgcgcaccatgcccagcttgtcgcccagggcgagcagccactccagggtcaccttgttgtgcaggtcgaactcgtacttcttgatggtggtgtggtgccagatgaacatgacggccatgaggatgagcgccagcatgatcggcagccacgccccctcccggaacttgatcagcgacgccgagaagtagagcacctcgatggagccgaagaagaggaagaagacgagtgccagcgccggactccggtgccaacacagcatgatcaccaaggatgtcaggcatgtcgtcaccagcatcaccgtgatcactgccaatcctgcacaacaactcacattctaagcaacgcaatgaaattctaatgcatatctgttgcagaagttcagagcatttgtttgatcggattatgaacattgttttaatcatgaaatatatacttgaagtgatcagaaagagctgaaattacagtgaagtatagctgacaggatggtaatggatactcaccggatgcatttcccatatgcttggtatcgcgaaaaccgacagtcacagcaatgcagaggaccatgagcagccagttgatctcagggatgtaaatctggccatggatattctcagatgtgtgcaccactttcactcttgggaagcaactgagtgactggctctggttgatgatggagaatgttccactgatgattgcttggcttccgacgaccgatgccaaaattgccagcacaagcacaggccaccttacactctctgcattttgcataagccaaaagaaatgctgtaacttcagtgtgtctagataggtgcagttcttcagaaccatcaactgctacacatgttcagttcagaagaatagtgatgatgtttcagtacctggaaccgatatatagtaaccaatttggtaggttgagttcagagtgtgatgtttcgataaatacgcagcttggcccatgtatcccaaaatcagtgcagggtatactaatgtagtgaaagcaagctgcaaaaatcaaggttcagagttgtgatttacagaaacaatgaaggaatgaaaccatggaacacatggactgaaaattcaggacaagcgaattacctggattgcactgtaggagaaatggccaagatcagcaaacattgcttcagatcctgcaatgccaaacatttcagagttgctaacttcatccaataatccatttccttacaattttagaacttacaaagggaaaggatgaactttatctcagcatacgcatacttcactttacctgtcatgcagagcaaaattccccccagggacatccacccagacttcttagtcttcctcaagaatttgagcatgtaatagggattaagagcgcgataaacttgagggttccagtggatgatattgtacaagccaagcatgctcatgcaaatcaaccaggctaggactattggtgcaaagagaaatccgacacgatgggtaccgtaatgctggagtgcaaacaggaacactaatatgacacatgttatcggaatgacggcatctgcacagaaaaacgcataaatgagcatggcaaggaagctaaaaaatgtgaaggttacaggtgatgtagaattaatgtattagtacttttgcatttaaagcttccaccttactctctctcagattcagtttatgaaaaaaattcctaatccaatcatgatcattatcagcagtttgtatagtttggggctgttcttacagtttttcattatatcaaccaacaaagatctacccaaagctgaacagtcttgctaggctgtttatatcattaggaagtactacatgaactagctacagctagagtactactcataaaggtgttctgaaacaattgcacttcagaattcagagttgagactttacattcatgctgatccctggacaaggagagttcaagccctgaaaccgctgagaatactgcaaacagacaaatcaaatagcagagagccaaatgtaagcaactcttttctccaaacaaggtacgcaattttcgaagaacagtaaccaaagggggaaaaaaaagctcagtctgaagattaccagatatcgcgggcgtgaggacgccatccccgatgaccatacaggttccaatcatcaccatgatcagcagagcagtctgcagagtcttgtgcttctcaagccactccttgattcgagacctgttagccacttcaggcgggtactccagcttgtacgtggagagctcctcgtcggcgacctgcctgtttgggaggaggctcacattggcgtgcctgcagatcagagagtagagcgcaaacgtccctcctgccaaatccaaatcgcaacaacaacacataagctcaccaagaatcttctgcagactgcagagaggcagagttcagaatcttgcaggcagaaacaaaacagcagcagcttgagagaggttaccttcgccgttgtcgtcggcgcggaggacgatggagacgtacttgatgagggggatgagggtgagggtccagaagacgaaggagaggacgccgaagatctcctcgttggactccgagtgggtgatgtcctccgcgaaggtgctcttgtacacgtacaggggcgagatgctcaggtcgccgtacaccaccccgaggctctggtacgccagcagcagcgtcgtccgccatggctctctctgcagcaacagcaaaggtcactctgcctcagtcacttctgcattggttcgagcttagctgccggattgatatcacctaccacggcttaagctggaaaaagctctctcacctttcgaggcgccatgcctctcccgaactcaggatccattgctcagcaagaaactgatcctcctgctccaagaaaagatgaattagatacaacacactgtcataacttgtatagattctgcaggccaagaacaagattgaacacagatagaggacgcacctgggaacaagcaagagctgacaatgtgaattgcagtagtactaggtaatcaatcgagagaatcagctctaagaaggggaaagggcgaggagagctgggaaaagcaaggatgcaaatatatccaaggtgaaaagttgcagatggagcccctcaagatcactaattggaatgaatgcgaggtgatggaatggaaggaagcgatatagacacgtgtggtggagcagtatcacacttacaatacaaatcctattaatcaactactagtgctcactcctctacctaagcttcaaagagataatcacactaaacttacaaagttgggataacaccaagttgcatcatataaaatcaaatcgatggatggcaaagtgcagcaggtaggggatttaacgagagctttttgggcatatgaccgaatggaacagccaaggcaggccatgtgggtccaaggacaaaagcatgtgaactcacattctcgcatcacagcacaggaagtgccgactcaatgagcttttgctttcagaatgtaatgcagaccagggaagcctcccctagatcatcactattgcgttaatggtggaattcgcactccaacctcttcttcttcttgcctcaaaccaatgcaaaaagatccaaacctttttggtcagttcagagtttggcagggaggagaggataggtccaaatcgaaaagaatagatgataacggatcaccaattctttttgaaagatggactcctaccacttcttatgtctcgagaaaaatgtgatcttactcatgccgaaccttatgtaaacttgtgaaagcgaaagaattgtttacattctaatgcagtgactggtccaaaagtggactcctatttatttttacagagaacagttcttgattaattatagctgcaaagatctcatatttgcttgctgaaagggcaagaacaaggagctagtaacagcacaaaacccaagagatcgtattcccatttttggcttctctactatacacattggtgtgcaagaaacttctgaagaaatcaaagaagcagcagaagacagaaaagcattcccctagttctgcacccaacccatgtctgcatctcaaatgccaaacgagctactactaatcttttaggacgacgaccagaagaggacttgaagaatcgacaaaatatgactctgatgcaacggagaacattaatacagccgtgccggccacacaagtttgagctgtttctttctttctacaatcaaataaagaaaagatggaaagaatcaagcaagtaccaagaacacatggccatctcctcgagcatcccgcgatgtgccatcgatgatccgttccacgccacatggatatgaataaaagcgaagcgaatcgtatccggcactcccaggcttggtaatattttttttagaggagattgtatgctaaattttttttatatattaaaaaaaccattgcagatatacgtaggttacaaaataccatcatactatatgaaaataaccgaatgacatctgagttctagacccacatgccaatgacacgtatcatggtatctttcaactctttgaattttgtacggatatataaacattaacatttgtaatatactgtgaatatacacaagagtaattttcataaaattataaatatttgatcaaattatcacaaaactacagattttatcagaaaactacatatttaagactaagtatcacaaaactacatatttaacaataaaattatcacataattacatatttcggggtttaaatccttagcactaatattatatttgaattataaacatccgagttttgtctaaattgatgctaaatttgtatttttatgataattttgttagtaaatttatagttttacaacactcaaccttaaatctgtagttctataataaagttagtattaaatctgtagttttatgatatattatcttaaaattgtagttatgtgataatttaacaaaagtatttgtagttttatgaaacttaatataaatataatggtatattaacacttttacatgataggatactataagactgagtttggactggccaattagaaacacctctataccatgaaaacgtacgactcattaatacatgattaattaattaattattagcttaaaaaaattttaaaaaaatgattaatatatagaattattttaaagtaatctttatatagaatttattttttataaaatcatattgtttagtagaaaacaaggtgtaaaatttgagaaaaagggtagcatcagtttcattcaaaggacaaggactatccgatccactggtccaatttagttagcagaattaagatgagggatgctgttgggtagtcctccagaaaccagagcgttaacatcagttgcatcgccgcgccgtatcggaccaatcctttccatttccattgtttctatcaacgtggagtgcctacctgctcgtctcaaagagatcgagaggcagcacatggctccgtctgcatgttgccgttgccgccggctgcatcgcaacgcgtgcctccaacgataacgacaatgtaaataacgtttctctcaagactgaaacgaatcctacagcttttggtccccgaaaactcgccaggttttcctgtgcctctcgtccctcgtcgacggtaaggaccggattggcaaaatcgcaatcccggacatgaatgaaagcagtactagcttcattgatgacaacaaccttgtcgtatattttcctctctgctcttcatctcacatggctgcacagaagaaggaacatgcatcgatgcgtgatcagaatgacactttcggcgctatatgcatgctcgatttgcagcatgctgctatccacagtcacacacagcatgggccagtctctaaggtccacagcgatcgtactacgcgtgttggggttggtagctcgggttgtggttttggtttggccgaccacgtgtggagatgcatgcgagtgtgtgtggttagggtgggcatttggtctaaccgaaaatttcggtctcggttttcggtctttttggtttttgaaaagtgaagaccgaatttcagcgtaaaaatgtcaggaccgacaaattcgatctcggtctcggtcctcctgaccaaaattcaacaacattttcatatatgcaaagaaataatgaaaattttaacacaaaaaccacacaaaagttcgtgtgcgcttatgagtaaagaattttattatgttgcatgactagaagaagtagggatatgaaaaaaagagtttaatcctattaaacatagtggattgtaggttgcatttagacattttttaggcaaaattggttatatagcatcgaaagttcacgtttttggttttttagcaccttaagttaccggttcactttaatagcacccaaagttcaccatgttcccatttttaacacttacgtcaattctcgatagttttccgtccgtcttgatctagccacacacgatatgacgtttgtacccctcacaagtacaagtataatg

SEQ ID NO: 14675 - DNA, 1237 bp, Oryza sativa
gctatataaccaattttgccttttttcattattcggtctattcgattaaccaagaagactaaccgaattgactgaacaaaattcggtatttcactgcctaagatcgaattgatgaccgaatttctcggtctcgatcttttcggttcggtctttttctgtccacccctatgtgtcgtgtgtgtccatccatgtgcatgtgaagctttggaaacttgccctgatcctagaggacaagtgatgctcacgtgtcgttgctaacctgcgtactagtggaatatcatttttgtgtttcttctgtacagtgtacagttgggaatcgaccagattaggggtcaaatccgttcaccagcttggctatactttgctgtgtttctgcacgggtgaaattggtagcgtttgttcgtgttaccacctccatgttcagctaccgttgggtcgtctactgcacttaacgaagatgtaatctcgttcaagacatttgatggatcctttaatttccaacttgtcactcacacactcatcacgcatgattatgttcactcaatcattaggcagcctccatatatgacactagtttctacgtctctagtacgatccattgacgtgattgtactagaaatgctcgagtccaagatgaaaaaatgtcttctcgaagatgccaatctgaataaattgtaaggtacgtactaacctccatttgtctacgtctctacgatccatcgacgtccatcaacatattgcactagaaatgctcgagtccactatgaacgcatggctttctaaagatgccaatctgaacgactgtacagtactagctagtattccttccattttatattataagattttttatcattacccatatttatatatatgttaatagattcattaacatatatatatatatatatatgaatgtgggcaatgctagaaagtcttatgatatgaaatagaggaagtagcttttttttttcttttctgaagatgcacgcaacctgccaccggttgctctgcaccaaacctacaaatactactacctccttcccaaattagttgacgttctagattttttggtactacatgctaagatttggagtaaaatattataatgcctttatcaaatttttcatgaacgcacaaaaagttcacgcgtcaatatactagaagaaagcagagttttggttacacaacataaacggctagaaagccattgccaggggacgaggaagaaaaaacc

SEQ ID NO: 14676 - DNA, 19147 bp, Oryza sativa
  unsure (1)..(19147): unsure at all n locations
nnnnnnnnnnnnnnnnnnnnnnnnnnnnnnnnnnnnnnnnnnnnnnnnnnnnnnnnnnnnnnnnnntttatattataagattttttatcattacccatatttatatatatgttaatagattcattaacatatatatatatatatatatgaatgtgggcaatgctagaaagtcttatgatatgaaatagaggaagtagcttttttttttcttttctgaagatgcacgcaacctgccaccggttgctctgcaccaaacctacaaatactactacctccttcccaaattagttgacgttctagattttttggtactacatgctaagatttggagtaaaatattataatgcctttatcaaatttttcatgaacgcacaaaaagttcacgcgtcaatatactagaagaaagcagagttttggttacacaacataaacggctagaaagccattgccaggggacgaggaagaaaaaaccggaaaagaattgtttaaggactagttaaagaggataaaaactcctagagcaagagagggcggagccccactaaactcccagcaagtccccaaaagcagcaatgccagcagatgatcacaaacggtcttccggaaagatggacttcagctccactgaaaccgaagagaacgagtgatcgaaaactataatacaaataatgcatggttgagcatataagcataattgagggtagaataagaataaatttaaataagatatgattgacttaaaaatgataactattatgagataaaatttaaatggtaaaaagacaactaatttagaacgaaaacgaaaggagtacttctgaagcctgcatgtgattctcaggctggcttatcatttgcgatagctgtggcatattaggctgcaacggtacaacggtacaacctagccgccgctctgctgctgctcaaaagccaccataggtcaaggaaaaaaagactgtcctaatttttttttaaatgttcattgtgattcttagaaagaattgacagatagtctaacttatgagaatatgaataaactagaaaattcagtttttgactaatagtttatttttctaaattctataactatattgtcttaaaatctagataaaaaagttagactatttcataaagtctttgattatgagaaaagttgtaatcggtagaaactctctcggacaggtccagtatagcggctgctgctgcaactctaagataaaagctttcttaatttggtcacatatggcttaatcagtgatagttacttcgttagattggttaggtcgatgtcagttgacaagtacaaatcaaacatgtggtcactggtcactacgtatgtgtacaattcgcggtgatttggttatgtaactgtagattgtataaggcccaaacaaaggcccagttaataattgggctctctagttcaagggccacgcgaaggcagacacctgctgaagtctgattccaaggtccaatcaaagcttaagaggatactaggcacagaaaaaaaagttctactcccgttttttaatagatgacaccgttgactttttatcacatgtttaaccattcgtcttattcaaaaaatttacgtaattataatttattttgttatgggttgttttatcactcatagtactttaagtgtgatttatatcttatacatttacataaattttttaaataagacgaatggtcaaacatgtgagaaaaaatcaatggcgtcatttattaaaaaacggaggtagtatcatttttatttctttacctgaaagacgcactgtacactcacatatcaattacgtatctaggatttttaatatgggtggttcaacttatataatatttttaaataccctaaatataacaaggttagagatataaattgatcaaatgtgcatcataacatattaataagggattttttttctttttccaaaagtttcttctcacatatttatatacgtgtattgggcagttgggctagggtttttttcccggaaccaccagtaccactcctgatccgcctatgatacacatacgtgagtgcgagtgcatttcttaacatatgcttaaaggaatagaggccttgacctcatttaaatcctatagaaaagcataatattcatgtgtattaggattttaacaatagtgataacagctgtacacccatgaatctactactcgcatgctttcgtaagaagtttttttcccccttaaatgtgctgagacagaattttgaattaaaaaggtcaaaggtaaaggtacaaaatcccctcgaactggaagttgaaaggtgccatatccttcaccgaaagtgtaatttgacaaggtgatgaaggattttatgatggtgatggacgattttgacgtaggataggcattccacggattgacaaaacacagaaacagcttaaacgaccacaaaaatatccacacccgggtccacctgtcagttggaaagaaaccccagttctgtccgtggatgtcagagagacaaatcctcggagtcggatgacacgtcggtgtcgcggccggagaagaggtccatgcagagctcgccgtaaaagcgggcgacgagctggacgaacaccggcgacctgagcttctcccagcagcacaggagctcctcgacgtccatgaggtccctcacctttctcttcttcaccagcatctccatcagatgcttctcgaagcttctgcacgcctcctccacgccgtcgtcgccaccgctgctcggtttcgtcgacgccgccgcggcctctccgagctgggcctgcagcgccagcacccgagcggccgtcgtcgacgcgggcgtgtcgagcgacggcgacggcgcgcgcaggccgccgccgccgctgtcgtcgtcagtggacgacgatgccggcggccggtcagcggcggcgacgtcgttgcggtcggcgtcggagcgcatggacatgagtggccagaacaccgcgcggacggagctgaagctgcccgccgcgcggcggcgccggcgccggctgctgttcatcttgcccacggcgcggcggagcagcgcccgcgggcgcctcttgaagagcgcgagcatcccaccgcatggattgcactgcaagcaacacgacggcgacggcatcgatcgatcgatcaaccgcagcgcatgcgacgcaatgatacgacgccactaacgacacagctcgatcgtgagctttacgccatatctcttcttcttcttcttgttcttgggcgttgcatgcagtagattatcaaggactagtgggctagccaccaattgtgcattcgcaatgtgcgtttgttggttgctggttttgagatcgatttggttgttgatttgattgaatcggttgagttttatgatgaggcgaatgcatagtggatttgcgggtggaggtggagttcacgtagaggcagagcaggcgagcgacagagtgggaggacacgatgaaatgagttcatagctagcacagacggccaaagcaaagcaaattaaaatgcaaaattagacagatcgagtacgtgcatatgcagtatataccaatttaaaacatttaaccagcaggagccatgctgtatatgtgacaaatctaaatgcaaaattttgcgttgaatgttatttgtcgttaggggagtttaaaacgacctgatgatcgatcaataattgatcaacttacatatctatgttagctagcaagctgaacggattgaacggattgtaagaggcttccatgtagcgtgaaagctgtctcgtttatatttgcctattttttttctctagctagctaactacagcttgagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtataattatatgtaattacattgtaatttgcacgtaactgtacgcttctcgtgctcagtggaggtcacgggatttctctcatccgtatctaagtagagttaacatttaatcgcttttgttgtatagtaaaaacataaaaagatacgtgcaagacattactgggtcacatacatgcactgcttccccgtacgtatgtatgtatcacttacatgcatgtcacgaaccgctgccaccaacgaggatatcacgtacgaacggcgcgctgcaccgttagaaaaatcgacaaatattaagaaaaaaatttgacgacaaatttctagcaaaaccaaataattgttatctattttaacagtggtttttactaacgtgactcgttaacctactctaatagccttaaaaaaaatagggacaagctcacacggcccaggttccatggaacataagaaaaggtgggtcaatttgttgcggaggcggcgtgaaaagttgaccttgcgggcggcggatggacagcacacagcggcgcgtaataatactgtccttggcagcatcacttagcatgggtcgccaacgaacgacgtgattgtttcggccatagggtcgagcatgatcgcgtcgtactatacgaaccggtggtaaaacagccgtagtacgtacacatactagcgcatcatcggtggccggatgcaagtcggcactagctacttattgctctcgaactcccccaaatcctctctcgaccgccttcattcctccaatcctccgtgcttttgttctctagactcgaatgatcgagatccatatgtgatgtgtgccgttgcgcccactgcatgcagcagaagccccatcatggcacggccggccgatcgatcaagtcatcaaacgccgtagagccggcccgtagagtagaaatcactgtgcactaggtgacactgaatatatatacatgcccagtgcgcgcgttggccaacctcctttctatggcagtgaccagatcggtgcatgcgtcgacgtcgttgcctgcccactgcccaagtctcgcccaaggacaccggaaaaagcccacatctccggccactcgcgagtcgcgatcgagcatcacatgcccacgacaccggagaatatatattatttcctcgcgcgacgacgcagacggctcgtacgtgcggagtaaacgaggccgatcgagtcgatcgtctccgcgcgcggacgcctgaagcggcgggcggtttgcatggcgtgcgcgcggttgcaatgcacacacggcttcgatcgatcggcggatcggcgcatgcatgcatgcggaaagcggcagattttaaagccgagaacgcggtcgggcacccaactgtccgcctaaaactcgctccatcgatccatccatcgcccggtccccgtcgtctcggaatcatgcatgcatgcatgcttgaatgaataatttgatatacgcatgcgtacgcacgatatttcctgaccagccaattaaccagcacacgtatatcactcgacacgacacgtatagatacgttcctacacacatacactcgtatacgcgtgtactgtgtgtacacatgtacacagaagattgatatatgtatgtagtcacatgtgcatggctggacagacagtgttcttcttcggccgaccgtcgttggacagggaattcaatgtcgacattaactcatggccctgcacatgtactattgcatcgtctgtccacaaatttactcctaactccatcgatcagcacatcatcaccactgtacaagtaccatgtagtacgagaaatgcaccacacgccgccgcaaaggtagactctgttttcctttttaagtcgccttcaggaacccaggtcttgcattgttacacatccaatcgatcaatccagcagaaatcgattgaattactactgcttattaagattcaagtagtaacagtgctagctggatttctgctacgtattactaatcgatcaaaccagcagaaagctagcactacgtagtgctatagctggtggtgtgtgtcagcaagataatatatgcatgtaggagagtataagattatccgctgcatgattaccaccaatgatagataaaccccggccatgactgaaagtcttaaactttactttggcatataaacttgtcatccatccggccgctgggtacacacactatagttatatacactagaaaggataatgatgatggcgttcgagtaagatttgcaaagctacaatcatggcacgggtctttcaactatacctactccaacaattatttatctcttcctacctaacgggccgcgcccgaacactatcaatccatctcaattattcattatctacttgcatacctccaaactctgcatctgtactctgtcgctccgatagaggaatttagggtgctgtttttgtttctactagttccccatgctactactatgagttttgatctcatcgatcatagatagctaggtatcgaagctaactcgctagggcggtggttgcttgctcccggcaacttgtaatcgacaattttggcatggaatggtggcaccgcacgaattgaactaaactttggtacgagcagcactgatccgcgcttgtccagtctcttgaaataagctcgccgtgtccccgcaaccactggcagaatgatccccccgtgaggtgagcctcgtcgtcgtcgccccggcaaaacgcgcagcgaaatcatcagcgcgatcatatgccttcctgctcatcctgctcaggatgcgatcgagaaattaagaacggacgattcctctatctgctaatcttggctctcgcaaaactatcatctcttcaggcttcagcagaagaatttagaagacacatgtatacagattatatattcgagaatcgtgaattttatagtacgtgaactgttcgctgcataggagctcctatagtactgtagctgttttactgatccattgcagacaagcgtgggtgagcagtagttctagttcgtcactggagctagctagctgctagtctgcagtaaaaaaaatgtctaccggttgctgtgcgtgcacacatgtctgaacatctgatgagcagttcaatactggtgcattgtagacatcgagaacaacagcctctgtaggttttgtgtaaaaaaaatgcaggttcgaaataatctgttactgttgcagtacatgttctggaatcactacagtgatgaaaaaaaagatgcatttgtctcttccaccgcatgatcaacctcagtatagctgattgtttatgtggatttttcggggatcaccccgtgccaaggtataaaaaacagacggaaatcactcggttttcgtatagaaattgaggtttcgggccagctcaagatcacaaactgttcagtaaaccgatcaagttccaaaataaattagagttttttaagtcggtagtcgatgggtttcaaacgattttcgtaaaacccataaaaatcctcctagctagggcatttttttacgacagtttggttttgtgaacctttcccgtactaatttagagtaccaatttataattgtacagccgtacaggtgacatatccgttcaggggtgggggcaggcctagggcaaggcatacatccaaaaacttgcttaaattttattgattcactatgtaattttttttcagaaaactaatactccattagtcgagctttatcttagctctagtcttatgtaatttttggcttcgcccctgtacccgttggatagcgagacattcacgatgtcttcattaattttaagatatgacggtatattttttttggaggtgtttataaagatagagtgtatgtgtatacgtctatagagttaagcatacacgtgttgtgagcgctttgtgtttgtattatattttttttaaaagaaagggtggtatactgtttttgagagttcaaatacgttctgaaaaaccgaatgatagtacatttgtagttggatttttctcctgcgtacatgcatgttgtcttctgtaagatggaagcaagctacaaatcaaatgcaactgtagagtccatttgggctgcacctgcactacgtggtctctaatacaaccgtaagccaattgcattaattaagttgcccccacatgaggatcaaagcaaatcacttttgatttcaatacagtgattcgtggtagaccaaattttgaccttttgaaatgttcatgtccccttccaaaccctccatggaccatatcatagctctacctagcagctgcctctggaaatgacttggttcacactccataagcaccagcatgcagttgggctctcctgctgcagctcatgtgccaaatcgtcctggactcgaggtttagctgcagcgatggccattagagacaatgagaaacgcctgttacggcaggcttgtctcacaatgccactagcgaaaagctgaatcaccatcttggtctgcaactctgcatcctttcccttgccgtcagagagtcccccacagcttttacgcacacttcctccatttcaaacattttgactttgtgccatgcgtgttgcatgcaatctactaataaggatgaatctctgtcaaagtaaaattggtgtttcatcggtggacaaagcgtcgacaaacacttgaatttctacatttcttattttgctctggagagcagtctgaactctgaactctctgtatcatgcaccaacatatctttttcgttccaacaatttacaagcgtattgattatgattcagaagcacaaatataagagagaatttgtatagtatgtcagattcttgcaagatgccgctgccgcttttccaccgcaacatctctttgctgccactcgcggcaaacttttccgtaataaaaagtggggtgcaacctcgctgcacgcactgcagctcagctcacccccacagtccacgaccacactgcctcactgcagcagcagcagctacgatgccattgctgagctcgtggctgttccacaagctgcggcggaggagaagcgcggcgagaggagaacccgacgtcgtcgaagcggcgagcaagaagcagcaacctcccatggcggcggcggcggcagcggcgccgtgctcgccgtcgccgaacagggcgtcgtactacttcgcgagcagagaacgctgtctccctccggctcgcgccgccacggacaaccacaagctccgggacacccggttcccgcggagcccgcagccgaacgacgacatcgtgttcgacgtcgtcgccgtctcggcgtcgccggcgcgcggccagttcgacgggatgaaggcgatgccggagctcaagctgcggcccatcctcaccaagcgcgccaccgccaagaacgacggcgacgaaggtgacgcgctggacagcggcacgagcgcggccgcgtcgccgacgtcaagggtgcggcggttcgtccaccacgcgaagccgagcagcgggaggcggaaggggcgggtggcggcctgccggccgacgctaccagccggaggcggcggcggcggcggcggtgccggtgactgtacgagagcctggtggtggtgaaggagtcggccgacccggaggaggacttcctggagagcatggcggagatgatcgccgcgaacgacgtgcgctcgccgcgggacctcgagaagcttctcgcttgctacctcgccctcaacgccgccgagcaccaccgcgccatcgtcggcgcgttccgccgcgcgtggctgcacgccgccgccgccacggcggcgccgccatcacctagcccgatcaagtgatcgagattattactacgtacgtaccagcaaaacgcaagattaattgctacgtgccctgtacagagtgaccatgcatgtgatgatcgaattcggtatgattaagatgatagtcgttgcacaaatcgatcgcaagatggtttgataaaaaatgtttgattcgtttgctcgatcgatcgtgctatgcttcgccgtgatttcgctgcggatgcaaaggtgaaggatggatgagcgcacgcgcgtgtgtcacgggggcatccatcgcgctttatttttcagaagggaatcgacgcatgctgtctttacagattggagtaggcctattcgcgtcagagtttttctctcctctcctctggaaaggctcatcatttatttttttttaagtatgagtattattttttgtttactcgtactaaatgactaccgtacgcataggatcatggcacaaatttctgtgtacttaccgatagtcacgtctactctcgctatctcacgggccattttctgcttaagtcaaaaattcttgcacgtaggagtaggagtagacttttttattattattattttggctgttaaacatctgagaggtgaaccaaacagtaatccaccaagaatccaacaggacaaacatcgttgtcaaccttagcgtcagtccttcagtaatcgtgcttcactacacacctcacctcacttcactgccactagaatgcagagcagcagcagaggccagaggcgcactgtgacataccactgttcaatttcagttttcaccattgctacactccattccacaagggtgcaacgattctgggcagggggccagggtatgcagaaataggctgaagaaacagacgcccagaaaaacctccctgccatgtaaaagattgatctgtcagttttccagggcacaggcctaactgcatggatgatggatgtacctacccgtgggctcctcggagctgaggtgagcccagttgcagaaaggagaaaagatggatcctcctgccaatgggaccctgcctttcttgtgcccagtggatgcaatcaccaagaatgtgttcttgttgtttctttgggacatccacttgtcaaaattcaatagatattgagagcttttctttctttttcgctgaaaggcaatcgaatgtactcaatggattcttgggagaaatttatgagccaaaagtgtctgtaacctaaagtttcaagaattaaattcttctgctagtgcggtgcatagtacaaacgtgctataataagttgttcagttgaaagttgcaatcaatcggcatctcagacgatcgacgccgaggcaatgctgcattgcttacgtgggtggagaaagagaaaggcaggcagggcaatgtgtgtttcagtaatcagtatggtcatggatgcgagaactgcagttgggaagagaccaacagcaacgaacaaaggtttcgccatctgatttttcagagccccgtcagattcctcgcagtcctgcgcagccactcgtgatgatcgtgaagacgtgaaaccaacataggcatgggcgaactggggatgaacaaaggtcaagtactctgcaactctttcgtcagaaattcagaatacacaagcgtttgagatgttccattgaggtgctgttcacctttaagaaatgtattattaaaatttccattgaatgagttagaccggtgaactatgcagaacaaaacactgatataattatatatgtcccttttaaatatttattttaaaaatctgagtagatttttgtatcaggagaggcaagtaggtaagtggtaacgaggtagagtgggctgtacagcgaatcgttcatgtcgtaaacaatatgggcctttgtttcgttctcatataataaggctgcgttcgtttgtatgatataggatgagaaaacacctcgttttccgcgcgcacacttcccaaactactaaacggtgtgttttttgcaaaaaaattctataggaaagttgctttaaaaagtcatattaatctatttttgaaatttaaaatagttaatactcaattaatcatgcgcaaatggctcacctcgttttgcgtatctttctaatctccccaatctactcctcaaacacaccctaagtccactttgagagcgtttggcagggccagctgcagctacggttgcacatagttagtgtcagagcgtggcattaaagcaactgccgaatatgccctttgactctcttaaaatatagatccaatttaattcgtatccttcaatcgtaatactagatatttaaatccccccactatcaaaattaaagagagttattttgcaccgatttaatagttagggagttaagatatttggtattacggttgagggatacgaatcatattataccaataatgagggagtcaagtggacttatttattttctcacaaagtctccatgagtttgcaaggcccataacttaacccaacggtggcccatactcattttaccccaaaaccatgtttgctctcacttcgcttagggggtgtttggatccaatggtaaatttttttggcgtgttacatcggatatacgtatacgtatttaaagtattaaacacaatctaataacaaaacaaattacaaaatccgcctacaaaccgcgagacaaatttattaagcctaattaatcagtcattaacaaatgtttactgtagcatcacattatcaaatcatggagcaattaggcttaaaagattaatctcgtaatttacacgcaatctgtgaaattagttattttttagactatattaatacttcatgcaagtgttcaaacgttcgatgtgatagggtgaaaaattttgaggtgggatctaaacagggtgttaagtgcaatgcaaacctcaaggtcttttatctactaagcaaaaaaatgaaaatccaaaccaaatgcagcccaactggggacttttatctaaactacaccctcgtaggtgcattaggcccattagcaaagttcagtcccaaccttagtacccgaaaacaaagaagagtttttaacgtacagggcataaacttaagaatattccccgaaatatggtcgatgcacaaaggtagactactgtgcacccacgagtgtagttggttggttcatggttgggctgcctggcacgtcacgccccaatgcgtccccggatgctgcgactgcgatgcccgtcgctttcagttcgcgtgcccgcttcacgtatccttccgtaatcgtaatccgcccacctgatcgctgatagcgcgattagcaatagattttacgattgcaactgcgactgatctctgacctgaaacgctacggtcgcgcaagtcacgcgacgtgtgtgttgcttacacatcgaccaaacaaataaaatcagtgcttagattgcattcgacagcggtagatttctcttttttttttctctcgtacgtaagtttctcgaaatgctatgcgctttctaaaagtttttgttacagaacaattacttaaaaagtaaatattaaactattttaaagtttaattaatcaatgcgctaattacttatcttgttatagctgacgacgacattctgatgtgtcgtgttggcaacatccatgtcgacaccaataggagggttctctggactctgctgccacgtgtacttataaaattgtcccctcgagaaactattatttttcgtcgtcaaaacacataatcttgtgactggataaagcagcattatggtacggtcaatggcaggtgggtcccagaagagtgcagagaacactgacatgtgggccccacaatttcgccgcatataaacggcagccgtaacgagctcggaaatcgcctgcacagctgtttcaacgacggctgctcggaattcggagggagggaggaaggaatcggagtgttcggtaagcttcgcgaagcgggatggaggcgccgcgcctccgcctcccgttccttctactggtggccctcgtcgtctcgccgccggcggtcgccgcggcggcgagccgaatgcggatcgagcccctccccaccgccgcgctgcgccgcctctacgacacctccaactacggcaagctgcagctcaacaacggcctcgccctcaccccgcagatggggtaagttcaatcaatcggcccaatgcttcgcctcttcgcttcgttccccttccgctgctgctttgtccagcgcctgttgcgtgcgcgtgtaattcatcgtcgttcactgcgttgagtgcgtgatttattagtgcctgtggttctgtggcgcagatggaacagctggaatttcttcgcctgcaacatcaacgagacggtcatccgcgacacaggttcagccgcgggatccccttaattttcatggttaaatctgcaattctgcaccgcagttttttttttcctcccctgatatggtggaagtccttgtctgaactggaaattggaggatacatatttccttaattagtgttgtatcttccacacttccactgctcagagtgcaatgatagaatagaacactgttgaggttggatattggaatggaattgttactacccactgttcaagtgacatgttctcatgtcgtgtttggttataacaattgacaagttcctaatgcgttttcggttgttcagacttaagagtagagtttggttagccatgtacttctaatgaaagttttcttctatctgatgaaacagctgacgcactagtctcgacggggctggctgatttgggctacaactatgtaaatatcggtacattacttggctcaagagttatatattactggctgaagcaagtatgttgttatcctctaatttacttgctgttcattgccttttcagatgattgttggtccaatgtaaaaagaggaaaaaaggtaatgcatttcatttgctaatttaggctgtgatttctccaattactttgttcctaaatatgtcaatgctttggtcttttgataattttaacgagcttggacaggacgtcactcagaacagtcttctttggttgtactgatacaaatacaaatgcattactgaccatataaatacatgcattacaagtttacctctttagtttttaatacattgtttcctgtgcatgtaggatcaattgctacctgacccaaaaactttcccttctggcatcaaagatcttgcggactatgtgcatgggaaaggtctaaagcttggtatctactctgatgctgggtgagtaagcagccctctatagatggtttttgttgttaatacaccatgaagaataatattccaaataactaaaaattataacaagctaaagctttcaggatttttacatgtcaagttcgacctggatcgctccatcatgaaaaggacgatgctgcaatatttgcttcatgggtatgagctagaagcaataaattattgatttgaaatactacacagtatgaacatgttaagatttaagagcatattctatggaaattgatttctccagggtgttgattacctgaagtatgacaactgctacaatttgggaataaagcccaaggacaggtaaactaaatgtcttctcattgtgtaagcctctttcatgagtacagttatgtgaactgaatataacgcattaaaattcgtttcatggtgtcatattcttaggtatcctccaatgcgtgatgctttaaattcaactggacgccaaatattctactctctatgtgaatggtatgcacctttatcatacgagagaagctaggggttgtatatcatgttggtttagatgtatatgatgtgctattatactattttttctcttaggggccaggatgatccagccttatgggctggcaaagttggtaacagttggcgcacaacagatgacatacaggatacatggaaaaggtgattcatgtatttcgggttaagtgtttggggttgggtgaaacctatctatacattgatgtgaagctgacttgtgatcttctgtttgaaaacaagcatgactgatattgctgataagaataacaagtgggcatcatatgctggacccggtggatggaatggtaactgtgtagcaaagagcacaagttttccaccagttttcatactgcaagagaacactcgtactatcattcaactgacttttttttatcagacccggatatgctggaagtcgggaatggtggcatgacctttgcagagtatcgtgcacattttagcatctgggcacttatgaaggcaagtactcattgggtgcattctgtaatcactaggatggcacctatattccagtatgttgcatttggtcttcatgactccaacttatttgtgctgttactggatcaagtagtgaaaagggtttctgaaaagaaaaaaaggagttagtttcttttcaagtgtttttccttgtccttatattttatgctacttgacgttaggggaatttcagtaccgttctgtggatagaagtgtagcgcaaatgatgtgatttaaaattatttggctcctgcattattatatttcaggcccctctcttaattggttgcgatgtcagaaacatgactaaagaaacaatggaaatattgagcaacaaagaagtaattcaagtaaatcaaggtattacactgaatcttttttgtttgcgctctctattatgttgacatgtgtaaacttcaagatagttttctattaaaccattctattatttctacaatgtcattgttctcaaagatcatgaatggcattaaaactttgaaagcgaatttgatttcagcagcaaaactttcatcatgcactaagacaattagcatcatagttgctctttggaattcagttttctgcatatcatgtatattttttgaacaagatgcttgaaccaatggacctgagagctcgcaagtttcccttgctttgttccacctgaggacaggaaaaaactgtacagaactaattacgctacatattgtaaatatctgttttagagtagattattttattcgaacaaatttttttttctccttgtatatgctgttggaataattaattaacacgttaaactgcactcattcgttttctgcagatcctcttggagttcaaggaagaagaattttaggtcaagggaaaaatggatgccaagaggtgatatacatgtccattagtaattatagtatgcaaatataattattactgtgtggtctgccctgatggtttacttccacagtcctttttttcttttccaaaattgcaagacactaactataacagttttgtgcatgagcaatttacacacacaatagtatagcaactgttttaatttgatattgaacagagcatgtttttgtaacatatttgatatttccccaacttgcctaactctagagtccatcgaaatttcatagggacggtagcagccaccccactagctggtgatgggttttcctatgacatccctttgagaatcctgttcagacagggccttgtatgctagttagaagctacttggggtagataatagacttgtagtgttcgggcattgttcagttggaactgcagttctgccatcttaatcatatactcatttgggccgtcggagcatgaataacgcatgcaaccacactaacagcttgagcttttagaatagattagctgctgtgtggaattaaactattacaaatgcatgtttgtgaagttcttcacatcagggcattccttttcactgatatatcatgtttgcaggtgtgggctggccccctctctggtaaccgtctggctgttgttttatggaaccgctgtgaggagtctgccaatattatagtaaaattgccatctgtaggccttgatggttcatctccctattctgttagagatctgtggaaggtaagttaaataatttccggtttaagtggttcaatttacctctgtttcccgttgaaacaagagaggagtggagaaaacaaaggggttaaaatggtgttgcttatcatattaaactatttgggggagagagaggagaaaaatggtcaccacatatatccttttcatccaaccaccaaaacgtgtagcaaattaacatcatagaataagcatgagcatagtgtagtatctactgacgcaacaaagacagatcaaagtttatcaagattccattgtcaaaaccttatcttgtcagcattttgtttattatatgttaactgcattctgaatctgcatttttgcagcatgaaactctatcagagaacgttgttggaacttttggggcgcaagttgacgtgcatgactgcaaaatgtatattttcactcccgccgtcaccgttgcatcaagttgatcatgaagagcatcatgcctgatgctttcctggaagcacccagtatctactcaaattagacctgatgaatcgtccaccattttggtcgaggcaacaggtctactgaaatttgctttgtggagaatgcagttttcccgtttctatggggaagttcgtgcaagcaaaccacgtaaggtttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14677 - DNA, 349 bp, Oryza sativa
tctcctcctcctcctcctcctcctcctctaccagagcgtgcccgggcggcggctggcggcgggccgcgggcggcagggagcgcggcgatggcgggagctggcggccggtggcgccctctcctctgccggaggggggaggcggcagcggaagcacaattttctttttttttcccgaatttttgatacatttggatctaagaacttgtgattcattggatctgtgatgtatttctttaagaatttgagttgtagttttttgagaatttgtgatgtgaatgattcattgatttgaggatgatactttgattttgggatatttgggatatttggggagatttgggaaggagca

SEQ ID NO: 14678 - DNA, 680 bp, Oryza sativa
atatgtgatatttttctctagattttttctcacatatgattgttaggtgtttgttctctagtataaatttataatttttctccaaggtaagaggcgccaagtggaccaatcaaaagctagcaaaagtgccagctttagattatgagattttgcagtaaatgggccggaatgttccgctttcggccctacaacgggacgggatatacggccgtaaaagagcctgctgacaggccataaaaggcccacagagtatcgatacaggggcctgatggtccgaaatcaacataaaggagaagggataagttcactttaggtccctctatttgtcgtccagtctgattttcgtccctgaaccgtaaaactggatacaacccgtcccccaacttacgaaaatgggtaaacgaggtccctcggcggttttgatagtggttttggctgacgtgacgcatacatggctaatttgactcggtcttcatttgacgtggcacagacgtggtgcttacgtggcaatttgatctaagaaaaataataaaccttgtgaaacccacatatcagtttcacacataaattaattaaaaaagtgggacctacgtgggccccacatgtcatccttactccttccccttcttcctcctctttccccttttttcatatttcttcccctcctctttaacgcgtga

SEQ ID NO: 14679 - DNA, 779 bp, Oryza sativa
  unsure (1)..(779): unsure at all n locations
nnnnnnnnnnnnnnnnnnnnnnnnnnnnnnnnnnnnnnnnnnnnnnnnnnnnnnnnnnnnnnnnnncaacatgattaattaccagtgcacgaatgcatcaaggaaagaattccagttgcaattaattacaggtgaaacatactactccgtcttagaaagaatccaatcctaacaatgaatcttgacacatgttcgttattaggattggatttttttttttttggaacggaggaggtacgctcgtattagcatacgcaattatagtcctttaaaatcgtagagcattcagtgaagatgtcaccgagaatgtcacggggaatgttactgaatctgcgtccgtttattagcaggtttgcatgcttcttgatctgtaccgacttctctctccaatacaaaatccactcctgttacaagttattttttccctctctctttttttttgagagagagaggactcccgctcttgcaatcttgctagacctgttcgtcctccatcttgcagtagcaagattttttgttttctggattgccgtcggccggtgaccacacgcgcgccgccggcgcgagttaagatatctccaccgcctcggcgatattttgctccacgttgcaaaggcccgtgaaggtgacgatttggcccatctatgccggtgagcgtgctacgtggtggatggggcgtgggccggcttattttcgcggcgcaaaggcctactctttacttggcaggctgccactacttcggcccattaaaattcaccagcggcagaaattgaaatgct

SEQ ID NO: 14680 - DNA, 861 bp, Oryza sativa
  unsure (1)..(861): unsure at all n locations
nnnnnnnnnnnnnnnnnnnnnnnnnnnnnnnnnntaatatttttaaagtttatacggataaagtttatacacctaaaatttatatagtatgttataaactcaacccgaatttggattaaattcagataaaaaatgttccaatgtatttatttacatgtataatgtttacgcacacagatatttttatattttttttctttcaaaccttttttttttgaatttgttatcaaaaccaatcaaaatgcatacatgcgtaggaagaagagaagaaaaccgcagtgtcctggtgggtgaggccaagttgactgtgtgcggtgacgcggtcactcatgcataagagcatctccgagagaatggctaagtgactctccaagccaaattttagccatagcagagaaaaaatagcctccaacagcatctccatcccactggctaagctatatggttagccaaatactccccccaactggctaaatctagccagccacaaccacatccctaaggctggccaaatgctctccccgctacctcctctgatgcaatggcgaggagtagcagcgttgccatccgtcgcagcaccgcggtccctttgagtagcctctctctctccagcactgccctccgccgcctcgaacaggtcgtgcccggcgcccgccgcggtggacgaagtcgacagcggcggcgttgacggcgtcaccatgggcgtggacgacgccagctgctgctgctgcatcggcacgccgtgcgagtggtggaagtgctgggacggcaatgaggaggagaagtgttcatccgccccccttcggccgcctcatcgctcgccgcagccgccggcatcagctcggcgcagcgcgccgcctc

SEQ ID NO: 14681 - DNA, 1243 bp, Oryza sativa
ttaggtagtccgccaatctgcctgcagacgggccaacagatttagtgtgatcctatcaatgcataatattttgcaagcaatataattaaatttcaaatataggctcaagatgttcaaaggtggcttgccttgctccagatctggagcttgatcctcgaaatcctcgcactgcgggtcttcgggctccgaaactacacgcgaaacgggacaactcaacaaacggcgaaaataaagccctattaatgacctctaatcgtgccactagacagatctcgagatttgggaaattttggaagttgaacggagtcaaacggatttacggttgggaagatattgaatttctaggattattgaatttttgatctaaaggaaaaggatttaattaaatcctttttggaaaagaaaaggaagagggaggagaagtagacttctctcgggcggctagggcgcggcccaagggaaatggagcggaccggccgatctcaacgggccggccggcccaagacggcccaagcgcgcgcgcgcgggagggaggagagagagtccggtggaccgggctcacctcgtgcggtcccgggtgggacccgcttgtcagcggctcggctcaccgtgcggagggagtttgcggcgtacgcgcgcgggcggggctgggacgcggtgcacgcgcgcggttcgcggaggaacggatgcggcgggcccacgcgcagcctcacggttcaccgcggaccatgcgcacgggggaaagacggagggagcggctggccgggtcggctgatccggtcgcggccaaggtggcaccgacgtggcgcctacgtggcagccacgcgggctggcgggaggtagacgacgacgccggccggaacggacggcggacgacagcggcgagcggcggagcgactcacggtgattcgggcaaaagcgagcacaccgggcggttgcacgggacgaggggagacgagccaacggctcggatttgccgggggttgctcgacggcggcggattgcggcggcggcaaccggcggcgggagaaggggaaaacggcgacgaagctacgaggggtcgattcccggcggtgagagcatctacgcggccacgggaactcgacgctagcgtcggattgggcggaactacgccgagcgaggccggcgacgagcgggtgctacggagctcgggcggcgacggcggcaagcacacggcgagcgacggcaacggtcggggcggcgccggctaactacggggagt

SEQ ID NO: 14682 - DNA, 9941 bp, Oryza sativa
tgtagggcttggtatcggttccgtcatttggtccgcggcaactggagagaaagacttaggcggaggttcaaatttcctgtcagtacacatgctctacatttatatttctccgattcaaattaatacatacaagtgtatattaattagatctcacgccgttaatttgtcatttatttgtagtgcgcaaagcaaaagcagggaactaatttgtgcggctactacgtgtgcgagtattgccactgccttgcagaccaaatcatcaccacaagagagctcgatgtacgtacaaataaattcaaaatttcattacgtaacaatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtaaattctactacgacggaaacacaattcaccggtccttaatcgtagctagctaggacatataatggattgtaattaatacatgactacatatgtttctatatgcatgtgtacacattttctataatgtaaatatattttggtcatatatatatacacacacacacacatatgcatttgcataacatatatatgtatatatacatatatattatgcatatacatatctactgaaccatatatacatataatataatatatatatatatatatatatatatatatatatatatgcatatatatgtattgaaacatatatatgcatggtttatatatatatataaaccacgcagcaacagggccatgaaaaaaaaaggtcagctcgatctttagggactaaagatggctcagccacgtggctgagccatctgttaccaaccgggattaaagatcgatctttagtcccggttattttacccgggactaaagatagcgatctttaatcccggattggtactcccggcttggaaatcgggactaaaggagggttactaaccgggactataaagggtttctccaccagtggtatagacatagttgagcggctgtatatgatcttacgacttgtttagcctctgaaatgtcgatggtttgcagcatgaatacacacatgaggttgttgcctttgttatgtttgcatatggacatatggttgtttcggcactaatcaaaactccgcgtgtatataataatattgtaccgttgattactgattactctgactaacgagtccgtgaccactgatttgcttgcacggcccactttgcttacttctctcgatctattattttgacattctcctcgtcagatcgaatcaacatgctcgccgggtagctggggtcgttcactttgaacctacgaaattaaattaacggtgtgtgtgtatgcctgtattcctacatgtagagagttcggtttgcttacctaacaatctactacaggcctctctctctgtggccaaagaataggcaggcatccatcgatcactggttaatttctacgtgcgaaactagggacgctgcacacagattcactgacaaatatcaactaattccaacatttcgaaccatccttctgaatttcacaaaatcaaattaaattagtaggataatgctggccataatggttacaggctcacagctgctccctgagaccatgaaggcaggaggtctttgcaatcctgccaaagcttgcttgctttgctaattatttaccctagcaaagggcccaaagtcgcaattgaggtgtacgtttcaatatgcaactattcctgtcacgagaggacaatggatcagctacagtagatagcttggtttggctgctatggttgcctactgatctactgctactcgcgccgccgtattcgcgtatggttgctttcagtatttcgcttgttcacgcgcatgcatatagcaggtataaccaaagacaaaaactgccatgcgttgtgttccgtcagaaaagaaaacaatgtctccaattcagatacagagatccatccacagataagaaaagagaagtcattttaatttgctgatgaactaatgttcttttgttctctaattcctcactatgaaatatatattatgcagttgatcagtttatcactgctaattctttatatatcccacttccatctgatgcttgtgtgcatctatgatgcagaggccagatgtgttatactcttccatttttctaaaaagtttgttaagcaaccgattgatctgctccctctttctgccttcctatggggtgtagccaacttattctaattaagctagtattctcaatggacaaattctattctatgtatgtgtatattgcactgtgagttgagtgctgattagtacctctgacctgagtccaatgatttgcaaagcgggtccttgttattgttttgtccctaattctgtacgattttactatttgttagtcaccatcaacagggtctatcgtgttccttgattttggtttttgcacttatttaattgcaccgcaaatggtgtgtacgtaaaccatctagtcctctgtctttctgaacttctctgaagataagagatttgtctttctctgaagacacgaaccacacgctatataggcaaaacataactgaaaaagtagtcgtccataggcatattcagttagtgaaagtgaaactaggaacattgcccacagattcaccaacaaccattgccaacttttggaagagctagcattcttacctgacgtgcaactcagattctttgacgacggataaccttattgttctaatttatttgaaattaacggtagctaactgatcaaatcatggatagatatgtacttgtttgtacaaatagtacatgcgtatatctgtgtatcttcgatcgctgcaaccaattccacgtttgtcgaacatttttgtggcaacttgcatgttacttgtatccaatgatatatatgccaaacagctaagaataattgaataatgtgaattggaacgccggatctgctacagattcgatccaattggcaacaaagtcgatggaaaaatgcagtagaatgtcaacgaatcctgcgttttcattggatcttaacagctttgatcaggctatacattgtacatgcctagattaagtttttttgcttttcaacaaaagaatcttcatcagaacacaccatgtcacaccatctatcacaccaagttgctagtggctagctagctagtagcacgctgtgcaagaacaattataattagtgcatgcctgttgtaaaatagtgagagtagttaggaggtaattgatcgatccttgacttcttaatgcatattattggtatgatagtggaaatgtgcagtcctttagtctcatgggttgatcagggggaggtgtaacgtgattgatgttaattagagcttactattggtagtaggtaccaatctggccagcttaataattgttatcaacattatgtttgatcatgtaccatgtagtatataatgtagtattatactatcaacgtgctcatagctgccacatgtgtagtgcacaaatgcagtacgatgtgtgactactgtaaatatgtaatgtttgctgaaacaacgccaagatcactggctcacgcatgttaattctccaagtagctactactagtagtactttaaagtttgaacaattcaacggttgttcttcggttgatgagacaggcatggttgattgatgtgtggacaaagctgacaaggaataggacaaagtaatcagtatcagtaactaagaaactgttcaaatggagatggaccagctggtgtacatatgtgttcaagtgttgaccatacatctcagagagcttaattagttgggtttgcatccggcatccctagctctgaatttaaaatggcctgtgtgtagaagctctcatgcagcttgctagaatgcacagcttatttttttcagtttgtttaattagtttaggttgggttggccgtctccaactaactattcagcttgttgcgtcgtcggtcgatcgatccatccatccatccatctcgctgtcctgcacgtttagacgtttacttactcagtctcatcctataaatacatgcccatctcagattgccaagatcatcatcagtcgtgtgtctctcgtgtgttagccacacgccactgtctaattgtctattatcctttgcatgcccctctccagctgcttcatctgttcgtccacaagcaactaaggtgagatatatacgtagtgattaaccagtaattaatcagctagcagtagtgcagtacattgattacatcagtttgctgcatgattacaaatgatttgattttgggtgcagatgatgggtgagaatcgagcgagggtcgtggcgttggtggtggctgtagtggtggtcgtcgttggtgtcgccggcaatgtcgcggcggcgcaggcggcggtgacggtggcggacctgcagagggtggccgggtcgctgcagatgtacgtggacgcgctgccgcagatggccaagatccgtggctatggattccagcgcggccaagccgtgcccatcaacctcaccatcggcatgtaccagaagacctgggtacgttaattagctgcacttaggagcactaattgcgtactcatatatgcaactcaacacttaatttgacctctggggattagcttcaaatcttcaaggagtactaattttgtagcagaaatgattggtagtacatttttggtcggcacaaatttggggcgaatgccttttttttctttttcgaaacagaagaaaacaaattagtactttgatcatgtcgtcggtggtgcctactagctcaaataattggttttagcccaaacagccaatccaggtcacatcaattcatgattagttagttagacttgagtgatgcaagtacagtattcccaaaatgcatgtgttaggctagcttcacacagtaggattattctaatcagggtcgatatgacaatacaattaatgcattgaatcaattaattgaacagtaaaataaataaaaaataataaaaaatgggatggttgcatgatgcatgcagaaattccaccgcgacctgccggcgacgccggtgttcgtgtacgggcagtgcccggactcggcgacgttcccggggccgacgatcatggcgcggcacgacgtgccgctgttcgtgaggtgggagaaccacctcccggcgtcgcacatccttccgtgggaccccaccgtccccaccgccatccccaagaacggcggcgtccccaccgtcgtccacctccacggcagcgcccacccgccgcagtccgacggcagcgccttcgcctggttcaccgccggcttcgccgagaagggacccgcctggacccaggccacctaccgctaccccaacgtccagcctccgggcaacctctggtaccacgaccacgccctcggcctcacccgcgccaacctcctcgccggcctcctcggcgcctacgtcatcgagaagcccgaggtggacacccccatggacctcccctgcgacgacgacgaccttcacctcgtcatcgccgaccggagcttcaacgtcgacggctcgctctacatgaactccaccggcgtcgcgcccaacatccacccgcaatgggcgccggagtacttcggcgaggccatcaccgtcaacggcaaggcgtggccgttcctcgtcgtccaccgccgccgctaccgcctccgcatcctcaacgccagcaacgcccgctacttcaacgtctccctctccaacggcctccccatccacgtcgtcggctccgacgcgtcctacctctccgcgccggtcaccgtctccaacctcctcctctccccggccgagatcttcgacgtcgtcgtcgacttctcccagtcgccgacggccgagatcgagctgctcaactcggcgccctacccgttccccaccggcgccgcccccggcccgctcaacggcaaggtgatgaagttcatcgtccagccgaacgggccgctcgacccgccggacaactcgacggtgccggaccacgaggtgccgtacgcgagcgtgacggcgctgccgccgacgacgatgacgaggtacatcgtgatgtacgagtacctgacgccgacggggcagtcgacgcacctctacatcaacgggctccgcctggaggacccggtgacggagacgcccaagtccggcacgacggagctgtggcaggtgatcaacctcaccggcgacaaccacccgctgcacatccacctggggatgttccaggcggtgaagatgcagcagctcgtcaacctgcaggccttcaccgactgcatgacggcggtcaacgacgcggtcaagtgcaacgtcgaccagcacgccgtcggccccgtcgtgccggtgccggaccacgagaagacgtggaagaacgtcatcaaggtgcccccgggcttcgtcacctcggtggtcatcgccttcaagctcgtcgacaccaaccagacctaccccttcgacaccaccgccgagccgggatacgtctaccattgccacgtaagcgccacgttaaatgccacgtgtctatcttactgggttaattttttttctaatcgaatttatatgttctaatgtgatttgatgtgcagatcttggatcacgaagacaatgccatgatcaggccactcaagttgcttgcatgaacacgataaaacacggtgctgacattgacgagatgatcaagatgcctcaccaggatcaataattcgaggatttccatttgcgtgggaaaagagatatatatatatatatatatatatatatatatatatatatatatatatatatattatgttatttaaatttatatttattcaattcattctgtgtgtgtcttatatggttcttatggcgtcgatgattgatcgaggggtacatgtttgtaatccgcttgattcttcgaagtgaaaagtataatatatacgtcattcatttttatctcactcggctgttcctgaattgaattctctctgttttccattatcgtatatatgcagtcaatgctgcctccttatgctcaatatgagatggattataagaaaatctagataggaagtagtagttcgaactccaaacttcaagtttctcgttttcttttagtaaatatttcaaactgttaaatagtatatttattgtaaattttttctatatagaaactgttttaaaatttcaaataaatctatttttaagtttataatagttaatatttaattaagcatatgctaataagtattttcgattcgcaatgcagtgtgattaaaaatcggttcatacgatcgtataatctccattgaactgttgcgtcgggatgtgtaaatgctcgatatcaacatgtaacgaacaaaataagctgatcggtcactgaattgttcagtcattacttcacaggcttgagtcgtcgcattgctcattactttcgtgtttcaccaaaatcttttaatgttctttctatatttcccatgttcttaagaaataactaattaatgaaggcatccgccgacattttataatcttgaaagcaacaactcattgaaatgatgagctaatacatatatgcctttttcagttttctctatgtatatgagctaaacggggttcagttaatcacatggctccaaaggcccatgtgattgtgtcagggcccaagtgctggaccgatatattgattgactgttgggcttggcccatacccgcaagagggaggcccacaagatttgctatagcacgcacgcgggccgccgcgcgtccattgctggcagagttcattacatgggctccagtggcccatttgattgtttcaaggcccaactgctgggaacgtactgttcagagtgcggcagcaagggtgcgagcgctaaatagggcccaatagccatctcgatcccgtgaagcctgtggacctgtgggccgttatggaagggcttggctgttccggatgacttcaagggcccatcagcccagacgcggcacaggagaaggcccaccaagtgtgctcgtcttggtcctccgttactgattgcattctaagtttgaatagacttcaaatgttgtaaacttttataacttgtacctttttgaaattttaggactataaacaagttaaattattttgtattgtgtactatagaaacaaggtttacctgtaactttcaaaagattcatctgcaaagaccgtgtcacaattgccacatgacagaatcggcaggtcggccggcggaggaaacctccggccaaattttattatagggaaagggatcacaaaggcaaacgtacaacaaaagcacaaagcataggctatcctatccgaatggagacacccatgcatggccaccaacatgtaacaaatacccccatacaaatgcacgggttgacaactatagtaaaataacttggataacgcgataattaactttcacccaaacagaaatgctcataatttttaatcctggtgaggcatcttgatctcctcatgcatcaaccaccacgtacagtgtgcagtcttgttcatggaagcagcgtgagtggcctgatcatggcgttgtcttcgtgatccaggatctgcaaattacattagaaaataatttcgattagactatagagccactggataacctagtacttactctcctccaaaataagttaatatcacatctcatagaaggttaacttattttgaaatggagtaagcagtagaatggcatgcacgaaagtagcatgatgtggcgcttacgtggcagtgatagacgtatcccggcgccgccgtggcgtcgaaggggtagggcatgttgttgtggacgagcctgaacgccaccaccaccgacgtgacgtacgccggcgggatcttcacgacgttcttccacgtcttctcctcctccggcaccggctgcagggccccgacggcgtgctggtcgaggttgcaggcgaaggtgtcgttgtgcttcagcatgcagctcttgaaggtgtccgggtcgacgagctgcagcatctggacggcctggaactcggcgaggtggaggtgcagcgggtggttgtcgggggtgaggttgatcacgtgccacagctccgtcgtccccgatatcggcgtctccgtcggcggatcctccagccggagcccgttgatgtagaggttcatcgtcttggcggtgttcgggtcgttgctcgtcatgttctcgtacaggacgatgtacctcgtcttcatcgtcggcggcagcgccgtcaccttcgcgaacggcacaccgatctccggcaccaccgtcgagttttccggctcctgcatcggcatgtcgtcgccgacctgccacttggcggagacattgaacgccatcaccttcccgtcgagtgtcgcgttcgccggagtgccggtggggaacgggtagggcgccgagttgagcaactcgatgtcggtggcgttggggttcaccacgagggagaagtcgacgatgacgtcgaagatctcggccggggaaaggaggaggttggagacggtgaccgggcggaagaggtacgtcgcgtcggaggcgatgacggtgaaggggagaccattggagaacctgatgttgaggtacctcgcgttgctggcgttgaggatgcgaaggcggtagcggcggcgctggacggcttggaacggccacgccttgccgttgacggtgatgacctcgccgaagtactccggctgccactgcgggtggacggatggcacggcgccgacggtgtccatgaagatggtgccgtcgacgttgaacttgcggtcggcgatgacgaggtggaggtcgaactcgccggagggaaggttgaagggcatctcgagctcggcccactcgacgatgtagacgacgagaaggccggcgaggaggctggcgcgggtgaggccaagggcgtggtcgtggtaccagatgttgccgg

SEQ ID NO: 14683 - DNA, 14807 bp, Oryza sativa
catgcctgcaggtcgactctagacgatccccacattgcaaacgatttgtttaacatttcaacttaaatttaaactgtattgtacactttttgttgtttcactgttcaaaaacgaggcttgacattcgttcaaaaaaaaaacgaggcttgaccatgaatatctaacagtactttttttaataatatactaaaacctacttagatatttatttgcgagtaattaattaacgtacccaggtcttgttgtacatgccgatggtgaggttggtgggcacgggaaagccgaactggttgatgccgtagccctggatcctggccatctgcggcagcgggtccacgtacttgggtaggtccgccgtgctcctcaacggcctcgccgccgtcggcgacggatctgccgccggcgtgtagtcgtcggggtcatctgacgcccaaccccagcgacttttgctgatcacgctgcagatgtagctagggatcaacgaatcactcttacagttaagtattgacatcactgtatcccactgagtttggtagttttttgctgctgcaggttcatccctggcggctgcgacgacgacgacagccgccagcaacatagcggccagctgctgaatcctcggacccatctgcacacgtacgcaataatcaacaatacaaacatcagttcattcatttacaatagtttgattgtgttctaagttaatctctaaccatatcatgcagcaatgtcgtaattaatgtctcagtttctcaccttagctagcagcgtccgagcttggagaggggcatgcaaaggataattaaccgaggagaaagaaagattagctagctaagacaatgacgatcgatgtgtgagcgtgtggctaacacacacgagccacacgactgatgctcttggcaatctgagagggttgctatttataggattattattactgtagtttgaacaggtaaacggtcaattaatcgtgcaggtcagtgacatgcatgcatcgacgctaattggccgaataatttgttggatttggccaacacatcaacctaaactaagtagagaaattggatgcgagtttctacacacaacattttaaatccagagagcttcctctgcatgacccaactagctagctagttaattaattaagctctgcgagattatatatagtcaacacttgaacatagatattcagcagctgctagctggtccttttgaacagtttcttaatcaatcactgtttacttatatatagtttgtcctaatcttggctgtttcctcgtacggcaggaaataatactacataattacagtcacacacacatccatcgtactccgcccatgtgacatacatttacttcttccttcatgttaaaaaaaagtttttccggattttaagttttattcgcatatataagtattttttaatatggatttcaatgcatggaaatccatatattttcagccaaacaattgaaatttaaaatttgatatctgagatactaaaaggaaacctttgctataattaaatcaacatcctggtatctaacgttgatatcatccaacagtcctttgaaaggcctgcttctctctatatctgagttaacaaaaccgatcttttttttttcttttaagaaattaaccgctcaattttttgaaactgtcggtgaccggtttgtaaaagtcaattattggttttagcctttttactaagctggccgagagttgttggtaacgcggtgaggagtggttttaaattgcaaagcgaaaaaggtaaaccctgctctctactctcagccagtcttcaccgtcttcctcaaacccctgctctatcaataaaaacgaggtaaagattttgtcctcttttcatcctctttctcaacgaacaatatctctccctccggcttgctttcctaggaacagccaaggcccaatgctcaggaggaagataatagtccggatgcttgtgatacacatgaatctacaaataatgaaagaaccctaaggcaaccaagacaattagtgtcagataattaattatgaagaaagtgagcgtgtcactttctttaagcgatgagctaggttgaaagttgaaaccatgcgcccctggtaatgcgcagtaatctaagtatccccgatcgagaaatcacgtgcattgctcaggaatcagcaccagatgatgagaatataactgcctcatgagaacacatgctttatacaaataaacaaggatatagtggatcgattgcgaaataatttttttatgataaaataaaactgcgtacactcctgcctctacatattaaattcctagtgcctcataattatagctcatccttttccttttgttttttttgtattgttttttttttggtaagattagcctttgctatctgtggatctaccacatcttttagggggccacctatttggtatacgcaccatctccattacggacgcatctacatcgtacaacgttgattatttttatgtgaatttttctaatgtattttagagtttgaatcttttacctcaaatttcataacaatatattgaaaactttcgactcgaattttgaactcaaatttcaaaacattcatctaaaaaattcaaaattctcaactcaaattttaaaaacttttaaatcagaatttaaaattttcaaatttgatttgaaagttttcaaatttgagttggaagttttcatatctgaattgaaagatcgatttgacttgaaagttttcaaatctaagttaaaatttttcgtatatgagattaaaggtttacaatcttgaattgaaaattttctagtaagagaaggagaaggagattggatatggtgtgtgctacttctcttgctagtgcatatatgctaaataggattcatgcatctttcatggattgggtttagatcaatagaagaacacaaagatataagtggattacttgtactttgcaattggatacgtaccatttttgaaattaggatggacccatcattttgtgggtgagcattgcaatggacataaataactagggatgaaaacggtcagaaacgatcggaaaacagcctcaaccatttccgtaaccatatttttctcggaaacgaaatcggaaacggtaaagtcggaaacgaaaacgatatcggaaatatcggaaaaccggaaacggaacaatacggacggaaacatgtcggtacagatcggaaaccgataacaaatacggaaacattaaactataaaaacatatatttaactttacataagtatgttatatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattatcatattataagaaatggtaatttccgcgagaatacggtaaatacggaaacgatcggtataacagcaaaaccatttccgttttcatttccatatttttaccatttccatttttgtttcggtcgattaccatttccatatggcccggccggtagaaagtcgaaaacgaacgccggtcggccggtaattaccgttaccgttttcacccctataaataaccatcaacttgggcttcgatgtgcactactccatgagctatgttgagggcaaaccacttgtgcaattgctcatcatttcttatctcaacaaattcgccatcaataacatgtcataaaaaaaaacgtattggttagaaccccacacaatttttgagccgataaaatcaattaattactacaatgtgaagctatgcatgccaagttttgttatgaaatgtgcttagcggtgttacctagctgagggtcacgcgtcatcacgtactgggccacccctcaaggtcacccggccacccatcaagttgccaggtgtgcgtgatgacgcggcccagccactgctccctcccgcagtacactgcagcaacatccaagcgccaccaccaccactccttccgccctagcctaccacagctcccttcatgtcagtgatgaaaaccctagcgctaactcagtcatgccaccgagatgaattcggtcgggactggatgagaaagttggggatatggttgatgtgtaattaagggcattttggtcagtttgagctagttttttcctaaacaaaaacctaacggttaataaaaacaaggtcagacgataaatgattaaacttaagaaaataggggcagattggtagataaccttaagaatagaataaaatgatcaattatccctttttttttctacatcaagaggataggagagggggagtgcgtggttgtgacttgtgaggcaccatacttacgctaaatcacatgccatgttttatatagtagttcttgcaaataaggcaaactctattagtctcgaggagacgtcctctcatttctttgcatatcatccatctataagttacagcgaaaataaataaatacgacggtgagaacatgtatacaaatcaattatagttaaattcattatttttttttgttaaaacttatagtttaattcgttattatagttaaatttaaacttgcatgtttgtggagttatatgttacataccaatctctatcttatctttattttttttagaaataaattatgactatttaaatgacatgcaattgggaacatcccttgaaggattaaaatttatttcctgaaataagctatattattttgtacagtgtacttcaacaatcaacaacataattcatatataacttccaataaagtacaaacccaaattaagtccgtagcacagataccccgtcagagcgcaccagtttatgactagcaaactttcactcataaacaaagacttggataacataacataaacaactttcactcaaacgtaaatgctcagaattattaatcctagtgaagaagcttcttcatctcatattctcatcgatcagcactacgtttcttgttcatggaagcagcttcagaggcctgatcatggcgttgtcttcgtgatccaggatctgcacagtcaaaataaattagaaatggagcaactgatcaatgaacacgataacgaacgggcacgtcgagcatatgacgtggcgcttacgtggcagtggtagacgaatcccggctcggtggtggcgtcgaaggggtagggctgattggcctcgacaagcctgaacgccaccaccaccgacgtcatgaactccggcggaatcttcaccgcgttcttccacgtcttctcctcctccggcaccggcacgacgggcccgacggcgtgctggtcgaggttgcacgtggcggtgttgttgtttttgatcatgcagtccttgaacacctggaatccctcgatcttcgtcatcttgatggcctggaacgtggcaatgtggaggtgcagcgggtggttgtcgccggtgaggttgatcacctgccacagctccgtcgtgccggacttgggcgtctccgtcaccgggtcctccagccggaggccgttgatgtagaggttccccggcgcggtctggttctcgtacaggacgatgtacctcgtcgtcgtcggcggcgggagcgccgccacgctcgcgtacggcacgccgtgctccggcaccttggatttgtccggcatgtcgtcgaccttccccttgccggcgaccttgaacagcatcaccttcccgtcgaggttcgggtccgtcacattagggccgttggggaacgggtagggcgccgtgttgagcatctcgatctcggtcatcgccgccggcaaccgggagaagtcgacgatgacgtcgaagatctcggccggcgagaggacgaggttggagacggtgaccggcctggagaggtaggaggagtcggagccaatgacggtgaaggggagggcgccattggagagcgtgacgttgaagtatctggcgttgctggcgttgaggatgcggaggcggtagcggcggcgctggacgctgaggtacggccacgccttgccgttgacggtgatgacgaggccgaagtactccggcttccactcccggtcgatggagatggagccattggtgtagaactcgcggtcggcgatgacgaggtggaggtcgtggtcgccgcaggggaggttcatggggtcctcgagctcgggcttctcgatgacgtaggcggcgaggaggccggcgaggaggctgacgcgggtgaggccgagggcgtggtcgtggtaccagaggttgcccggcgcctgcacgttggggtaggtgtaggtcttccgcgtccatgtgctgccgttctcggcgaagtcgcgggtgaaccaggcgaaggcgtggccgtcgaactccggcgggtgggcgccgccgtggaggtgaacgacggtggggacgccgcccttcttggggatggcggtggggaccttggggtcccacgggaggatgtgggcgtcggggaggtggttctgccactccacggcgagcggcacgccctgccgcgccacgatggtgggccccgggaacgtcgctgtctgcagcgattgcccgtacacgaacaccggcgtcggtggcatgtcgcggtggaattgctgcatgcgcaagcatcccattttgaaattatttttcgattttgctacatgtttattgatattttttttcttgaaagttctttttttttcttgaaagttcgatagacataaatatatttaaccgtataatatagctacattgtaacttctatagatgtactgactttggtcaaaattaaactgtttcaaatttatttaagttcatagacaaatatagtaatattaataatactaaactagtttttatcaaatcaataattgaatatattttcataataaaattgtcttgggttgaaaatgttattgctatttttacaagcttaatcaaacttagagcactttgactcaaagtcaaaatgtcttataactgaaatagagggagtatataactgaaatagagggagtatataatataatttatatgaaactttcacatatataggtagtccttttttattttcttaccggtaaattttagcatatttacattatttattattttttagtaataagacaaatagtcaaacataatttcaaaagtcatatatatcatctaataaaaaatgaaggtagtatattgttggatctaaaaataaatatctaagatttgttcatgacaccaaaattgaaatttttactcccagatttaatcatgaataacagttttacttatgataatatggataaatctcaagcgtatatatttttcttaatttaatggtagtttacatgtcttcactatatacgttggtctggatattagatatatattttcccgtaatcacaacgtacgtacccatgtcttgctgtacatgccgatggtgagcttgatgggcactggacggccatggcggatgccgtagccccggatcttggcaatccgcggcagcgagtccacgtactttgtcaggttcaagctcgtcatcaccggccaccgccgccgccccgccgccggcgccggcagcggatgatccggtggtgtgtactcgtcgtcgttggggtcatctgacgcccaaccccagcgacttttgctaatcacgctgcagatgtagcttgggattaaagaatcactcttacagttaagtattgacattactgtatcccattgagtttggtaattttttgctgctgcaggttcatccctggcggctgcgacgacgacaacagccgccaacaacacagcggccagctgctgaatcctcggactcatctgcacgcaatcaacaagacaaaaatcagtatacattttacaatagttgattgcattctaagtttctggccatatcgtgcagcaatgtcagtactatttagattcgtagctaattgaaaataaacataactatattttaagacgaaataagtaattaagtagctaatcaagcagtgatgtcagtttttgtcaccttagctagctggagaggggcatgcaaaggataatgaattaaaggagaaagagattagctgatcgactgatcgatgctcttggcaatctctgggagggctgctatttataggattaattttactagtttgaacaagtaaatggctataattaaacgtgcaggtcagtgacatggatcgacgacgttaattggctgaataattttttgattttgggcaacacatcaacctaattaaactagtagaaattagttgctgatgtgattttagctagttgcttgcaagcttctacacacagtccattttaaatctagagctacctctctgcacgaccaactagttaattaagttctgcaagattatatatgtagctagtcaacacttgaacagagatattcagctgctagctggtccttttgaacagtttcttataattaacaacataattaatcattgtttacttataatttgtcctaatattggctgtcgtttcctcgtacggcaagcattatatatttacggtcactcatcgatcgtactgtgtacacttgacaaatcacattgatcgtatacttactccctccgtgattaaaaataatcaacttctccttcaaatataagcttttctaggattaaaatttgtatcacaacataaacgtttctaaaatattgattataatgcacaaaaatcatgctacattgtttttagtcaggtgtttttaagagggaatcttatatatttgaccattaatacgattgaaagataatttttttattaactctaatttttactaaacaatttacaaatgtttatgaggaagcacacggccgatgaatcgatgcaaatcctacgatttactagaagtaaggtggtgttctcttctcctataaatatgagataaatatgaatgttaagtgttttacgtaaaataagatggtattaacgtatgattaattgagttttaattattataaatttaaaaaatagattgatatggtattttagagcaacatcgtggtatccgccgctcctcctttacactaccgaacaacaaaaagaaaattagtgttacaccgtgtttagttccaaattttttttcaaactttcaacttttccatcacatccaaactttcctacacacataaacttctaacttttccgtctcatcatttcaattttaaccaaacttccaattttagtgtgaactaaacacacccttagataattatatatgaagtgagagtgcccctgacaccgtgctctgaataatcttgtatcccgatcgagaaatcacgtgcatggctcaggaatcagcaccaaaatggttccaattcgatcgttgtccttgagtatgctagattgatgcttggaagattcctagccttaatgtgcgattagttacccattgccagaataaaacaattgtcaccaatcatgtaccatcttctggctgacccatgagaccaatactgcaaatttccaccatctcataaggttattttatccatcctaaaatataataaagtttactagtgtttaaaactatcattcctctcaaccaatcaaaactatcatttcagttaatttatttacctacctttttatctcaatcaatcataatcattcctaatttaaatccatctctctctctctttttttttatctttgtgaaagacttcatcgatacgtactcattcctgccacaactaagcggcattttagaatgtgcgcaatcaatgcattaaaactttggcaataaatatatttttaaatattttcattcatcttttttgaaaataatatggctagatttgttttaaaaaatagtttgataattaataatataactttgctatattttgcatggtttttatagtactgattaaataatcaaactagtttagtggtgatatgttatttttcaaaacatcacttatttgtaaccattagtagtaaatactccaccaaggttcactaactactcttggaccatctgaccatgtttgagaccgtccttttaaacaattattgacatgggctgtttatttactaacacaatacattaatattttggaaaattaacttcgcaaatagcttagaataaggagtctaattagtgaaagaatgtttttcagaaaaaaaaatcgtaatttagaagcatgagcaaataatttatgacaaaaatctgagggaaaaaaatctaaaaagaaggatctaaaaaggacagtgcctaactattctaatataattgcctagtgagaatacatgcttatacaataacttgtttccactccataggaagaggataaaggggatcgagtgcgtattttttcgataataaaagaatacaacactgcaacctctgcatcacacatagaactgatagaagtaattaaacaaaaacaagtactcctatcggtgacctaaataattaggtaccgaagctggataaagacagatgatcgaattaatcatgaaaacatccgtgcatatttttccaatgtggggactcaaaaagaaaaataataagaacatttattcatcaagtgacggcagtccttttcctcatacgcggatccatatcttgaattcttgatctccgtatacatctggattagtgacagaagttatctgataatatacggcagttttgtcttggtcatacttgctacgcatgcacacacgtgaacaattaagtaggggcatctcggggaagattcatcagagctacacaacgtcagagaagaagagctcgaaaagtcggcaatgggagatgattatgaatctgtgtgcaacgtcccctagtttcgcaccactgtaggatgcatatgcatttcttgaccagattaatttaatttaatctaatctaaatttgatttaatttcccggtagtaggtgaagaacacattgttaggtcaagcaaaccggacactacgtatacctgtaggtacacactacactggtacacactacgtatacctgtaggagtagttttgaactgaacgatcccagctacccggtcgccctgttgattctgactaggagtgaattaaccaaattaaagaccgtacggtaaacaaatcattggtcaccggttcatagtcagcgcaattaataatcaacagtaccacataatatataattacatacacaactttgattagttcgaatcaatcatatttcgatgccctgagatgagattccctggaagctaacactgtgcctagggcgcttttcatatgtctgcataacgattctcatacacaggcagcagcatcataaaccctccgtaaaaaaacaaaaaacttaacatagacgaagatgtgacctctcatgactgtccagattcgttgtattaggaaaggatgtgactgctcgattgagttttttttgggatggagagagtactcatgtgctgtaaaatgcaaaccaacattcagaagataaataagttgtcggtcgacagaaacttcagtcttatgtaaagcaaagatatataatctgcctcacaagcatcatgcatgcttgattcaacatgtaatgaacaagtggttcacaaattaactgactttacatgctagaataacatcactcttgacattgcaaaacagttatctgtttctcgtcgtgtttcaccaaaaatcttctaatgttctttctatatttctcattttgataaaagaaaaatgttgaactggctccataacaataatgagggcctcattcgtcgttttgtcttgaggaagccaacaacgctttgaaatgagctaatgtctttttctctatgggcttgaatggtatttggtttatcacatgggctccaaaggcgaaatttagggcatccgccgctgttttagcatcgatgcctcttgcttgcaagaagtagatcgcatttggatcatgttcaccactgatggcagctccatgtgtacatttgacatcatcagcaatgatctgaaggtttggcttcacattaacaagtgccttcgatgacaggagaagacacttggtttcttgccctgcgtcagtttgttgtgcatatctgtgaatcaaggacatcaatgtattaggagtctaggacaggaggaaatagtgatgcataaacagaacttcatgaatatcaacagaatactgaagctgctcagaagtgaaacaaacaataattgtgcacaatctcctgatttcataaggaaaaattgctatttgaacagctttgctctgctacatatgcaagactatatgttaggaacccgattggactgtatatgggccaagttagccatgtccaagcgaggcccaagcaaagcaggagcagcatacaaagcagcagcgttagcaacatttggggatcgaacagatcgattggccaaggcgccaaacggtggcggcggcgatctggaggtcggttggctcctcgtcgatctactcctctaccccttctcttcatttccttgttctagaagcttctagcctcctttgtacctttccatcttccacctaaaaaaccttcactattgcagtagaaaactgctactccttccgctggatgagccactcttgtattgaatttggtgttgcttgaattgaggaagtgtgtctctaacactatatttacagatggcttcactacattttaactaataaataaagatcctaaagcaatataaacttcaggtatgtagtatgtcagtactccaccaccatttaaatcctaagcagttagaaaatctactattgaattaataaaaaaaacttgaagatctacatatatgcactgatggctcaaaaatggctgaaaatcagtaatactttttgtcaaaataatacagttgaaatacttcacagaagtaatctgatcacatacctgttcactttgatatttccatcaaatatgccattccctgtaccagaagcaatcaatctatgtatctgttgtgaacgacctcttgggtgatcaagtataagcttgctatgaagatcatgtatctgtttattctgcgctgagaagtggaacgttgacaattgtgtgttggtctcagggcccaactgctggacgtggagattgtgcctgttcaatcttgctccaatgcttacctcaacaaactcatagttgctagatgtattctgcaaagaatgttagacaactataagaataacttactgttatttcctactcaagtaagccttgctttaatcttcatcattgaaaactgaaaataataggtaaaatcatccttgtcaattttgtcccaagataattccagtatggaacattccaatacaagtcctttctagagtgtaataaaaaaataaatttatgaaataaattattagtgctaagttaccataagctgtctaacgaaatttaaaggaaaaaaaatgcaaagatgtcgaattgggtcagtcagtccaactagccactaaccttagtgtcgctagcccatagccatacatacactctcctagcacagtgcagccaccatagaaaaccaacagacaagcacaggaggtgagaacttgagggatttctactgcctaataccttcatggaagtcacggtctactaatggggtttccaccaccaaccacatttaggtgagttgtcactgccatctctccttgctatcgcattattctcatcctgcactttatttttgtgtcatgaggttatacttttgcatcgctgaggatgaacctcttgttcctccttagctaggatttcttaagttaattacactatctttcacttctcagattgaacacttagatatcatttcccctagtccactgaagcagcaatgaataggaactcagtacgaccttatgccccaacagtaagaaactttctctgaaaccatggttttcaggccttctggttccacaggttgctagcttagacgacaaatggtgtgaaaagctaaactttatagaaaatgaagcaaagcctaaatccaactaatacaggaattttgtatgtgccttgttgttctaaataaagatgatttatttcacagtatgtcccagttgtaaatattcaattgaaacatcaaagcacaaagtggtaataatgcactcccagcagtttgttaggaaacccttttactttaggaggtttatttctgcgtatgaagcttctaactacaaagaaagtatagtgcattcctcattgatctgttatattgtcaccctactaaagaaggaataagaaatctcatttctgcatgtgaagcttctagctacaaaataagtgtagtgcattcctcattgatctgttatactgtcatcctactaaagaaggaataacacaatctcatgacaccccataaataaaactaaatatcacaaacaagaaggaagctacctctaattgcaatattgtttttagataagattgttgaaacatataaattgtaacatatgccactgctactcttatcaacttagtaattctatgtttctaaccatgtgcagtcctaattgaaccaaaattgtctttatcctatcctatcctagctcaactcacagaacaagcaagcacattgaaggtgaacaacaactatggttaagacatcgatccacaaatcataactatatgcaaagcaattcaaaatgcacaagaaaggtctacctgctggacgacggtccacttggtatgcgcagccgcaaacgactgctgctgcacataggaatgcaccaccttcgcatcctcctccacgatgatctccatcaccggattagcccaataacacccaccgtcctcctgaccaaagtgctcctcaatgatggccacct

SEQ ID NO: 14684 - DNA, 23182 bp, Oryza sativa
ccgaacgacaggcgacgcaacgcgaagcggggtggagcaggaggcggcggcgcacaacgccggcgacggcgacgacatgcgagcggccgcgcgaatcttctccaccggtggctgcggagagatgggggaagaagaagggtttggtggtttctacgtgagaatgacaggtgggcccccttgattcagtgcataattgggccgagtggtgggcccaatttggcggcccagtgagtcacagccttatccgttcgcgtccccgccctcgcttcgccgcggcaatggcgctccacctcacccgtcccttcctccggccgtcgccgccgccgccgcggccgactcgtcggagctcccgggctcattgcctcgccccttctgccagcgcgcggggcccgagcttcaggaggccctacacgtccgtcctggtggtccccaccggagtcggcgccgccgtcgggggtttcgccggcgatgcgcttcccgtggcgcgcgcgctcggtgccgtcgccgactgcgtcatctcccaccccaatgtaagtattaacttccagtagctgttagggttagttttggcttctccatggttgaagatttcgtcttcacataatcacaggtgctgaacgctgcgatgctctactggccgatgcccaacacgctctacgttgagggatacgcccttgacaggttcgctgaaggatcctgggctctccaaccagttcaccagaacaaggtactactaccaatttagtggttctagagattgctcagacacaaccatggataatgtaactgtaggtagctagttagctacggttttgttgatacattgacacattgtggctgcttcaacctaggtaggtttggtgttggattctggaatcgaggaggagcttcgactccgtcacttgcaggttgcggatgccgcgagggcttctcttgggctccctgtagtcgagtacattgtgactgatactcctttggaggtgctcattctgttctgatcccttctttttttgtcctgtgagtgagaatacgtttaagatctagtgatacctctagttagaaagataatttagtgcctgatgtaatattcatgcttacttatgacctgctcatttgtggtctagatcaagacatggtttgatccaaaatgtgggaagtctacagggagtgttgggaactctgattctctcctgagggcagttgaggccctggtgaaccgctctgatgtgaatgctgtggcggttgttgcgcgctttccagatgatgatccagaagattcagattgttatcgggaaggaaaggtaatacttgcctgctcaagtagctggtttattatttttcctaacaggttactgatagttgtgccacttagaattcttgaaacaccatgttgtcttgatttagtttgttatgggatgctcttcgatttttcaaatttactgtttggaccatctgaaatgtcccttgcaagttgcaacaacactctcttttcaagtagtttgaaagctgttggccttatggtgtcattttgctcgctgaatttttatattgatgcaattcaatggttgatactgatcacggtagacatgctgaggttatcatttgtgggtggtgttcagcatttccaagcatctatcatttctaatcttgtattttcttcaatgccatatcaatgcagggagttgatctgttggcaggagttgaagcgattatcagtcatctaattgtgaagaaattcaaaatcccagctgcccatgctcctgcagttttacccccagttctcagtctgtcagtgtccccaagatctgctgctgaagaggtttctactctttctgctgaactatgctggtgcataactaagttaactaaatatcagggatatgcttagtaatgaccctacaatgaaatgttgtatatcaggctaatttcaaatgttcactatctggtagttacatgttttcttaaagttagtccacttgttcacatccattcctagcatatagatcagtgctgtcctatgtcaaattaagcagtgctcgttaattttatatcatctttttgtaccagttctcattgatctttttttgtaacagattggacatacctttctaccttgtgtgcttgccgggttaagcaatgcccctcaatatgtgatgaggaggaatggaaacatggataatggttgcatagtggctagtgatgttgatagtgtgattcttccaaaagatgcttgcggaggagatggtactattgcctttgctagaactgctacaaagaacaaggtagatatcagtgataagtgatgttttatctttccatttggattttattatcctcatgaataattgtttttttgcagcccttaatcattacggttcaagaaaatgaaacagttcttgatgatacccctgacaagttcaatatagaggcggtatgtaccacatgtcttgacaattttacaaagctctcattctgatacttatgcaagaaatcatagcaatcttacagtgttgacccttttgctccccagctaaatgtccagaactattgggaagccattggagtaatcgcagctcacaaggcaggtatcaacccaaatgctcttagaagacaaggaattgatcatcttaaaagctctcttagactataccctgcacaaaatcgtggttctaagaaatcggcctgttcaccaccgcaggagaaactatatacacatgaactagtttaacaaatttagttgtgcaactaaaagtttatagaattcagttctggcaagatgggagccccaaattttgaagtcatttgtacatattccacaagaacaacactgcagtggaatcctagttatagctgatgtacatatacaagccaaatttcttatggcatcacgatttagaggtaacatgtaacccacatcagtagtttgagtttgctaagacagaagcacagtgtcctggctttttgcccttccattggaagtacaatttcatttcagtttacagcaatgaatgtagaagtttatgctgaattttagcaaatgctcgggcatatgcatctactgtggtacgtttggtcgattagaatggccggccggccacgtgtgacctgcggacatgcaccgcttggtagcataagtctcattcagttgtggagtgatttggtaggtatactgcttccctattacagctaccgatcaaagtggaactacccttttattttacgtgtgtagctagttcagttagcacctgacttgctgttaatttactgtagtttcctgtcgggtgcgcctcttgagattagcatttctcgcatgcttacttaccagctggtttgggtgaaaaattcgggcaaaatagtttttgggtacctgaaatttcagaaatttgaagctggcatatggaatcctcaccgtatcgctctatgcagtattcgtattttggttttgtaagtcgaaattttttaactttaactacattcgtaggaaaaataactaatatctacaacaataacaaataaatacaacatattttatggtagattttaacgaataatttgacgttataaatgttggtgtgtttttcaaaaaactaaaaaagttagtcaaagtcaccttaatttagaaaaatactaaaacaccttacaatacgaagcaggggagtagcaacagggccgggaatggatggtttgtagctaccagcaagcgttcatggccggtttatgaattcttgctcgctgctgcccgcgcacgagccccttgcagcaagccgcattatcgttcgttccaacacgtacccggctgaaccaaccagctgccggtcgcctcagctcgaccaacctgatcgacttccattccagtcaagtcaaagcctctctatctcccagcaactagccccgtttctatatatacatctgatcatatgcatgcagaattatattgtctcttctactgctactgatcgatcgatctagctaagacgatctctagctgtaatttgtgctaacacatgtgtaatgaggtgtccacgacggcgcagctctgcaagtctgcaggtgtcatcgcagcctccaccacggctcatctccgagcacttgccggccggtgatccgccgtcgccgcttagccggagcagaaagaggaggagcttctccgaggaagaggacgagctcctcctcaagctgcacgctttgctcggcaaccggtacgtacgtaattaattaattcccccaatatcaacaatattccgctattaattcaccgtttgttataattaagcaatgatcaaattaatattgatgcatatatatcaagttggtccctcatcgctgggaggctaccggggaggacagacaaagaggtcatgaaccactggaactccaagctgatggatagtactatagagcatccaccctcgctacatgatgatgaacaccgtcgacggcgtcgccgtctgcgaagcgaagctcacgacgaacgtggtgcaaagcatccgggccacaattcatcttcttcctccaaggacgtcaatggcgatgaatgtacagtcgccgacgacgcaagtagctgtaaccaccaagatgataaccgggctgttgcagaattgaacctagagcttaccctctctacgccttgcatctacttgttacttggacaggatcgtgaggatggatcgaagagcaaccagggtttaatttgatcgatcctaaagtatactaacaacacattaattagtacatcttgcataagcataaatgaaacgatggagccaatgtgtcatttgctaattaatgaatccagcgagatcgactgacgatgagcaagttggaagttactaatcccactgtcccataataaaccaatcttgagtacattgtactacaataaaaatctgcacattgtatcacattctggtataaggttgatatattttgaaacaggtggaatagctacaagagaaggttggaatttagtaagttgcagttacaaattcaagctcatcatgcacactaaccttctctagaaaagagtaatactatacctcgatcttcccatgaccaacctaattcaaaccggccaacggagtttctttcttctaaaatgataatcaaaggaagaaataattaacatttcgattgctgagctccccaagttcagaataaattaacgtcatttcgacataaagagatcgctctcggtagtaagctagagatagagagagagagagagagagatgccggagtactgcgtcaccggcgggacggggttcatcgcgtcgcacctcatccgcgcgctgctcgccgccagccacaccgtccgcgccaccgtcagagacccaggtaacacgcacgcacacttgcgccgttgaggcaaatgatcgaacacgacgtatgcacgtctgagatctgagcatgtgtgcatgcagaggatgaagccaaggtggggttcctatgggagcttgatggcgcgagcgagcggctgcagctggtgaaggccgacctgatggtggagggtagcttcgacgacgccgtccgcggcgtcgacggcgtgttccacgcggcgtcccccgtcgtggtggtcggcaacagcagcagcaacaacggcaagccgaacgacgacgacgacgaggaggaggtccagcagcggctagtggagccgatcgtgcgcggcgcgtcgaacgagcttcgctcctgcgccagggcgtcgccgcgcccgcgccgcgtggtgtcacctcctcctgctcctgcgtacgctaccgcgccggcgcggcggcggcgctgaacgagtcgcactggagcgacgccgcctactgcgcggcgcacggcctctggtacgcctacgccaagacgctggcggagagggaggcgtggcggctggccaaggagcgcggcctcgacatggtcgccgtgaacccgtccttcgtcgtgggccccatcctgttgcaagcgccgacgagcacggcgctgatcgtgctcgccctcctccgcggcgagctccccaggtacccgaacacgacggtggggttcgtccacgtggacgacgcggtgctggcccacgtggtggccatggaggacgccagggcgtcggggcggctcatctgctcgtgccacgtggcgcactggtcggagatcgtggggtcgctgagggagaggtacccggggtacccgatccccgcggagtgcggcagccacaagggagacgacagggcccacaagatggacaccgccaagatcagggctctcggcttcccgccattcctctccgtgcagcagatgttcgacgactgcatcaagagcttccaggacaagggcctccttcctcctcacgcttgattcatatgatccacacaattaagctgcttgattaattaactaattaatctaatattattaaggatcggaatcacgtagtaccgatcatatatatgttcatctcgaaattaactgcaagtgtgagatcgagaatacactaatacagtgctaatatatactgatcagtcgcctggtgagttattaattatctacttctatgatctcgtatatatatccatgatctacactacgacagtgggtgcgatgctggcacgcaccagttcagctgatgccaccaattacgtacgatctatttcctccgtttcaaaatataaacacttttaaacttcagcatagtcttcgatatactattttaactaataatatttataaaagtaagatgttttaaataaaaaaaagtttaatgataattatactaacatcaatgttatatgattgatgttttaatttttttttctataaatagttaaaattaaaaatgtttgagttagtattattcaaaaatccttatattttaaaactgatggagtaaatgccggtctttgcagcccactgacggcaaggccccaagaatcagattaggagcccaagctcgttgtttttcttaaaagcccaaaatcccaaagcgctcaggcccgtccagcccacgtagacgacacgggaggccgacggacgaaagatcgagatgagcaacgtgttgagggcttgaggctgaggagttccgcagcgtgcagggtgcagcagccagcagacttgacatcattgacatgacatgaccaattactccgtccagggaccagggctgcagagggcatcaataaactaggcatcgattagcgagatgcgtcaggctagtgccctttttcgcacgtggaggcaactgcatgcgtgtaccgtcacatgcgttgcacgatgccaagatcctcgtgaagctcatgtgcagttactgttaccatccgccctttccatccaccgagaagtccagacccgaccacaattccatattttagtgggagtggattctaatccctcgagaagatattccttgtatacctttttcttttaaatttgatacaaataattatgaaaaattctgaaaaaaattgacagtgtagagtataataatacctactagttcaccaaaattcatgatcaaattcgatctacacatcgagaaaaaaaaagataaatttacatataaacagtacgctactatttatacgctgaatttgtcttttttatatctcgatgtgtgagttgagtttggacttaagattttatggagttgtatatatgtgttgtctgaatattgtcaattttttccagaatttttcataaccgtttatatggtttttgagcaaacgagggaacatccttaaaggaacattattaagggattagaatagtttccctagttcagtcgtgtttcccgtgttctgacaagtggggacagcgccacgtgcgcgctcgctcttctccacatctcgtggactcgttcgtgggccccgttgctgccttcctggtctataaatacacacactactatcacactctgcatctcaaacccaacttcttaaagaacaaaaaacgatcagccatgaagagcggcagcctgctgacgctcaccctgggagccctcctcctcgccggcatccccatctcctccgccgctgtcacccccaacagcaacatccgcctccccaccgacggcggcgacgaatggccgtcaccgccgtgggactgctgcgacaagctgaagcagtcgccgctcaggatctggccgcccaagtacaagtgcctggacgaggtcgaccactgcgccgccgcctgcgaggactgcaagcgtgccgacggcggcggctacgtctgccgggactggtactggggcgtcaaccccgggcccaagtgcaccggcggcggcggcgaggaggcggtgaggtcgaggccgtggaaatgctgcgacgacgccgtgtgcacaaggtcgatgccgccgacgtgcagctgccaggacaaggtgaagtcgtgctccggcggctgcggcaagtgcgtgcaggtggagtcgcagccgccgcgcttccgctgcctcgatcgctaccacggcttcccggggcccaagtgtcacaaccagccagcttaattagctactcatgttaattagcctcagatcatacgatccaacggtgaataagagcgacgcgtcgagcaggggcgcacgcgctgaccgctcgatcagcgttaacgccttgcttgctgccgagtagcagtgacatatgtgtaacattcgtgtggtcacgtatgttttttttcctttattgtgttttttttctttattgtgtttgttttatctggatcgtgagggaatgtttcggtgaccagagtacgtagtactagtatgttgtggttgctgtccaataaataagatgaatttggtagcagtctcaactctcaatagtctgtttgtttggtctcttcttactagctagaacatcatcgcatcacctcccagaattggttgtttaaccgtaataaaaaggatcgattaatttggtgtcaacagggaagaacagatcagggatgatttttgtcgtttaatttcaccccgttaatcctatatggcaatcacgtgtcggccatgcaaattaatcatcccgcctctggccttccctgctggctgtgatgagcacgtggataaatcatcaggtagaattcacgggcgataattgtcccattgatcgcttgtagcagtaacatgttaccggcaacaactaagcaagcttggtccgttcatcgctagtttcggcccaacaacgtaagccagagccgccgtttcggcctaataacattagctcgggtagaaggagcccgaagaagcccatagagttgggctccttcccgcctattcgcccatcacggcccataaaataggcccaattctcggtggcccaaatagtgttgggctggatagaatgcaaatcgtccgagacaggccgtgctgacgggctgtagggcccacaggcatcacgacggccggcggtaggtaattaccgctgaccttagatcatgttgccatgtcacgtggttatacggacacatatttaaattattaaacgtagtttaataataaaataaattacaagattcgtctataaactgcgagacgaatttattaagcctaattaatatgtcattaacaaatatttactgtagcaccacattatcaaatcgtgtagcaattagcaaaagattcctctcgcaaatttgtcgcaatctatgcaattaatttttttagcctatatttaatacttcatgcatatgttcaactgcggtatatcccataggttcagagcattgataaaaggttgacaaatctagataactttctgtcgaaatactagtagtatagtttgtagtactatctccatcccatattacttgtcgctttgagttttattttaatatttaatcatttgtcctattcaaaaaaaaatttagaattattatttattttgtttgttacttgttttatcataaaagtactttaagtatgactatcattttttatatttggaccaatttttttaaataaaacgaatgattaaatgttacatataaaaagtcaaaattacaggtaacatgggacggagatgtagtatttttttcggagggagtaaagtgaggagcacgactgatcgatgataggtcaatcaattgcgcgtcttctattaatggctggctggaatgaaaagccgccggccacgtatgatacgatgggagctagctagtactactagaaagtcaaggcacgagtcgtctctcgtcccatttggacactgaccaagcaagcaaacgcggttgccggctttgccgcctgcaacactgcgatacaaacacaccccacggtcatggacgacgtacgtacgtgtctcctccataaatcaccagactacctgcactaaactagctctgcaccccgccaccgggtcgcgcgcgtcgttgaaacgtcacacctagctaactgcactgcacttctgcgtgtctgcgtcgtgtactcgtgtgctttggtgttttaatttctctctattttgctctgctgctgccatgccgtggtcgtgcggctggtgcgggaggtggaggaggagcagcggcggaagaggaggaggcgctgatcgtgaggccaacggcggtggcggcggcggcggcggcggggcggcgtcggggagggaggaggagcagtggagcctcttcatcgagctgcccgtgctggaggccgccacccgtggcttctccgacgacaacctcctcggccgcggcggattcggccccgtctacaaggcttgtttcttactgccatctcatcgtcccctttcgccatggctttgctttgctgctaggctgttgccctgttttgcttgtggaattcacctaacattaacaaagactggttttttattggttggtcaacaaagccattccttgctttccattctgattttgtccttttcacctaccaaaacgacacaaatgattgatctaaccctgtctatgtatgggtaatgggtgtactatcttttccatggacaaatatcttttctactgtttgctggctctctctcttttttttttcaccactaataactgattatacctgctctgctactttcagacatcatttcgtcaaattaatatgcgatattagtttttttcctctcttttgagattctaatctcaacattgcacgaaccaaagcatcatttttactcctgcaaagcaaagcagtagtagtaaataataaacgtaccattacttgtcaggaattttacatcttgggaagaatgaactactaactgacaaaaaatcggttgatcttgttaccatctctcttcagggggtgctcgagaatgggcaggagatcgccgtcaagaagctgtcgctggagtcacggcaaggtgtgagagagttcttgaacgaggtgaggctgctgctcaaggtgcagcacaggaacctggtctccctgctcggatgctgcgcttcctccggtcacaagatgcttgtctacccttacttcccaaatggcagcctcgaccacttcctcttcggtgacacctctctctcatctgcatactactgtattatgttgcaaaatgtcctaattattaattgccatcagattgcttctgaattacgggtagaatttgtgagctaaatctgacagtttggtcattttttttagtagtataacgaatcactgttatctgtttatcattaatcaaaacacaaaggttctaacctcggaagctaggcactctgttggagagtttgtggtgcacaaatcataatagccaaaactctatggtagttctgaacaaaattcagggaaagtgcttgtagaaacagtcatttctggtagaaaaacaagtccctactggagttccattgtttgtggcctagtggtttcaactttcaaggagaccaaaacgatgagttagccgtggcaaagcatatattcgcacagacacagtcacacagagttgttcagtcaattaagcagaacacagaatctgcaagaagtctttttgtcagtcaatgtaaggaaaaatctgccttgacgttctcattgacctttactgtgtcaaaagcaatacttcgatttgcttaatctcaaaggctcaacatatcacatcaaatcgggtatggctgtatgccattatgccgcccaatgtctttggattgaccatttctcgaataggatttcttgtcatttggagtaatctgaacaccgccccccccccccccacacacacacacacacaaacttctgtgtggacaaacaaaagacagaaagttcaattagctactccgtaccatagtttgaaatgctccatgattttgttaaaaaaaaacataaagcataactaattatgttctttacaatttccagtttaaacataaagatacgcatgtacctatacttaattccatctgcatatataatccatacaaaaccagatcagtattcagtactacatccattccaaaattaatataatgacttttagcactagtccagatatatgactaaaagttactatattttaggacagaggtagtacaacataaaaaaaaaaaacagaaaatgctctgcaacctgctgtatgtatgatacctgtttatgtacctctagacagaaagaagagcgtgcagctggattggcccaaacgctaccaaataatcgtcggcctagcgagaggcctcctctacctccacgaggaatcccccgtcaagatcatccaccgagacatcaaggcaagcaacgtgctcctcgacgaacagctgaacccaaagatttcagatttcggcatggcaaggctcttcctcgaggacgccacgcacgtcaacaccttccggatttccggcacatagtgagtaattacaccagaacccatcgttgttattcacttgatccgtccacaaaatctctgtggttgcgtgtgagtacagtaagtgatacgtcgcagtggttacatggctccagagtacgcgatgaacggctacctgtctacgaaaaccgacgttttcagcttcgggatgctggtgctggagatcgtcagcgggaggaaaaacatcgataaacatctcgacgccgaaaaaaccgacctcctgaattacgtaagtactctgaaataacaacactggattctgaaaatttatcttccaggagcagcattgtgagttgtgactgaatcttttttttttctggaaattattcagacatggaagctgtcagaggaagggaggcagatggagatcgtggacccggcgatggcggagtgggacgccgaccaggcgcggctgtgcgtgcagctcgggctgctgtgctgccaggccgtggtgtcggaccggccggacatgtacaccgtccacctcatgctgtccagcgactccttcacgctgcccaagcccggcaagccggcgatccacggccgggtcggccggtggatgagcaccaccaccacggtgttctccgccgcctccaccgccaacacggccaccacgctcggcaccgacacgatgacgacgagggcgtcggcgtctgcggcggcgctgggcggcattgccgaggacgactccaggaactccatctcgatctccttcaccactgaaggccggtaaaacaagacaggaattcaaccatggacagtgcaagtagtaggttagatagatagtgtcggaattttttatccaaataattgtgttttgattgatatgaacaggagtacagttgctgtgaattaattggcagtgcatatgcacagaattttgcatttggggcaatccattctgactcatttgagccgtaaataatctgcgggccgtgtcttattcggacttatttggatagtccgaattcttcgtgttaatttcttgggctgggcacaaaacgaactctacctgggctgcacaggcttacttgtgtcagcccataaatctcacagataaaaaaattaagcccactcgagtgctagtccttctctttttgagtaaatttaatagaattacatattttatggtccaagttgtaaaaaactacacatgtttttacacttggcacttaactatatttattttggattaaattttcgcaaaactatattatcaacggacagatccacctacaaaatgacgtggttgttccacctagaatatagatttgggagcttcatcctagatagaactatgttttgcgaaaatttaagttcgccatgcctacatcctaaatatatgcaaggaaagaactatgtcatctcgcgggtgaacccatttgttgatattgcgattttttgaaactttaatacttaagcgttaagtgtcacaaaacgtgtatgtaaaatctactctttttttatgttgctgggcctttctgttaaaaatgaagagtattaataatgatactttggacctttgcatgtagatctaagccattgtagcaggtagaattgcttgtagaaagagagtgatcccacatttatataagagaatttttaggccgtttgccaaagcatatatccattcatgattcatccatcccagtgtaccatgcaatttgcaaaaacgattttatatgccattgttcaaagaatgtccgaagtaatctctatagggaatttgtctccggtagtccgaagtgacaacgagaggttgatgctgtactgaattctgaagggtcgctcagatcagattagctcatgggttggtccgattcctccatgcagctagctgcatacattgaccagtttatcagagcatgtctaaagaaacttttgcaatgtctacatatactcgagtctatgcaattcaattgggagaaaacacgtgggtggattcaatgtatgacaagcggggccttggttcccaatcaaattttactttagagtaaattgcattggcagtacacaaacttgttattaggtggatgcaatttaatacataaatttgtaaaattcttgtttcagtacacgaacttgtctagttcgtgtgaatgaggaccaaaataacttgtcaatgttaattttacgaagttgagatgttgattagaatgtgacgtacatacgtgtagtgagtatgcataagaaatgcattatttataaatttggtctctactttacccttcatcgtggaaatgatgaatttcatatatttctaacccttgtatcattgctcggatttttaatctttttctactattactgtatcatattctattttttattgaaaatgtgtatgtccaataacaaccttcttagaactatgtttacatagtgtcctaataaacttctaaatcaataagattagctatgtagtgtctttttcgccttcctccgtatgtactagacaagttcatgcaccaaaacaaacattttacaaattcgtgcactaaattacacccatctgacaagttcatgtaccggcaatgcaatttactctttaccttatattcaaatttttagttggcactctgtacttcactggtcctccaagtctaaatactggtactaagtactaatattgtaatatctctgatttgatgtctgaagagcaagaataggttattaaatccaaactggtttgataagtatgctagttggctatattacagtgccaatgacgacaatttacaatatctgtagcaatggccatgatgcgttattttttatcaggtgatatatttttttcttcgagaaacacagcacaaatataagcgttcacaacatgcgtacactgatccttataaaaaacacacgtacaccttacctttatgtcaacaggtacgtcgcataccactgaaaaaataattagacataaatacgaacggccgtgtcaagtctggaacttgaaccctgttgagttacgctcacttcacttctaaccagttttatgtgttatgaagttatctataagctagcataattttcataatatagatgccgcccacccatttgcaacgtagtaacgcgaatattagggaatgacataatatcaaataattagaaagaatgaggctttaaacccaggtcatctagcccaccacgtagtaatgcgcgtacatatgtagcatatgctataaggctggatcgatcatgcatccatgtcataatatactaccataccataccactttcgcgaatataattgtgaatataagtatttttttcggaataagtgaatataagtatttatgctgtgtactccatagtcgatcacgtatatatatatccattcagctcgcaagaatatattctatcttgtgccggataatcttgcaagtacaaaattcagctactattgtagtactccctccgttttaaaatataagagattttggagggatgtaatagtactattgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagttgtctcatctgccccctagagggcctcctgcccaccttatataggatgaggggcaggattacaagatagaaaccttaaccaatacggtatcggtttcctaaatctactttacaatattatcaaaccaggagtttaggccgttccgtaatatacaaggaaacgtaacacccaagtcatgatctgttacatattacataaatataagttatcccctatgactagtcggataaccatgccgtatgggtatggggtacccataatatccacagtagctcctgagaccttcgcagtcgaaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtagcccctgacaatgtggttaattgaacaaaccaagcatatagtcaaggaataaataatccaaccaaccaagtggttttgataatcgtaattaaccaagcaacttgatattaatatgtagcatatgcggtgtaaatccctgaataacatgatccgagtgatataccgactgctttgcaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccaagtaaataaacttataaaggatttaccaaccgcctagaaaatgaccacaatatataatcagcctaagccataatattggtcaataaaaatgcacacttacgtggcgaaaagcaatgatattgtatccaatcaattgcttaaaaacccaaacaacaccttgacttatatataaaaaagtcagcgggacagctatataaagctttactgtttgacaccttttaagatgcattgtaccaactcctaaaaagttaagtaactgcggtataaaagaattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatccgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagttggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaaattttgagccttgtatttgtgtagcccccgactctttgattagttgggaaacaactgaacatagagtcgagaactgtagcctcttgtcgtcgaatagtcattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagtgaagacgcgcagttgtgaagataaaagcactagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgtcataacaggccagccgtgcaggcggtgacaccagtcggcggcggacgaggcggccggtcggtgaagacgtagacgcccaacaacggcagcataataggccagccgtgcaggcggaaacaccagtcggcggcggtcgaggcagccggtcggtgaagacgtagacgcccaacaacagcggcataataggccagccgtgcaggcggaaacaccagtcggcggcggtcgaggcggccggtcggtgaagacgtagacgcccaacaacggcggcataataagtcagccgtgcaggcggaagcaccagtcggcggcggacaaggcggccggtcagtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcgacataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagatgtagacgcccaacaacggcggcataataggccagacgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagatgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggaaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaaaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcagacggaaacaccagtcggcggcggcgaaggcaggccggcggtgaagtcgtagacgcccaacagcggcggcataataggccagccgtgcagacggaaacaccagtcggcggcggcgaaggcaggccggcggtgaagtcgtagatgcccaacagcggcggcataataggccagccgtgtaggcggaggcaccaatcggcggcgacggaggcaggccggcggtgaagtcgtagacgcccaacagcggcggcataataggccaggcctgcaagcaaccagaaactccgcaaaactcggcgaccatgtgcacgacgaccgaaacgcggttgacgatagcaacaaacgcggccgacgcggggatgaggttgccgcctggcggcatgcgtggaggcggccggtgagcacgttgctcccggcggtacatgcgaaacaaacaacaaaaatttattagcaccatagaaaacagatgcctatatacatatatacttgctataggcatgcatatattagtgatgcgaggtttgtttgcttgctcctataatccagtcatgcaatgatcgttggcacttggcagtgcatgcactagattgatcagaaccaatctatacgcttgctctagccagtgtatggtcatagcatgcaccgtcgtcgtgtacgcctggtgtcggtgtcgtgctgccaatgggcgacgaacaacgtgaggacgacgatggctcgaccggtggtcccgcagagaaccagcgaacaccccaaccggcagtacatgtaaccgaggaaaaaaaataccagagcatcaaatgtgattatagatcaatctgataataatatattgaaacgacaaaccgattatcgtttgaagtcgtcgaacttgttgagattaatctcaacgcttgaattgattccatcgcactcgtcaataagaaactcgacgcacccctacctggcgcgccaactgtcgaaacatgatttcggcaataataaaagggggtagcgcacgagacctaaaagtggatggaggcggagacaaaggatttagacaggttcaggccctctcaatgagaggtaataccctactcctgtttggggatttgaatccgccgggtgtattatagatctgacgatctagttgtatcatctgccccctagagggcctcctgcccaccttatataggatggggggcaggattacaagatagaaaccttaaccaatacggtatcggtttcctaaatctacttcacaatattatcaaaccaggactttaggccgttccgtaatatacaaggaaacgtaacacccaagtcatgatctgttacacattacataaatataagttatcccctatgactagtcggataaccatgccgtatggatatggggtacccataatatccacaactataaataatctagatcccttcaaaatcattcaaaatctcttatattacgaggatacgatggagggagtagctagctgctgatcaagtttcaagtgtgtcccgtgaggttccatcggtcagaagccactgtatagcttcaaagataacgacacttagccccgtcgtcaggttgttagccagagttaattgtacagactaattgataacagcctcataggtcaatgcgtcatctacttgtacgatcagacaacaagtataaactccaagatatgccatgcacaaatgtgccacttgaagtctgaatatatcttagttttacctggaaagttgcataggctgtatgttcttctggaacctcgtccttgagctggattaatctgaccgagtcttaatctattttcttttacataccagaaacccataaattattcttggattaaataatcgcgatgcattactacgtaaagcaataagtgaatttggatccagaagcaaagtccaaaacaagcagagactacagagttgagtacgactgaaaaagcgcttttt

SEQ ID NO: 14685 - DNA, 2274 bp, Oryza sativa
  unsure (1)..(2274): unsure at all n locations
cttgcatgcctgcacgtcgactctacagaatccccattggattactgaatactagtatatacagtaggatgtcaacggctttcacacgcacgcacgcaagacctgatcaagaattgagaaggacggattacagatgcggctttattcagttctagatctccaaaattgaattgcccattctcacgcgaccaaatccattatttcgaaagctggattgaattgttcatcgagctcaattgcaaattaaccataaaacatttttgacagcagtagtttggattgtcagacaatcgatctgttggtatatattggattgttgtgtgcatgcaggctgcatgaatgcgcggcggttgtgcacccgttatgcgtgctggactccttcctgatcgaaagcatgagaatatataatgtgatgtgcaaatcaagacgtcacgagctggagagtacgactttcaattcatttgcttgactgtcattttcaccgacaagttaagcatgcatgagatcgatcagaatgcagttttcttttttttttttaagtgcagcatgcagtgatagctggctactctaaggtgacaagcagtttatcaccgacactagctaattaagggacccttgctaatcgagggaggagaacaagtaccatgcgtggtgtactctctggctaatcagcaactatctcatcatgtgatgtgtttgctactgctgctgccagccaacatcagacacagcgcagccagctgatgatatagactcccatctagtagaagtgtaatttgtaagcgaaagataatttgtttaataaaaacttttatatacgcgtttacagtgatataaaatcaaatgcaagaaaataaactttgataagaaaccctaaaatcaacttaaaaatttaaattttagctgataaatataaatataaacgaaaagatgtggctgtatatctatctttggagttgcatgtattttgggtacatatctactcctcgcagtactggtacgtgcttatccatcttgtttcatgcgtataaatgcatcagcgaggaataaattaaatgcagctagttattagtgatgagatgaagatatatatgatgattccggccatggcgtttggccggaaaacgacgccgatcgccggaatcgatcgaaggcgccggtagatggaggcagcgagatacgtggaacggcaccgtgggcgccgtccgattctgatcaacggccggccggtggcggttgatggttgacgcgcattctgttccttccgttataaatgggcccctccacactccacactctagtttagatcaagccacattcccctatccttttgggttttacactttcttgccatggcatggataggatggtagtataattgtataaatgatgccattttagtataattttataaaggaactcatttttccagataagagttttttttaatatgtgcaagtatttatatgaaggaaataaaaattttaaaaatccaactcttaataatacgaaaataattacacgttagagtgagtcaatagaaggcatcgtacctactgctattgattggcatgagtgccatgcattgcaagtaaaacgttttggtcatgtacatggccctggtcaaaatatgtaacttccttaatctctttttagatggcaataaatactccactctcttggatttatcgagcattgaccatacacatctctagttaaataacatttaatagggctaatgtatgaaatgaatagcattattcacctatttaataaccaaatcaacatttctacaaagttaaataagtcctttgtatttatactagtacacagaaatagatactaccttcgtctaaaaatgttactgcctaatataaaatgagacatattaggtatgaatttggataagggttatccaaatctgtagtactatctctatattttaatgtatgacgcaattgattttttatctaacgtttgaccatttgtcttattcaaaaaatttatgtaattatcatttatttttattgtgacttgattcatcatcaaatgttctttaagcatgacataaacattttcatatttgcacaaaaaatttgaataaaacgaatggtcaaacgttgggaaaaagtcaatggcgtcatacattaaaataccgatggagtactatacttggtgtactaacaatttggnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14686 - DNA, 1026 bp, Oryza sativa
aggaggaaggaaggttatttttaggtttttctttttactaaactttgataattgtttttgttgcttaataattatttccggtgctctgaaaattcaagtaaaatttgagggctccttttaaaccaaggagaatttaacaaaaattctctgggccacattcgaatttttcttgtacgtattttagtgtttgccaatttcttttcgaattttaattaattctattattccttttagaaaataatttttattttgggatgaatttatcaggacgtgacaccgttgccacggattgacgatttattcgatcaacttaaaggagcaagagttttctcaaaaattgacttgaggtcaggttaccaccaattgaaaatcaggtctgaagatatcccgaagaccgctttctcaacgcgttatggtctatatgagttcacagttatgtccttcggactcaccaatgctccagcattcttcatgaacttaatgaacaaaatctttatggaatacctggaccagtttgtcgtggtgttcatcgatgacatcctgatatactccaagagcgaggaggaacatgctgaacacctgaggctgataatggaaaagctcagagatcatcaactattcgctaaattctcgaaatgcgaattctggttagaccgagtagcatttcttggacacgtaatctcctccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaggaaggaaaagaaatttcaatggtctgcagcctgtgaagacagctttcaagaaatgaagaaaaggttgaccactgccccagttcttaccttgccagatatccaaaagatttcgagatcttctgtgacgcatcaagacaaggcttaggatgtgtcctaatgcaagaacgaaaggttgtgg

SEQ ID NO: 14687 - DNA, 523 bp, Oryza sativa
gaccgagtacacagagacggtccacgggtcgacggaagcggatcccgtgtgtcaaccgaggcgagtggccgacaaacggactccactagacaccacacgggttgcacacgaggaaacaacgcggttaccaagcgggcacactaacacggacactacacggacaagcgaacgactaccgataccgatacacgggtaccggggccgacaaccgcacaacgagcacgggcgacaccgaaaggacgaggacggggcagcgagggagagggacccttaccactacgcaacgaggcgagggaacgacaatgacgaacgggcgcggcggaggcggtcgggaacgacggagacgaacggcgaggggacggcttcggcggcgatccttggacgaaggcgagacgcggccggcacaaggcttgacgacgcggagccgaggacgaagacgacgacggggctgcagcggcacacttgacgaacgcggacgacggacgaaaacggcttgacggagggacgaacgccacgacgaccg

SEQ ID NO: 14688 - DNA, 559 bp, Oryza sativa
gtgttcatgcaagcaacttgagtggcctgatcatggcattgtcttcgtgatccaagatctgcacatcaaatcacattagaacatataaattcgattagaaaaaaaattaacccagtaagatagacacgtggcatttaacgtggcgcttacgtggcaatggtagacgtatcccggctcggcggtggtgtcgaaggggtaggtctggttggtgtcgacgagcttgaaggcgatgaccaccgaggtgacgaagcccgggggcaccttgatgacgttcttccacgtcttctcgtggtccggcaccggcacgacggggccgacggcgtgctggtcgacgttgcacttgaccgcgtcgttgaccgacgtcatgcagtcggtgaaggcctgcaggttgacgagctgctgcatcttcaccgcctggaacattcccaagtggatgtgcagcgggtggttgtcgccggtgaggttgatcacctgccacagcttccgtcgtgccggacttgggcgtattcgtcaccgggtcctacaggcggagcccgttgatgtagaggtgcgtcgactg

SEQ ID NO: 14689 - DNA, 9016 bp, Oryza sativa
catccaaaatcccttatatctggggacggagggagtactaagatcatatctcaaaacttttatctgataactaaattcctggtttgacaaatttaatctggctaaaatacattaaagattaattcaatacataaaattcttaatttcttgctttagttttcatgtgtttctattttgtattaattgttcaattagtatatgcatgcgtggggtgcacatgaataaacattcagtgtgataccaatagtaggtgcatgactgatcaaatctatccacaattgtttaaatcttggtgctcatatcatttatgtgtttaatttcagtaggatattcgttatgttaactgatttattcctaactccgtttattgtacatttgttaattaaggactgtatttagggcatgtacaatggtctttattagcggtctctctttattgtcatgcaagcatttttggtgatgtgaaagagagaggaagaagaaaatagaaagatggttgctacgcatgacaactgcatagagtcgactcgtagcatttattagaaatttttttgttgcattgagtctgataaaggaaaagtgactagtaaaaaagtattttggtatattaatggttagagactgtattgtcttaactattataacatgataacctttaattaacgtagagaccatacctttgtattttgtgggatacgtgtgtaccgtgatatgtgtgttatgtatgtcctccatgcatgtaatcagggaaaaaaaataggtgcaggcctagttgtcatggtgcagagtgacgacacatatatggcatgcgcacttgcatgataagccatgtctatccacagtgtctggcctaacatacaaatatgaggggccaaatccaagttgcattcgaaatttccgaatgtaatttgatttgatttcaaagagataggcaaacaacaatctgttgataaccggatagtgcacaattaatgaccagaggagaagcgatgctgcgattgccaggttcaaatcgtattgattggaagacacaaatcgtgtgtgtcaaagtatccgtcgaatcgagagttattaatacctatcagaagattgagagctagttcctttttttttttgaggtacgagagctagttcctcatcaacaaccagctagaactctaatttgtagagatggatactaattaaattcattatatctactgtccaaatccatgataatggagaagtactatatacactggttgagttaaatacaacttatgctgtcagatgtcaaccatggtactatacccaaccccccaggagtagcacagtacaattagaattaatacactggtacacatacgccagctatgtgaagactttcctgactacctgtaacagtagtgtgtgtattgtggtgtgtgggggatattgtacgtcttaaactcttaattatagtagcatttttcattgaaatgtatacaggtgatcaggtcgataagtatacttgttacttatattaatgggcatatgatttttattaagcatgcatttggggttcttttggaacataggatttccaatatgcggaaaaagaaaaaaaaacataggaacagagattgtcaatgttaagcaatgtatacaagatttcaaaacatagaaacactaaaggtaatgtcttcggatggttttttttttcgcgaacacgtctttggatggcatttttggagaaaatcacgtacacgagagagagagagagagagagaggagaagagattgtggattggacttaattagcaatggggaaaaaaggtgtaagctcgagttaaaattcctatgcaatagtgggtatagaaaagcaattaatccatacaaatttttactacaatcatattgttctgaagggtgttactagtataatataggaaaaaatcctataaatttcctccatccaaagaagccataatcatcagcatcattgtttgccttttgacttaattatcacctgcaactaataattaaattttgaaactaaattttagagttgattttgatgggtttttattgtattttattttcaacattagcttttatatcactaagaatgcatagataaaaggtttattttttttcagctataggccaaacgattaaactgtatatgtagtgtttttttttttgaaaattgtatacgtagtaaagggaaattgattgacaaaccggggcttatacatccgatggatttcgctgttgggctttttattatactggtcattttagaaatgatagtgcgggccaaatcagaaataaggcctggtttagtttcccaaatttttttctcaaaaacatcacatcgaatctttggacacatgtatggagcattaaatatagattaaaaaactaattgcgcagttagggaggaaatcgagagacgaatcatttgagcctaattagtccatgattatccataagtgctacagtaacccacatgtactaataacggattaattaggctcaaaagattcgtctcgcggtttctatacgagttatgaaattagttttttttattcgtgtccgaaaatcacttccgatatccggtcaaacatctgatgtgacaccctaaaagttttttttcgtgaattaaacaggccctaagcccagcagcaaccaagaaaaaagtttgctgttccatcaagaacattggtcaaagctagtggcactgcattcaaaatcctgatcaggatctatagctaggagtagcttccccgagagtcagcactcacctgcaggcacttgttcatatcgatcaccttttaaacacttgaatgagctataattatgccatcgttagcctgggttgacttgcggcgcctatgtcaaatcaagttcaatgtgatgtgatgtgtgttctgatgagttcgtgtattgactgctcgtattttatttgtactagtacggcacctatagggaaggccagagagtgaagagagcacaaaactgcagaataattcagtacccacagtaccatgtagatagatgtagctcaaattaaacggctgcgtttagttccatccaaagtttagattttagttgaaattagagatgatgtgattgaaaagttgtgtgtgtatgacaggttgatgtaatggaattttgcaaactttggatccaaagtttggatctaaacacaaccgtagagtagttttaatgagactttcacattggttcaaaatatactctaccagtacatatttaacccatttaacttttgtaagtactccagtttgtactactagtaatatatatgttcataaaatcataagaaaaacacctggtcatcagccttatacattttaaagaatcatatgcgttcaaaaacatcaatgcatctctccactactacacagttgattaaattaattccatatctgaactaaaaacacccccaaaaactcacacaccaaaaaatcaacattaccatacatgaatccaataagtgcagacatgtacctcacttagcagtagattttaaaggtaaaactgaacatcatgaacaactacccatcgatctcgatctctcttgccccccaaattaacacatcgcctatcgatcacgaacacttctaatttcttggctcttagtaatttacatgaacaataacttaactgcaatcacatcaaacgcagtaaatactacgcgtcagctcaggaggcggcgttcacgttcctgttgctgtggccgcacccgaagctgcagttgcagttcccgttgtcgggctgcacgttcgccggcggcgcggcgagcggcgccccgaagcacgagaagctggcgcggtgcggcggcggcggcgggcccaccagcgcgtcgccggcggagacggcgtggccgatgacgtagtcgccgaccgccgccggctgctggtggcgcggcggggccgggtacgtcgccgggtagctcatcgggtgcaaggcggacggcggcgccgtcgtcgtgtagaggtagtggtggtacggcggcggctgcggcggcgacagccgtggctgcaccggccggagcgggatgcacgggtcgccgccgacaccgcctccccggaagcctcctcctcccatctgcatcgtcggtggaggagcagcggcgccgcctcctcccatgttcacatccctgaaactgtagcaagaaagctttcataagaaaccctagtcgatgatgagaaaggaaggatcgggcgagacgacacaacttgcaaattaatggagatttaattcacgcttagatcgatcgatgtgatatgcatacttgagctgtgcgccgacggcggcgaggctgtcgttgccgaagacgagctgcctggcgcggttgagggtttcggtctccctctctgaaagatcaaatcccaatatcccacaagttagaggcaaagggaatgcgagattagatgcatggaagatcaaaaaattgaatctttttcttaaggatataaatggttactgttggattagaatatattagatgcgtggaagataaaaaaaacgaacttcttcatatatttgtgatcgatcaaattggttctttgataaaaaaaatatcgattatatagctaggtaggttgttgtgtgatattgccttggcggtggcgattcatgtggccacccagcgcttgagatttgcagaacttgagggagcagaacctacactcgtacaccttgccagcttcatccttccctccattactcttcttcttagtaacccctgtaaacaattagctaatcattcagttatcccattctgaagctatgtaactgtacttcctttatctaaaatgcaacaattaaggttttcttttttccatgtaatgatcgagacggttcaggagaaaattttaagtagatgaccacattcagacacacacacaaaacaaaaatctatcttttttactctacattaaagctatatatgtactagcatttgctggttatgaatgttgcagtgatatccttactggatgcttcggcgctggatgcggcggtggtcgttgagctctccaccgtttgcttgccgaactcatccggcaggttgttcaggtccagggggctcccttcttgtctccttgatgagttcatagcgaagaagaagaagaagaggaaaccatttagtacgtatatatacaacttgttgaagatacagattcacagatggatcaacaagttcctgtttgcacaatgatgagcacacaggaactcaagagcgaggtagcccaacaagatgccgatagaacacaagtagtagtgcactgtgccgacaacaagaatgaatctatgcatagtagttttatatagtactagaatgacatagtagaaaacaagctgttcatggagatccatagtaggctagatagttgtgataagtaacaggagctagtagtaaaaatgcaggtatatatgatgtatgcatagaaaagattacaggtaatatcggatttacacacacaaacagacacattccagagtgactgtttggaaaaaaaaattgctgaaaaaacaagacaagatttgtgcacatttaaacaagacacacaaagacagcagtgtttcagagggaagatgtacataacatggggatgaacaatagaagaagacacaaaaaagtcatgaggggtagttgtgcttgtaggcttccttcttacatggtggagcagagagcagcagggagagaaacagctgaacactatgatgcaaatgaggcttttggaaggagaggcccgaagaaaaagaaaagaggggatcgagatatatatcggatgctgtgtgtgtggggtttgagatcgacttgagacgcgttgagtagagctctcatcagctcagtgatgtgcctgactgtgtagagagaaaagagtacaagtattattgatttagtacatgacacaaaagcaaaaagacactgcagtttgggaacagcaaatgcattggggaacggctgtcttaaaagtgttggtttggggtgtagatagagtgagagaaccagtagtagagcttggtagctggggcagagaaaagcatgaaagttctctatcagttcacctctgcacagccgtccctttctctctcctgtcacacattcacatacactggtacacctacgtacactactaccagtactacccctctctctctctccatctgattaagagtgagagagtaagatgctgcctgtgcatatatgattcttggagtatgtgatggctgtaatccaagtgcgaggaatgcagtatttgttgcgttgttattattatctatccaaagagagatcgatcgatcgagatcgaggaggatcagagaagaggacgtatggtatggcgatgactgtatgtcaatatgtgtaggtgagtgtccacactattagctgtagggcagctgagctgagctgaaagaaagccccacagccacagcaccactactctcttaacactgcactgtagtatcactttgtaagcagcaatgcagcagcagatatgcatgctgctgagagtgagacctctcttctctcctgcatatattgaatcattaaatagagtaagctacgccctctttttctttagatcttgtgcaaagggatcaaacacacaaacatcacacatgcatgcgcacacacatctgtacccatatccatcatctagtgtaggttataggcctatgtgtgtcctttgtttgcatctttctccttcaacctgtggttgcattgtgtaggccatatgcatgcatgcattgcagagagctcttgagaagaagagagagagagagagagagagagatactagagggtaaggtaataaagacaagggcacctcttacaaagccctggttctgaatttagttgagaaagagtatgcacaagctaggggcccctataggcgcatgcatatggcttagcctttgaggtctagtaggatgcatgcatgctaggaagagctgttgtcaagtactgggagtttagggtagaggaggccagggaggatacatgggcagtaaaaagtgcctttggagggatgtgtgtatggaaaatgtgagacaccgagaccttcaccagtacaagtgataggacctgtgttggatagtgctaatgacattgacatacatggttttcatgtgagatctctctccctctccctctctctctctcccactctttctctctcacatacacagtcacacacactacaatgggttgcaacattcaagcaggtttgtagcactggcttggcctggccatgtaagcccagacaaattaatgtaggcattggtaggggatgagatatgatcaaacaagaaaacatggacaaagacaagactagggtttaccttttccttttgaaaatataaacctctcctcactagtttaccaaaaaactggtgaaaaccgacaacttaatttctgtaaatgtcgtacgaaaataagaaagaactagtcggttttgtgaaacctgctttaacattcatataaacaccggttgatttactcctagccaatcttcgatacgttccttccatgcttgggagacatataataccctaagagtaaggacaataagaaaataaaaaatatatataagcatttctgcctatgtatttaaacactggttagatacatagccagcaatgcttatattttaggatgaagggaaaatatcattaatatctaacccacctccgctcattctcttacaaaatttgttagagctcgtgctatagctaactatagattttttctcgatcccatgttgtattcgcttcctttcaagtaaaagaacaaaaatggttcctcactaaattaaggcccctagcaaaagttcacatgatctttaatttgtagaactttcagagtaattaggagtagttaaatttcagcatgaatatataatcgggcaaaatctcacatccacaacatactccaatttgtgttgagttgaagagaatggaggccctatacttactcgagggagcaaattaaagatgaaaaaccttttcaggcatatgcttaaatttgtcaaagattatttcatgtttaatgtgaaatggtatatatgtgtatggacaactgatcattttccatttggatcttccatcagttggatgctagctgatgtacctggcctactatatgtcttttttttagataatggaatataacatactggcttttgctcaaagagctatagccaattattataatctcacacttaaaataaatgaagttcaaagaaacttaaaagatgaaaccaaccatcaagaagaaacaacctaaaaactgccaacccaagataaagagtacacaattactatatgtcttttaaaaggataattttgacattcttaagaaggtaccagaaggtatcatttttttttaaaaaaaaatagtacctccaaatactatatatgtatctcgaggtactaaaatttttagtgcaaaatttacctcgagatattttctcaagaaacgtaaaatttctccttttaaaaacatgtgtatatgttttctaaaatatgtgtgacactgtactaagataactaacagaggcagtatatattcaaggatgttgggtcctaaaagcatgcatatatcaggactcaggttgaagtgtgtgtccctagctagacgatatgcatgcatgggtcacatattcatgttatgcttgctaaaagccacccatcgaatcttggttaacaatacacatatatatgggtgaatagctaatttagtccctcaagtctcatcgaaggctcaatttgatccttcaggtttcgttttgtccacataggtcctctaaatatttgttttggcttaaactcatccttttacccacttaatatgttatatggctatttctagttaacatttctattagaaaatgtcccttttgcccttaatttgtaacaactatataatagaaaagagaaaaccaagatgaataaacaatgttgcatatgaaaaacccattctttcaacatgtgcacatgaaacttaacctaatggctatcg

SEQ ID NO: 14690 - DNA, 3833 bp, Oryza sativa
ctagttaacatttctattagaaaatgtcccttttgcccttaatttgtaacaactatataatagaaaagagaaaaccaagatgaataaacaatgttgcatatgtaattcccattctttcaacatgtgcacatgaaacttaacctaatggctatcgtatacacttgcaagtacataatttattttcgttgtacataacttactatgcattatctataaaaaaaattcattgcatgcaattttttctcttatataagtgtatgatggggtataagtgtcatttatcgagagagttgttggttatgtttagccatgtggcttttaagtgggttcaaggataagtttgaactaaaattaaaacttgaagtactaatatggacaaattgacacattaaggactaaactaagcctcagatgaaacttggaggaccactttggctattcaccccatatatatcattcaaacgatacataaatcgacttgttgtaattgtgcacaactaactaacatttgaccaaattaattaaggggatgtaactcaagttagagccaggagatggatgcatatagaggagcaggcatggatggcagggcaagaggacagaaagaaaggacagggagaggaggagtagtgaaagatttgcacagtgggcagcagggcaggcaggcaggccaggtttgcagctctcaggggtcgtcgtcgtctctctcatctcatgtgagggaggccagaggtagaagacaacaagcaggagcctcctgatcgatagagatacctctagtgttgcattgcattggcgcccccctggccctgcatactcctgccatttcatgcagcattagctacacagatatatacactgctactgccactgcatgcacctctctcgctggctgcctcttgctgcagctagctgcatgccattgccatgcccttttaatttctttctttctctctttctcatcgatccatcgatcacctgtatgaatgccgtgcataatgcatcgatctgatgatgtgtgggggtgtcactggcatctgcatctgcattgccaaagtttttatatatatattcagagaactgatagatcgatctcctgggccccgtatacgcgcgtctccctcaccatgatccaagtatccacccctctcgatctatcgctttatgcatcgtgtgtgtatatgtatgtatgatcgatcttgatcggccaccaaattaaactatagcatgcatagcagctgatagctgcagtcatctgcagcagggcaacgatgcaaaaagctcatgtgcatctcgatcatatggtcaatcagtacgcatgcatatgcaattatggtgtgtatgaatgcatgcataaccgagtgaaaaaaacaagtcaatgctcaccgttaagttgatcatatcaactgcattcaaaaacttgaaaaacgtgtgtctctcacatgtaccgaacgcgtatagacgttatagtcgaatgatacatatataaacgatgttcttgattcgtgcatggatatatacaagaacttaacatcgtgtgtcttctttatattgcattcatttatgttaatttgtaattcttatgctattatgtgaaacccgatgttagtattgatatataatctaaacttatggtgatatttttttcgttcttctgttgaaatttgtgcccataataatatacctgctatctatgattctaccagcttgctatttgctatttattaccttggttaatgggttaatacaatgagaccaattttcctcacttagggcaaaatcttcatcagcacccttataaactaatattcctcagtgctaagtgctataaggttgtctgtgattctttgttatgtgttgtgattctttatactacgtgtgtgtgtatatatgcacttgttttcctggtgatgctaaccgaataggacttggtataattcaaaccaagtcctattcggcccaaaaggatatggccagcggttctatttttttccttggaaacagacgggagtttgtttctttttttaaaatcgaaaagattcgtttttttcgcccttttttttaccgcgtcgacggaatcggatttaattttttttaccgtgtcacattttttttaccatgtcgcatataatcggattcgattttttccgctcttttttcatgaacggacgacggaaacacttctaatttcttagtagagattatccggctagctgcctaaatccgaaaaaaaaacaaaactagttaaagtagctatagttggatcatcaaaatccgaactcgatcgtgtcaatattggttaatcgacacatcaataaacaagttttattatgcaagtatacctcataaatgtagtcgtcggcggcaaagaactaaaaaaagaaacactaaaagatcttagggatggaagacctacatgagtaaaacgaaagataggttcccttctccctcatcgttgtcatgagatgataatgtgtttgttggtactctgaccttagatgaatagatgagataacatgataattcattaagggtatgtatagtgtggcttgtgtaagctcttttagtgaaagctctgctgatattatgtagtttcaatgtaacttttaaccaattggaactataattgcatacaagctagttttagaattacattgttgttgttcacctcctcggaggcttcgccttagggttttgctcttcccgcggccttctgcggttcgtaatcttttttgcctcaggctttctgtgtcttttgtgtaaggtttttgccggtttcactttagcaaaccgtgcagttgtatggtttttgggcccgttccttataaacagggtcaactctatcattctaatatattcggcaatactcttgccgcttccacttaaaaaaaagaattacattcaactcagaaatggaggtgctcatatttggactaattaatttcacattagtttgtgccttttgatctggcaaccaatatttataattagatttaagtgcgagggtaccggaggacgtaagtagggagtaccggcgtcccttagagacactgtatatctctgtgatctgtccaaactatatatacatggggcttgcaatatctttgtgcaaaaaaacaacactacctcaaaaagcaaattaacgtacccctgccaatcagtggtcctcaatcataggctagctgaacacctacttcttacacatctgatcatcttaagtgtcaagcacatacactagtactagcactgctagctttgtaagaggtgtcccttgtcctcatgcagcactagctagcaagcaaagtcattcttgctatacccaaacccaacccaagctagggatgagatgagagggcttcactgactcaagcttgtcaaaaaggacggcgttcattctcaaaatgtcaacccacaggcctctcccattcattgacatcaatcttcatacatagtactatcatagtaaaatgatgtatatgtatatatatgtgtagtttacaaacgaggtaataaatagcttttgtagcggtcattataacgatagtggatttttacactggagtatatagcaacctctattgcaaccactacaagtagcacaacaaatatagcattttagaacttaatggccgttattgctcttaacgaccattattggctttgttgggctattattacacttaaacaatgttcttcacatatggataggagaaacttgaaagacaaagaacagctatagagggggggggtgaatatagcaattcaaatcttgcccccgaaaatactcatcaagccggatttctcaaaatccttactagaaccgcggctattag

SEQ ID NO: 14691 - DNA, 2252 bp, Oryza sativa
ccagtgcatgtatacaagctcctcttccattctccattctgttcgcgaacccggcacttgcacttgaccttgcgaagtccgttgcgaagacctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaatctcccccttgatgggaacattgacaatcccaagcaaaaattttgaaaatttgatttttgattcacaaagcaaaccattttgcaaacgtcgaactttggtcattttgaaatcgcgaaaaatcaagaccaagtgaagtgacaagaagaaaagggatgcgaatgcaaatgcaagaatgctccccctatgtgccaaactccccctttcaccaagatctaaagcaagttttttaattttcaataagtgcaaatttctctccccctttgtcaatgatgccatcaagatcaaaagagacaaaaatgcaagataaaaatgagatgaaacttacaaattttagtgttttgagagctttgagagttatctaaaggcatcaaaaggtagacatggatcacacagatacaagcatgtgctcaagcctagctaagcatgtgcataagaagtatgaaacaggtcatggatatcaagttagtatcgccagcaagcaaaaagttttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttaagattgttttttaatttctttaaagacaatagcacaatcacgacggtccacctgatcttatcagtcagcaagtgatggttgtgccaaacactgccgtctgacctcaatcaagtgttccagctagagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatgtaaacatggcatgagtatgagagggatacttcaatttaaacaaacttctagagcaagcattgcacattgattaagttcaaatgaatagtcaatttaagcaggtttcaacaagcttgaacagcataacatgatcacacaagctacttaagcaaatgaaagctagacaagagatcaaactagcaaaagagtgatacatgcatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagacgtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcgaaagatgcgcttgactgcttcgcgatgtgatgttct

SEQ ID NO: 14692 - DNA, 5030 bp, Oryza sativa
aagtcagctctcccatcatgctcatttcaaattccctgctcatcacatcagaaaactgggcaacaagtgcatgagaggagccaccaaatatgatgtcatcaacatatatctggacaagaaaaaaatcaatgccactatgaagagtaaagagagttttatcacctgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggtttcttcaaaatccaagccctcaacttgggtgaaaccctgtgcaaccagtctggctttgtttcgaacaattgaaccatcttcacctagtttgtttttgaaaacccattttgttccaatcacattaaaacccaagggtggttctaccaaagaccaaactttgtttctttcaaaattttctaactcttcatgcatggcattaacccaattctcatcagataaagcatgacaaacatttttgggctcaaaaaaggcaacaaacgctgaattgacaagatcataagcccgatttctagttaccctttcacccaggcctccgatcatcgagtcaggcggatgtcggttctggatgtgtcgggaaactgtcggtcataatgtgccaccatcaatctcctcagctgctgaagatgatgtagttggtgcatctcctgaaggtgatgtagtcgaaggagaaccggtttcttgcactggtggtgtactgtctagaggtgaaggaatggaatcatcgtcatcatcatctgaatcctcatccacaaagatgctttcatctagaacacctgaaatttctggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaatttttgaattcagagccattatcactgcgaatggctcgaagagcaccaggaaactccaaagccaaactacgagcaagagactgaaagaagccaaacgtttcctcctttgattcaagaaaatagacccaagagtagcgagagaaatcatccacaacaaccaagacataccacttccccccaactgactggacccgagcaggaccaaccgtattcatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaacgagacaacgagaaggaccgggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatcattcttcccctttcgcccttgtccctcgggcttcttggtcgtcttgtcactcttcttcttcaacttgggacaattcactcttatgtggttaggctctccacactcaaaacacacaaatggttcattggtttttcctctctttttatttctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatgacgagcattatcattatcagaaaactcttttccaacagatcttaacttcgaaacaatttctccaaaacgcttgaaataagaatcaatggactctcctgggtgcatctcaaatctttgatattctttatgaaattgattctgacgaaccaattgaatatcattgtttccctcatggaaattgcacagagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagacaaagaacagctatagaggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaatggacaaggcaaaaatgaaatccttcaaatcatttcatttataggtgatgcaaaataaccgctcaactaggagcaagcatacaccttcagaggaacattaacacaaacttaaaatctctcagacaaacacactccaaactaatcctaatacaaaagcctctcgggcaaacacactccaaactcacaccgaaactctctcaccgagcatctcaaaaggattgccaaaggagcaacatccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagctgccacgtcacgcctcagcacgcgagagcgcgcgctccaccgcgtggatcccacgctcacctgcgcgcatccagtccaaagcctccacgcgtcccgccgagctgctcccgcgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccatgaggaagggctggattggcttggcctccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatg

SEQ ID NO: 14693 - DNA, 14970 bp, Oryza sativa
gtccaccgtgtgcaaccttatgtccaatcttgtcacccggcatccttgatcgctttggacctcaactcctccctgagtctagtcccgatccggcgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaaaactaaggtcgtgttgagtctgaactatcgcaaaagctcgatttacctccctctagatacttaaataccggaagttcatgactcttcaacttttcaaaccaaacaagtcaccccaataacccaatccaaagtggttttagttctatgtggcatatacattgtctgcctcggagcacactttgtgacaacggcatgacatggtagctgtcaagaagagcgaaggaggtccctacatcttctccatggtgccaacggagaggagtgcaggcggcaacatagtcgacgctaagaggggacattgaagtacgtggtctccttctagatctgaccgatgacggtcctcattgggtgtgcagctaacctccctccatcgtcactgagccaagcaccacattcccctcgaggacaatgatgagctcgaacattgtcttgcctcacctcctatctccctctgctctcccaccctccttgttgccaccaaaacccactcccctccttgctcggtcttgtgggccctgggccctgcttccctcattcctaacgatggtggcgatggttcctcgatgcgcggtcaagagaactggggcaacaacggttctccttgttggtgttgaggtagtggtcgtgtcctcttgcttggatcaagatttggttagagggaggggggaggaagaagaagatagtgataagactgacatgtggggtctaatatactttttaaaatatatcgatggccttttcattggttggacagccgcatagcaaaactatcgccatatgtaggagtaaaaccactttagtttgggctaaggggaactttgtccagttttgataagttgaagggtgtaaaatgtctggtattggtgttgagggtgtaaatcaaacttttgcgacacttgaaggggcatgtaggacttaccccttatatcttattgatgttattttataattcttatgctatgaaatgtatctaaactttatgtgaaacttgatgttactattgataaataacctatatttattttttttataacttagcatctgtaattgcactcgctatccacaattcgttacctatacactactccctccgtcccataatataagagatttaggagggatgtagcgcatctagtactacgaatctagacagatagtgcatcctagtactacgaatctgggcaggctcatgtctagattcttagtactaggatgcatcacatcccttcaaaatctactccttatattatggaacggagggattagtccaatgtcagcccactatttgctatttaattattactaggagtactttgtttacaaggttaatatatatatgcaatgtggattgattgatcttaagcaattttagagatataagatgaaaactaatcttcctatcctatcataataactttggggctcgcaagaaaaagttgttgccttagcttattagcagcacccgtatcgagataggtcactaatgcgtgtttaattaagaattccgtagttttaggatgtgtcgtcccatccatctaagatcctttatattttgtgacggatggactacctatcataaacataaaatctagatttgttttatttttaaagaaacttttatatagtgattttttttaaaaaaaaacatttaacaatttagaaagtcctcacgataaaatagaaagtagccaagcgaatcccagatcagcctataaccatatatactttaacaaataaaataagtattccctatacatatatgtcatttagtgattattctaagctagttttgggctagagttcaccaaagttacaccacacttacacaccggctgagaataatcacaaaatgatctggtgccaaaggttgatgttcttttttccttcttgcaaggaaaataaactctataaccctccatatatatatggctgaactagtaccaatcatctcgaccaacagcagcagcattgcgctgtcgtcctcctacatctacggtggatcaatgccccagtacctaccactactgtcttctttattttctttgagaagaacttcacttcacctctagtggatggatggtgcaattaaatgatgctaatcaaacacccgtagctatagctagtaaatgcaaaaaacagttatccaccatgaaaaaaggctctcatcttctgtctcctgaagaagaaaaggaagaagacgaagatggaatcgatcgaattcacaccaaaattggaagtttgattgaaattggaataatgtgatggaaaagttagaaatttatgtgtgtaggaaagttttgatgtgatagaaaagttgaaagttggaagaaaaattttgtaaatcgaccaaatgtcaaaccaaggtctctgatgcctggctgctactccatcagttgactttgcaacgggtagccggccggtaagccatggcagtagctaagataggaggcggcagcaaagcaaagtcactgcaaaaaatgctttgatcggtgtgcatgtccactgcaaaaatgctttccaatttaggcgccacataaactggtagcctttcgccgtcctaggctctgcatggtccgtgcctttcatgtccagggacaccaacgcctgaaaatgtggattgcagtaataatggaggaaaagataggacggcaatgtactactccctcattgtaacgtttgaccatttgttttattcaattttttttgtaaatataaaaaacgaaaagttgtgcttaaagtattgtagataataaaataagtcacaaataaaataaataataatttcaaaaaaaattgaataagacgagtggtcaaacgttgcaagcaaaaactcaaaatcccttatattatgggacggagggagtatactattgcaggacattaaccatcaggcataaaccaaccacaagaaacatgtagtacattcatttgattaggaatttgtgattggagtatatctcttctcttctctcctgtccagttcttcagaatacattgcaggttggatgcaagaacacaaggatttcaggattcacctaaattgtctgtatgtattgatgtgtacatatatatagattatagagtaagttacatggactgattggtctttcagcactacaaaatatactgcactgagtcttgagtttgtggtttgcttgctgtgtatctacttacatggtaacatatctgcactatgctatattcaatgaaattggcacactctgtgccggttcgttcaaaaacatatctgcactagagtatagttctatgtaaataattcaggtctttgccaatgaatacaactgtgaaggctattctttgttcctgtgtattggttgttaactagtagggcatccttgccggaccagaggatgttctgacgatttcagaaccaagctcttgtattttacgcaacaaagccgctttctcccgctcaagctgctgtatgtacatgtcttgctcatcctggatgctttcaatctctgtcaaggccagtgacatggcctctgtgtcgccaccctcatcaactaaacctgtgaatttcttcaggctatctctcatctgttgaaaaaaaacacatgatgttcatcacaaaattgtcatgcataccaaagaggatactgagaggaatgtggcaatattgttatgcagagacatcgttcaaacaaaccaacgaagcctctcacctgcgatgatatcttgtgccctttgccaagggaagatgcatcagtctgaaagcttgttttcttctccaagtgtggtacttttcgcgtgatctttacatggacttctccgctttttactccttggagtggtatccattttacggcgggctgatttggaggaagcatgctgtattcgacagtgcattggcctatactagcagttggaaggactgcattatggtccttgacatgtaaaatcaggggttctcctgtttctggaaactcaaatgtctggttccaatctggagagagtgttttgtaaacaacctgcatggaatgagttactcagaatttctgatcaaatggattgttttttatagggcgattcatagtatctgtagaacagaatgaccatatataattctccagtctccaattagcgccaaaaaaggttttgttttttccttttataataacatactaaaactaacgagctattgctctataggtttcctctagtatgtgaggaggtaccacattttcaagagttaattcgtagcacctcgtagaggacctttgaaaagcccattttcctattgaagttcttatgttattctaaaccaagcacggactgctacaggctgaaagatttggactaatctgaattgatcatatgcacaccatctgaagatgccaagtgctgtactgtgtcagcatatttgttcatttctattacttcaaaacgccaacaaattcacatttcgcatgtcagaaaagcaatgcatgctgcatttcctaataaaggcatagtaaataactaaatacagaaaggttcaccaccaaaccttagttcgcttcttcttgctcccataatgcaccctgacataaggatcactagtgcctctgagatcagcagcaataagatccctagcttcaattatcactagctcaatccaggtagcttcaactctaccacttgaagtctgcttaagaagaacaatacagaatccagagaaacatcagtagacaaaatggtacaacagagcaaacggtataaaactaatgtttggtacagaatcaaggatatagaacatgttgctggaggtttcatgtgtagaaaaatagttgtactcaacatcccaaatttaaaatttttactgcgcatcctcttaagaaaaaatgtttctgacgctgatttcgcaaatgtatatatttttctgaattaagaatcctcgcaatattaaaattcaatgcttaaggaaggcaaataccttcaggataccgttgaaatcactctttattggctctatttgaagcctgatctctcctgaatccaccttttcaagtggaacccatacttcacggctatcaccatctaaaagtccttctagatttactcttgcgctgccaatgctttcgtctccaaatgtatctgcactatagcatttgatcttgagatattcaccaccagtgatctcatcaaactcgaatttatcattccaaaccggtcgagttgtatgagatagtgtttttgttttgtatagagcctataaaaagaatatgggattagaataccaacttgtataatagtaagtgaagctaaactttgggcaaggtaacaacaaacctttccatactgcactttcacatatggatcacactttccagatttaccgttaactgcaagggctttaccctcaactactgcaactctgagtttccgtcctgttctggactgaagcttgggcgatacatcaaatgaagagtgggatccgttgctcagagaattgctcaacgtaactgagccatcagagaattgccattcttttagcacaagagtgacagttaactgcaagggaaagagtttggaacagtattacacaactatccagaccaaataaactagaaaaggagaaatggcacagttaaccagttcgcagttgaataggtaggtgaaaaatgggcacattattgttggaaccttcatgaatgtcacggtagaaatgataaaaggaagttctccactaaaattgttaacttgggaacagaaacatcataattcatcatcaaaaccccacatttctggtcactctatcagtagtctatcctttatgtattatatctccagagctctcaagcccaactgaatgaaaccattgttacttccacaggttgtttctaaaaaaaaagggctgaacattttcctgatcctctctcttccgatcttgattccaaaagcgctaccaattcaacaggtcgaacttactcttttgtaatttataaaacaacccaactgtaaataaagttcaacagaaaatcaaatgtaggactatgggtcattagaactttaggctatacaagtagctgaggacctgaggtcctaaactcctaaaatctgttacttcacagtttgtatcgagtatatcaaatatggcataatttcaaacctgataggctagtgaaaatttgcttcggtggcttgataaaactaattagcacttcaatcaattgggaatccatttttctaaatgttacagcatatccaaaacaggttttggatgcaagagaaacagtgacaacacatcagtagttactatagagatgtacctcgcccctgatgtcctcaaatggaacaaccattccaacttcttgtccacaaagctcagtacgttttgcaacagcaccagaattatgtcctatagcccaaaatattgttgaatcatctagaacatacttgacctgtttacattactttcatcagcatcctttagatgtgttggaagaaccacaactgcatcatgtgcaatggaaactgactaaaataataagtttaactgtcatacctttatctcgcagcttgtcaagtaggtgaccttaacaccaccagagtccaattcatacagattgaacttgacaacacctgtctctccatgcaataccaggttaaatgtgctattccatgcagggtttggacccttgcttgtacttgtttttctcactaaactaccaacttctacctcaataaatgtctgtgataccttgttatcagcaattccagatgtagaacctccacttgagctttggcggatccctatttcattagttgtgtttctcccaacgttactagctgaaacaactgtgactgaaagaacacctccaactgctcgtttccttaaatctactggtggcaaagaaaaacacaatctgcgaggctcaaccattgtcttcactatggtttcggtcaaaagcttaacctgcatggctcatgaagcatcacatttagcattcaaatttcaatacgcaatggccgtaattgcactaaaagaattgcaaagataccaaggactaactaaatggcacacacaaacccaccagccatgttgagacaccgggtagctccataccaggaactgcttggcttccaccacttccaaatgccactcctatcctgacttctggagtggattcaaaagaataaagaatagcttcaccatcaaggatgggtaacagtagaagctgcaaagatatagtttaaatcgaagaaaataagagcttaatctgatgagccaactagaaaatgcgcttagacaagaaaataatcgtcaaatacagatataatactcaggacaagaaagcaaataaaagattttaacgtaagtggtgatccaagttcttatccacacaaaatttattgtgtttcaacaaaacgctaaagtgaaatagctcaaaataaggttgccactttatcctatgtgagaggcaggttaactacatcataatatcctatgtcaaccattaaggacaggaatgactccgaaaagccaaaaccatttttgttcatcatgattgttcattatcagctttgcgatctcagtgagcaaagctggcgacaattcttgcttaccaattcaaaagaagtctctctcaaatcaagataaatgagaaataacaataacaataacaataacaatgtaacagaatcaattgaaagagcaaaggacatacatctcccttgatgtgaatgctgtttataacaattcgagcagcgccaatcagtggttttgctaattttgccaaaaacattacactcatctcattgctgtcccaatcaaaacccaagcgcatgactttctgcatgttcaaaaaacgagagttgaagtgtgcaactgtacaaccaacagaagtatttcatctgcctctcctacttacaacataatattgttcaagatggaacaactaatgactaaggctatgcaggatcaggaagagctgcagaacatgttatatattcctaacagataatggaagaacacatgggttagttccagataatggaagaacacatgggttagttatacagatgcatagttataatcagaaaaggtgaataaccatttgatgacacggcattcgttagtgttttcaatgatgtaaggataagttaacaaaactagtacccaaacaagcacaactcggaatttatgaagcagagcaaataagctaaatcaccgctgttataattctgtagaactaaaaacagcataagcagttctttcaataatgatcagtgcctgaggcaatgatttcctccctctctaagtttaccacaggtgagtatcccatacacagtacagaatattaatatctgacctggtcacctgaagtcatccagcgcatcccatgctcccccaaggtaggtggacaacaaccaagtgagaattcctgtaactctattttatcctggagagatataaaagcaaatcattagtactacagtcagaatagcagcaggagaggataaacaactttaagagaacttactattagttttggttttcgatgctttaaacgtttctgcaaattcagagaacactcactggtcagctggttataaaaaaagcagaatagaagccagtgtgcaccatatcttgcaatgcatattgactatttgactacaacaaataaataggagcaatggagctgagaaaaaaaaatggccaggccggcagcgaagaagtgccccagccaattttattaagattggagaaggttaaaacaattgggcaacaaacatggttgttgttttacaacaagctgagaaattttctaatgaattttattttgagataatcatcaccaaagaaactcaaaaggtatatttccaaaagcttttaaaaccaataattattacatccaagcaaaaactattagacgtaatagaaactttcacaaatgatagcaccttcattttctagcatcctagtgctcaaaagattcataaaattatctagcaaatgtgcagaagctgacctcaacagtagattgaaacttctttgacagttttggttccatataattgggccaaacttctaccaaaagtttgttcaaccactcgcaaggctctattggcgtcgtaggctacaagagatacaaaaggggtattgctaaaagttcatgtataaagagcaaaacaaaaaaaaataagtgaaggaatatactgttgtattcagtataagatgcttccatcgtttgttcaaatcttctatggctgacctccttttaaacctcccatactgcattcatcattaaaataaaaatagtaagaagacaaaataaactctagaaagtggggcgaggtgtttctctgtgttattcttttcagaattatgaacactctgcaactcaaaagaatagatcagcacttccaaaccaagcaacaagcaatacttgcagtaaattagtactatctcaacacctagaaaaggactatttgtctgacaattcagcaggacatcaaagaagccaagccaaattcatcaaagaacaactttatccatatgaataccatgggaaggaaaaactacctgaattgttgcccatacagcagccaacaggggaacccagtttgagaatggcacaacccatcgttcaacaaaccatgcaaacaagacaagagggaccaggaaggggagcaagggctgctccaccatgacctggttgaaaaattctagtgcatccttggcatgcaatttcttcagcttcttcttcgccatctctcctccctgctgctctgtgaattcagcaaagctctcttctctgataaccacacagagcttgatgcagataccttttgttgttttttttggcctttgtttccactgcttcccgagttcctgtcactggccccttttgcactgtgggtattggatacctgtccacctacaattttggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtggctccactccacgcacgcaatagggaggagttgaaaaaactgcagctttcccccttcagagttgctacgaattccacgaactgcttccaagatgcctcctttccgatccaatccgccgcaaccgcatccggcgaaatcaccagccttccccgccggcgactgttcttccccgcctcctccaagaggggaagttggcagaggtcaaactttgcaagtttggaatgattctataaactccaagaaccaagaaccagggtgggacaaaggggggaaattttattttttgtgagttgaggggggctctgatttgttggaactggaagcgattgggcggcagaatcaagtagtagtggatttcagtgtgctgggacaggagggaacgaacgcgtcaaaatcgggctcgtgcgtgttcgtcaatcgtcagcggcgcagcgctcttctgtgccacgctggctctcattggtttgtactcctactccgtagtaccttggaatgcgactgatttttttgatcgatctcttgtttgtttctttgggttaattggaaccatgccattacaacttcagctatttggaaatatgccattacaattagcaaaaccggctgggtgccatcgcaatttcttccaaattggaaccatgccattatatacgtctgaattgccatccatgccatttgtcctcgcacgtatttccgtatggacgcttgtgcccctggctgagacgatacaagccaaccatcccggtccggctcaaccatctctgttccccattccctattccccattgtctgcaaaccctagctcgccgacggcgatctcgacggcgatcggtgcagcgccggcgacgacgacgggggctagggatacggcgccggcgacgacgacgggggctagggatacggcggcggctttaccgatagcttctcccggcgtagacggatcaacgcggcaacgagtttggaggcgagctataccagtggcagtggtcgctctgcaatttcgagaaggtgcagagtcccatcggtggctccttcaatcccagagctgaaatgtgcttgtgggcatgccgctgcggtgcagacatcgaacacaccaaggaatccaaggcggcggtggctgcagtgtcctggggaggtgagaatccagtcctacttgtgcatatttgtgtgtgattttctttctgaatccaatctggtttccttcttgtagaattgtagatgtgccttgtggatttgggaagatctcaacgaatacgttgaggagatggtcgcttactgtcatgctgacgagtacgactatcttagagagacatgcgacagtttgcgccagtttatagcagatcaaagacatgcatatctctcagttgtcagcctaggctgaggcaaaagagttgcagttgcaagccaattacgaagctttgaatcagtccaagttggggtgtgcagacttaaagaagaaattggagtgcgagaaggcttggactcgcacaattgtgtccatgatgatcttgttctatgtgttgttagttgctgtaatgataaggcaggtttaggagatgttctgtgtgatgtctggtgtgtgaaatattgtgatgtaccttaggtgtgtgaaatctggtgtgtgtatttatgtttgtgcaagttggggaatgcaatgcaagggctatattttggaatctggtgcaaataatctgctgcctaacatagaagctgtttatgtgcaatggtgactgaaataaatttgctgacataaatgacataaacttactgacataaatgacataacttgctcacataactgacataaacttgttcagaagtgtagcaactgacataacttgttcaggagtgtagcatagaccaacatgcagcacacaaaagacagaacatttcaggtttggagcccattaccatggccaatatctaacaagtccaaatggccatctacaagcagcaaaataaacaagtttgggtttttacatcacagaccaacctagtctgataattttctaactactctagcgggtggagcagtagaagcaacaagattcttcctcttctggggagttttcttcttcttaggagtatttttcttcttgacaggtgcagatgaacttgcttcagctgcagctccaggcactcctttcttcttaggagggtttttcttcttgactggtgcagcttcggcctgacctgcagcttcagccacttgtctcttcctgcacacagatagtaccattagggaagttttgaggtagtcaatttgtggactaaatagaaagaagtccaaattacctttttttggttgttggctggattgtttgctcatcttgatgaactggctcagcaagtttgcatatcttttcaaagtgaccaaaaccctgacatctcttgcatgtaactctcttcctgccaggttgttctaaacaatctcttattctttgcactctaggtcttccagcacctctcttctacctaggtgggtataccttgaagccaagatctacatgtggccactgagacctatcagtcattgttgccactctagctgcataagctgctctaaaggtctgaacactatagtagggactgacaaaatcttggattcgacctctgttagtgcaaatccaggccaatgcatgtttgcatggctttcaacttgccataccctacatgagcagttttggttctgtaaatcaactgtgtgccttctagtgttgttgtcagactcaacaagtgtcacttctgcgaaaccttcatcgcttctaacggggatcctttagtcgacctgcaggcagacagttgcatcattcaattctttcattacatttggcaggatgccatccacaagctttttaccaacttctctcctgagggccatcttctccatgatcatctccctgatcccatccacaagttcatgcaacaacagacctttaagcttcttgatctggttattgaaactttcagaaacattgtttgtgaggtagtcacacttgctagactcagaaaagccacatctgtaccaaatccttgagtgatgcttctcaagatactctattgcatcagacctcacttggtatatttgttgcatgtaccacctaaatccatcctcagtataacttcttgcagttggatacaggtgatcagtgaaggcaggaccttgaaacttcttcatgaagttagcatagagatgcctcatgcattctctgtgctcaactttttcaaatgcagcatcaacagctttttccaaacccttacaagcatctgttgatataactaggccctctggattatctatggccttattgaggtgtctcatgaaccataaccaattttcatcagtttcagagtcaaaaattgaataggatacatagaacaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcatatttaccatgtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgcctta

SEQ ID NO: 14694 - DNA, 3235 bp, Oryza sativa
gtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgccttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatctacatgtaaatacgatgaaatacccaatgcacttctacatcagctatccaaggagtatattcgagttcaagttactcacggtatcgaggaaataggaggaatcgagcctcccagatccatcccctccatcggcaatttcgctgcgcacgatgatgtcgcaggtgaacttgcgatcttcaggggaacttctacatcgtgggtcgtcgtcgccggcgccgtatccatagcccccgttgtcgtcgccggcgctgcaacgattgccgtcgagatcgccgtcggcgagctagggttttgcagacaatggggaatggggaatggggaacagagatggttgagccggaccagggggggctcgcccagcgcctctcagagatgaccggggccctcgagcgactccccgaggagctcgaggagacgatcaagtcatcctcgagggacctcgcccggggggcggtggagctcgtactggcaagctaccaggccagggaccctgacttctccccgtgggcagcgctggaagagttccctcccgggaccgaggacggcgcgcgcgcgaaggtccgggacgccaccgaccatatcgtccacagcttcgagggtacggcccctcggctcgcgttcgcgctcgacttcgatgaggagggcagtgacgacggtgcggacgacagcgacgacgaggccgacgtcccgggcgcgtcggagtgagcccccaggcccccgccaatcttaataacttttgcttcttcttccgaggccttcgggcccccttcttgtatagactgatttaatctgtaatcaaataaagaggaaatttctgcgtcagctctgcttgttgtgtgtatgagacgaggatggtctgtgccgcggtccttctttgtcttggcttgaacaagggctcgtgcccaggtcccagcctcaaacggcgcgggtcggggctagtgcctggggagatccacgtgtcgagactggccaggccgggagcgcggtgaccaagggttatggatgacccgattgtgggcctttgccgattcccccccgaagttcaccacgccccggggcacggctcggttctgggccccgtttggcgattttagctggcccgggccgccgagggcaaggtcgagcacgagcgtgctaattcaagccaagattcttcaaaaggaaaacgatggcacagacacagtcctcaagaaatcgaaaatgcttttattgaaatacggaagagaaaaaaggtaagtatatgcatgtggtagcccccggccaactctgcacgcccggggggtgcggggttggcccgagcccgagacatgatacccgacccccactaggggtagaagcgacgaaggtgctcgatgttccacgggttaggcagctctgtgccgtcgcccgtggcgagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggatctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttggggatgttgaaggtcttggttttgaggccctgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttagg

SEQ ID NO: 14695 - DNA, 3578 bp, Oryza sativa
gttttgaggcccttgaggatttccgcgttggcgcgctccacttggccattgcttctggggtgggcgggggaggcgaaccaaagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccatccgaggtgcgtgaggcggagtgggctccgcactcgccttcatggacatcggcgagaaactcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgggaggtacgcctggatctcagtgatccaagcaatcaatctaggggagctgggagcgctcccctcggatcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactcagccatattgttggtcgcccgaaagtcaaggcggaccaggtatctgaggacgtctccgctcggcgaggtcaacatgacccccgcaccggcgccctgaagagacagggagccgtcgaactgcatcaccaagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatttcaccaccgtccagtaccctctcggttatgcaagatttggccgagggggtaagacgtgaccaccgtgacccgatgcgcctggaaataatggcgcaacttcctcgaagccatcagaatagcgtaaagcatcttctaggcctgagggtatcgggtcttggcgtcccggagggcctcctaacgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccgtccaggtaaacggcccggagcatttgaggagcttaaataggggcagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttattggggttcagctttatgcgggcggagcggagactttcgaaagtttccgctagatctgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagtttctatgggggtaatgaatgcagttttttcctcatcctccctagccatgcgaatctgatgataaccagagtatgcatctagaaaacacaaaaggtcgcaccccgcagtggagtcgacaatctgatctatgcgtggcagggggtaagggtccttaggacgtgccttgttaaggtcggtgtagtcgatgcacatccgaagcttgccgttcgccttgggaacgacgaccgggttcgccagccactccggatggatgacctcacggatgaatccggcctccagaagtcgcgccacctcctcacggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaagaaggagacgagcgcgtctttctatttgtcgtccaagagaccacggattcgtgtggtcttggacggcccgtcgcccagggcaacctccttgaccggaacctcgtggcaggtgaccatccgctgctttgggcgggcggaacggaggtggtgagcctctcgtcgccacccgcgggcttggacgccgcggcgaggtggtccgcgcgctgctccatacaagcaagcgcgactttgaggtcgccatgacggtgatggggccccggggcccggcatcttcatctggagatatgcgtagtggaccgccgccatgaacttcaccaacgcgggcctccccaggaccgcgttgtaggacagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgaggactgcacccccgtctatgaggacacgccccaac

SEQ ID NO: 14696 - DNA, 938 bp, Oryza sativa
  unsure (1)..(938): unsure at all n locations
cgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctccccgagcgcctccccccgcccaagatttcggcgagagggggacggtggggtgcgagcccgacggcgcgggttctgctccccgtcgtcaccgctagcgttcggagagaggctgtgcgcccctgcccgttcggccattgggctgagcgggagaagcttggcgcacacgaaagaggacgagggcttagaaagacacgcgcgccccctacctggcgcgccagatgacggagcgtggggctcctcaccgggagactacgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgtgtgaaggaatccagagactcgagagcgagagagagagttcaggttctagccaacattcgccagagtcccaactcccctttcgtcctcccttttttttaggcctgggcctcctttttatctggtcaggggtcaccacatgggcctctagctacctaagaaaggaaacatgcttttacaatgagggctagtctacagccggaagtgacctctgacaagccgagcgcacgtctcttgctccgctcgcccctcttccggtggacgcccatttcaaccttcatttaatggccagcgacttccttgtcatacttgcgctnnnnnnnnnnnnnnnnnnnnnnnnnnnnnnnnnnnnnnnnnnnnnnnnnnnnnnnnnnnnn

SEQ ID NO: 14697 - DNA, 666 bp, Oryza sativa
acactgggtccaaaacgccagaccaagttccaagtgctatggtgctaaccatggaacctcagtgccaatgaacatagcaccgtggtagggaaatgtggccaggagctcaatgccggtggtgacctctagatcgatcatgcagtggtgtcattgcttcgattgatgttccaacaccaattgactccggtgctgctaccgatttcttgctcttccacatcgccattgtccttgtcgagtctcgtcgactctagcaccactacgagctcgttgagatccagagcacaagcttagcctcctacctcagcgtcatgcttattggcgttgaggttggaagttcaatgccagagcacttagagttgaccacttgccacgttgatcatccagcttgaactcggtgccatgatagcagggggttaacactagcgtgactggtgctgagacgttggatcatagtgtcatcgggcttgacgttgagttcgtggttcattttaaaataagtactggcacagttcatgtttgaaatatttcttttataaggatcatattgtcaaaaacatctgcaaacttccaacttttccatcacatcaaaactttcctacacacacaaactttcaacttttccatcatatcgttctaatttcaaccaaacttccaattttggcataa

SEQ ID NO: 14698 - DNA, 1128 bp, Oryza sativa
ccagcacaagggagtgcggcactttcttccgaacattgcctcattcggcgacatctgaatgctggcctgataactgttgttgtatgagaactccgcgtacggtaaacaacgatcccaagtgccttcgaaatccaaggcacacgctcgtagcatgtcttctaggatttggtttaccctttctgtctgaccatcggtctgcggatggtaggccgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcaaaggtggtttttactggcacgaaatgagctgatttcatgagtcggtccacgattacccaaatggagtcgtacccgctgggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttctggatgaatggagtaagcggactcatgagcttcctttaggatgagatctcttaactcctttttggccggtacacagatgcgtggaccgcaccaaactgtgccttgatcgtctatggagaaattggtgtctttcttatcctgattcttttattaactcttttatcccttcgtcatctttttgagcctcccggatttgcgattctagggtaggcttgtactgtcaagctggcagggactcctgactgtaccacggtcagtcttaacttctccaattctctgcacagatgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgtgtgaaaatatacttaagacttttgtgatcgg

SEQ ID NO: 14699 - DNA, 946 bp, Oryza sativa
cccgctcagtctcctctccctctccgggaaaacctagcgccattgctcccccaaatccgccccgaatccaaccgttctttccaaattaattggggggttttaatccccattgaatcctcttcaattccccccaatttcccccttgaatggcgcccccaatcgtcgggaacggccgcgcttttcccggccaccaaccatggccgccggccgccattcccgtcgccgttccgccctctcccgtgcttggctcgcttccctccgctataaaatgcaaccccctcgttccgttctatcgttttagccccctcccgagcctccccgtggtccctagccatcttcccgccgtcctcctctctctcctgtgccgccggccgcctccagccgcctctacctcctcgccggagcgccgtccggtcgcgccgtcgcctcctacagcatcgcagccgcctcctcttccacggtctaccctccgtttcccgcggagacccccggagctacgttcccgccgtcgcccttctctttccttcgcgccggccggctacagccgcctctccctcctcgcccgagcgccgcccggccgcgccgtcttctccctcggcctcgcagccgcctcctctccctcggtcagccctccgtttcgcggggaaaccaccggaggcgcgtccccgccggcaaccggtggcattgccgccacccactccctccagccggctgctgttcctcgtcggaacgccgatcgacgtcgccgtctacttcgtcgacgccgtggcatcgtctccttcctcgtccacccctcggtttcgcccggaagccccgcacatcgccgcgaacctctccatccgcctcgccggagttgttcggccgcccgtccctcctcacccgtgcaccggtcgaccgcacctccaccaccttcggcatcgcagccgcgacgtcgtcctcggcatcg

SEQ ID NO: 14700 - DNA, 1215 bp, Oryza sativa
tgggtaccctattcatggttccactagtatgaatttaggtagatgcttcgctgattaaataggacaacattaggtggttttataactttagactttgggaattctcatatcatttggacattatggaattgttggattatggtggaattggacatacccctctcttcctctttcaaaacccctaaaacctgttttccagtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcctggaggttccggccgtaggtggggttgggtcggtactcttgtttatggctaggatgggttgggaactatgtcacgtctttcgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatctgcttaacaactaaaagaaggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagtaagagaagctttggagaagttgtcttaggtggagtcctggcttataccccagttgagcgcctgtgaagatggagccgtaggcccgctagtccgctgctgtttatttttgattgccaggcctgaagcgcctttgtaa

SEQ ID NO: 14701 - DNA, 2702 bp, Oryza sativa
tttttgattgccaggcctgaagcgcctttgtaataatgtaaatattatcgatataataaagaagtgtcttttatatcatgtttgtgtggtgtaccccggcttttcctgggacggggattaatacactagcgttcgggaaaagcaaattttctcggtcgcgacaaacgggtacttgttatttatagttacttcattcagggctctatagtcgattaccattctctcagagccatcctttttcttaaccagaagcactggggctccccaaggggatgagctaggtcgcacataacctttactctccaactcttcgatttgtcttttgacttctgctaactcattagctgccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagactgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacagaactattgcgggtacggagttgacagagaacatacccatcacaacgtctggagcatcctgggcggtttcagcttggatgtgattcacgcggcctcgaccaatgttgttggaagcacgtgaaccttgtccacttgcctgagagcttggacgagactgagctgccgctggagtaggagttttggcagtgctgccattagcatgtcctgagttggtgttggtaggattctgaggacactgtctaacatagtgacccatctggttgcaccggaaacactgaactgctgacggtccctgcggtgatttgaaagaggtaacactgttaggcgcagtattgccactaggggcatgcttctgtggctgaggtgccggacggtttatctgaggacgaggggcgtagcctggctggtggttagcctgagtgaccgactgatggtattgcatgggttgaccgtagcgagggcgaggtgcgcctcgggaagaatttccctgatggttagacttgcgcttcttgtattcttcggtggcctcttttctggcatcctcaagtagaagtgccttgttgatcatgtgttgaaaggtggggaagtcatgagcaatcaactggagtctcattccaactgcgattcctttcaagaatttcctgatcttcttcttgtctgtgtccacttcctcaggggcgtaccgagccaacttgttgaactgacttaggtactcattgacactgctgttgccttgcttaagtctgttgaattcttctttcttcatgtcaatagtgctttcaggcacgtgagctgcacggaaagccgtagcgaactcatcccaagcaatgttagtgggttcagggtgtgcattgcagtaattctccgaccaatctgcggcaggtcctcttagctggtgagaggcgtagagcgtcttctcaacaggagtacactgcactaagttgagttttctatcaacatctttcaaccaatcgtcagcctcgacgggctcgatggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggttgctgcggcggggttgctcaacctctgcgttgcgggaaacagtacggtgcgaactattgctgtggtgtgactgttcattagccgactcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgaagtcggctcctcagtcgaagaaacgtcgatcggctggcgcaaaggg

SEQ ID NO: 14702 - DNA, 2515 bp, Oryza sativa
gtaggtcgtgctgagtggcctgagcctccgaaagctcaaccatgcgagtcagcactggctgagactcgctgtacggacaagggtacctggcgtctgagtggccagaaggaaggcgtggaagctgccgaaaggcggagcctccgagacggtggctgtagtcatgggccaggcgacgaagcgcagtccaggagaggtcctggtacgcgatctgcagagtgggcctggccacggtgaagtggtgtgggcgaaggccagctccgtgtatacctccacgggggtaaaggtacacagagagctcacagtgagggggaacacggtccacggagtaccccgtgtactcgggacacgagaagccaaggaaacgggagaggtcacgaagctgggcgacgtggtgactctcaccaaacccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaatttaacctgttaatcgataccagtcccaggaaacagtgctggtatcacagggagacagaatatcacagcaacggaggtctctttattatagagtagaagtacagtcatgttgggctgcggacagatcccgagctcacaactgcattacaaaaggaaagcggaagccaggacttggaccatacaatcacaggcgcgacttgggaactaggccgaaaccctaaaactcatcgtagccggcttgctcctggaagaactcctcatcagcaggatccgcttcatcttcttcagcaactggggggggttatttatatagagcaagggtgagtacgggagtactcagcaagccaggggaaataagtgtttaatgcaggcttcaaggaaaggctgttgtttttgcaattgattttatttgaactcttttctaaaagcaactaagtgagtgcttctcaaacgacacggatgagacagtgcgtctcgtccggtcggggtatgtgcaatgtatcagtctttagatcttgaaacagggctggcacccggccaacagcttttcaaacggccacccgggccaacaacttttcaaacggccacccgggcctagctgatcccgtcagctgctgattttccaaacatcgaacccagtttcacaacagcaatttcacaagcagtagtcaaacaaaactacgctaggaatcacctcacatccgccgatgaccgtgggcacggctgttcgaacagtttgttaacctctgcagagggggtacactttacccacacgacattactaacccggatcacccagcccgtggggatcagccacgtcgggagacctgcaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtgcgttccccggtccgcggttttggaaattcatttagttcgcaagcaccgacccaggtgtcgggttttccaagtcttttgtaaaactccagttttacccaagttgttactcagatttttaagtttgaaggcgaccgtcgatattcgcacagagtgcacgaatatcgaggcgcaactggtcggttacgaggggacgtagtgtaacaattaacaacggaaggatcaaatgcaacaagttaggtaagtccgccaatctgccttgcagacgggacaacagatttagtgtgatcctatcaatgcataatattttgcaagcaatataattaaatttcaaatataggctcaagatgttcaaaggtggcttgccttgctccagatctggagcttgatcctcgaaatcctcgcactgcgggtcttcgggctccgaaactacacgcgaaacgggataactcaacaaacggcgaaaataaagccctattaatgacctctaagcgtgccactagacagatctcgagatttgggaaattttggaagttgaacggagtcaaacggatttacggttgggaagatattgaatttctaggattattgaatttttgatctaaaggaaaaggatttaattaaatcctttttggaaaagaaaaggaagagggaggagaagtagacttttctcgggcggctagggcgctgcccaagggaaatggagcggaccggccgatctcaa

SEQ ID NO: 14703 - DNA, 5550 bp, Oryza sativa
gcaggcatctaggttatgagtaggtatttaaagggtcatttaagaaattattatcagatcagaaccagggttccaaatcctagtggtaactggtaactgttcatttaccagaattaggcatgtcaaagttcctgtggaagcaggcttgcacgtgagaaatcctcaaattcctatggaggtggtcagcaggtcagggatgaactctccacatgggaacccgctgatatggttttaagatttctctaagcgttggtgttagcatacactatgtcggtttatctattccttgtcccgttaccacgcctgaatagaattcaactatgactggctttagttaatttatgtggtgtttcagaagaattcaagaagcagagttttttctctctagtgtgtgtagatctatggtacttgaaaaataaagggaaaacacacacacacacacacacagaaaaaaagaggaaattggaagcattgcactagaatccagagggaataatcaggtagtggcttcctggtgtgttccaggatttgtctgcattctgagatttgggactctggttatatccatagcctttggtctcataatagttatatgttctctctttagaaaacaaaagttttctgtcattgtagtgtcagatggcatacatcttgggttcataacccacttttaatgggtttttgtttgtttgttagtgctagttgagatttatttgaggtgtgcataatgttagcaggagcagagtatatattacagtgctgtttgggagagcttcttccagcataccacaatccctgtcatttaattaacaaaaaccacatatcttttttaagattacgcaattttactggcagtcatagatgcttccttttttttctttgaatagctacaggtataaatctgccttgttcattaatgtactgtctatacaatgttgaaggaacttaaggacgttttaagaactgtgcctgaagttgaagaccttgttggacctgaagatgctgccaagcttttgtctgtgaaagagtaccatggtgtcaatgaagtaaaatcctgtctgcggtcagcttttactaagctaatgacagctagtaaagaagcggtttctgaagcaattacaaaattgatttttcgcctgaatgctgagagcaaggtaaaaatatgaaatcaactagaatggttgtggatatctgcattttcacatgacatcaaatattagaaccttcccatattttatggaaatacaggcttttcattctttggatcttcattttctatgcatttacattatcttacactcttaccagtaaaatgtgccatgaacatttctcttcattatctttccaaatgaaagttaggttctgttctctcctgcttgaaagttatgcggtggttctttcgtatacgatgctaaacctatcagtggttaatgagatgttaaagtgcacagatgatgtttaaatggctttaatgctttgttttaccaatgctatgccatatgcaatgctcttgttaacgaggtcatatctagtactctgacatgcattctccttgtttgagacctctgataaatgtgggactgaacatggggtctaaccccgcagcacatagtgttaaagacgtaacttgcaaaatgacattgttcattgttttccaagttaaaatttattttgtttcaaccgcatggacttgactcttcgagacatggaaacatagtattgattactaggcagtgtcaaagcactgaacagtagaaaatatatatcatgacatttacttttcttacattcatgtgctgtgattgcgttgctatgctacttaattgagttattagttacatgggttgtaattgggaggaaaacaacaaagggggaaggtaaatataattgcacccatgagcagcaattcatgctattgtttttgtttaaatcgtccattttattgaacattgcataaaacaattcctgttttgttatccccattatacaaaacgttcccttaggagttatcatcttccaagtaaccctttctttacagcaatatgaagcataactaactagagtacctttttttaaagagaatttaatgaatacaggtcaagcctgagattctatctgtactgataatgatgtcatgatctattcaggtaaggaccttaaccgagaaagaaaatctagttttgtcgctggagaaacaatacccagaagatgttggtgttctatcagcatttttcttcaattatatcaagctcagtcctggtgaagcactttacattggtgccaatgaaccacatgcatatctatccggggaatgcattgaatgtatggccacttcagataatgttgttcgtgctggtttgacacccaagtacagagatgtgcaaactctttgctctatgctaacatacaaacaggtgagttacagaagtgaaaccatgacaatttctaattttgatcacatgccgagacctaggaaggatgctttcccaaggtctgcagaagttctgagaattcgtcgtcccaggacccaggctacaagccagcactgacatatgtattgtgctatgatgcctatgcatctttgatctttattaaacagtgaataccatagtgaactccacaaagttgtcgcaatgatcatcaaaaatatccttttgcaggtctttccagaaatcttgcggggggttcctgtacagccgtatgtaagaaggtacacccctccgtttgatgagttcgaagttgactgctgctcactaccaccaggcgaactggttgtgatatccccagtgtcaggtccatccgtctacctagtgatggccggggaaggcgagatccaggtagattccatgccaaatggtgaaaagtctaaacaaggtgatgttttcttcgtgccagcatacaccgaggttaagttctctgcctctggtcctgagtgcatgcagctgtacagggctggggtcaatagcagattcttcaattaatttagtgactgctgaaagagttccacacacaattgctgtaggtaaaaggtcagtgcttacaaaatacaagtgaaatgatatgactagttagcaaaagttaccatatgtactgtataggtcaacaaaagaataagtcaggttccttcatatcttgattatttgttcttccaaagaggtctataccatagcgttcctcacgcatccagatccatctgaatggagaggattacagagaataactttcagccattctattctattacattgtagttcagaactaaaatgtgaactggtctcaagctttgacaccgaatatagttggaaatacttacagacatgctccatgtcttttcattgtttgctctgccttctaggctggatgacctgagtcgttttccttttgttttgtctgtggtgatcattggcattgtcgttcacttggacatgccgttgatattggcatcgatccattgcttagtgcatgtcaatttgcactgccagtttgtttgttgtttcctactgctacttgaagtacctggtgttgctttcattcagtgaaagccggttggtccttgcgtagtgcgagaaggcccagtgggcttttggtgtttgtttccaagaagaaaagaaacaaacagcattggattggacgccggagttgcatggcatttgcagaattgcaggtcgttttcctctgcttctcgtggcccgatttggttaagccaaaacggtgtctttgatagcgtggacacgtatgtagtacgtgcagtacaggttggttgggtggatcacggcatatatatagcgtgtggctgtcatctgtgcatgcacgagcttgtagtaacctgttggctgcaggtggccatccatgcatccttccttggcttggatacatccacttcgatcagtcatcagtggcacagccaaacaaacctgcaaaataaaggtctctctccttatcacgtcaattcctagaaccagcgatcattttgtcctgcctgctttcactggcacaatttgcttcctctatcctcatatcccatcttggacatcatcttgtttccttcagaattttcagattatcgctgcattattcatctgtaatgtaatctcgtacggagtattattctcgtttgtcctttgtcgtcatcgtcttcgagagcttagacttgcaaccaaactgccctgctggttggtctctgtaccctgtatggtttagtaattacttggagagtgcagtgctgatgctacactttgaccaagtataatatctggtgctttatcgattcattttttttgtacgtgttgttaaagcaaacgtggggcaattcggccgtcaatcccgtgcggcacgtcaaaggaacacagagagagtttcgcaggcttaagcaacaccagctaagccatctacttacctgtctaatctgtgcaagtgtgcatgcttttcctccctgtcaactctacttaatagttactgacactagtagtaccattgggatcatatcaacggttggtggtgaaggccgcatcaaggaaagaaaagactccaacttttgatccaaactatccaagtatgcattgtcatttcacattggagaagtagtggacttccagtgtgtggttggtattccgtgttggttttttggttgatggctgatgtacatatatgttgtgttgatgttcacttgacaggaaagttcaggtgattcggcctgttgttttccagcatgtgtggaagacggatggatgtcttctttgatcatctctgtggactgtgtggaagatgttaattagtgggtcaccacaagttgctagctgcagaaatggactccatattctggatcatatatacagagtagttgtacatgacaaatcagcatcatatcattgctagtttgccacctgctcaaatttatatgatcagagcttgaagatggttgctaagctagagctttggtaataattaccatggcctagtggaaatcatgcttgtcatggatgtgtagcaatatagcatatgatgggctggagagcatgcacaaagccgagagcttggcatacaagcttgcatgcatcttgggtagcttaaaaaaaacaaaatcttgcatcttttaattgaaggttttgttaagcacaataagtaatccaccctagctacaaattactttaattaattaagttgtgtaaagcatgcaatctggacaacgtagtacgttgaaagttaggccagcagtcaacagccactgtaaagctaatgccggaccaaacgtgcaaaaatatcatacatatgcaagctgattaacaagttaattagtagcatgttttcgcgtaaccggtatggcagcatcatatatatactacgaagtggcatcttgccgggttaattagctcagttcatcaggttcagtgaacgatcaccaagtcgtttgatttgactaggccgcgactatctctgcacagtaggacggatgacttcctttttaactctagcattgacttgcattatccttaggacctttaagcaagtgaaaactaaaagacaagctatcacagatcaaatttgtttgtt

SEQ ID NO: 14704 - DNA, 22057 bp, Oryza sativa
  unsure (1)..(22057): unsure at all n locations
nnnnnnnnnnnnnnnnnnnnnnnnnnnnnnnnnnnnnnnnnnnnnnnnnnnnnnnnaaggcaatacctccactgttttcacgtaatatggttttgtgtttcttctataatttttcaattctaagtgaaaactaaaagacaggcttgataattaactaagcagtctacactatttaaatatatatatttttggtgagatacccctttttattttttagacggcctaaaataaaatcctcctacaaaaatgcacgtgtcccgattacttgaatggagttatttttacatatggtcctactatgaaaatcataaattttacaagtgcttgttaagagggcggcttgatgtcatccatggcggatttgattgtgcaagcgcttgggagtgccaaatctggtggtggtgacagctgcggagatgactacggtaggttgcggagatgactgtggtgaggaccgtgacccagcggtagtaaagatgacggcaacaacgggcgaataaaggcgaggtcccccacggcggcggcgagcagatgcatacgagttcatccatagaaccgatgggtagatccaagtgtgctcatccaccaggctagaggtagatgaaggcgaggttgtccatgacgccaattggcggatccaggggtcgaggttgtccacaacgccgacaagtagatctaggcgaggtcgtccgtgatgatgaggagctagggttcctaggtagcaacggatctggtgacgatggcgtcggctttgggagcggcgatgattgcgacgacctaattgctccctcttctatgcgtatgcgatcttgtcgccctcaccctcttctcttgcatcaatgggtgaaattgttttgatcggcacatggagcaatgatttttgaattgttggatattttttttggatgaattggataccatagacgagtgacttattagctagccacatgtgaaaagcccttcttcatagacgaataacttagctggcctcctggaaaggggcatttcacatgcggttgtctatgaaaatggacttctacaggaaaccacatcctacatgtagaaatacaatatttccacgggcgtttttgttacaagcaattgggccaaccacctctggaaatcgaatttatctgcccaaaaaaagattttcataatagtactatgaagttgggaaggtcatgtgatgaaatggcttgagctacgcattttctcatgctccatctatttccaaattaatatgtcagcgacaataattactgcttcacattaactaccaccaatactaacttcctatggttaaattataataaacaaaagttgtattgtcttgttaatcccttctttatataaagttaaggccaaaagctcaaacctcgtgcttccacgtcatcatcaaattgtgaaccgttggatgaatgcattagatcgcttctcagacgtatagagcccaacccattagtcaccgggtgagtctcttcgccctcagtgccaaatgtagctcacatgaacacattgacccatctccatacacatctacatgtatccagcccgttaatccgtataaaagagttttatggctgaacgccccttcagttgacatgcgctacctaaattatctacaatttttggatagggctgctaaaaagaatttctccaagaaagctatttgtttcttctgtttcttcttgaaattatacctcctatctaacaaattgatgttaaccaaatcctgcagcaacacgcggagcatcctctagttaacaaaggcagaagactctaaatttgaacactgaaaattctggaagcagctgcaaccgccaaaagactcctcaaacatgaccttaactagtctgctgaaaatctatgcaatgctatcatggatgctgtcacacatttcccccttacacaattcctagtagtcccaactagctaatctacgtccaatactttctccatcccaaaatgaatttatttttcacccatctcacatgccaataaaaaatttagaatacctctactttatcaaatctcaatgcaactatttctcacttcatatatttctaacacaattatttcatactgtcataaactccgatgcaatgattactttaaaattaaatttattttgagacaaatggaaatgataaaaataaacgggacggagaaaatgtatgtcttggttgtcagaacatgggatgtggcccggccatgattgttgatttttttatgcacattagttgagtcgtttcaaatcaagggtacgatcgatctcaacaacatgacaaggaatggtcgattttggatatggtcctgacttgaccagatgggatgtttcactgttgataagaagcatgcattatgttcaccgatttggcatttcaatgtaaccccgttttgtcacacagtcggtgcagggaggttctccaacacattcacaaatactacttgtctctcttcaccaaagcttcgagagttcatttttattatatgctagtatatatttctaaggcttggttcttaatagaagatgtacgaaactgagtttatgataaaatggtacaaacgagtagaaagttaaaaggttgaaatagctttcttaaagacaagctaataaacaagtttttttaataaaaaaaaagtagtgtaggaagcgtgtctatgttaatcaaatccataatataatctgttagcttaaaaaaatcatgaaccaataaaattcatgccattaagaactaattaatcaaatccaaatttgtctcgccaaatttatgacggtcagggaggagggaaatttaaagaaaccggcgaggacaaattaaaatgtgaatacatacacaacaaaatggtgaccttgatatacatgtactttttttaaaagattacatggaagacgtagacacacacagaacacgcattcacacaccatgaattaatgcaccctagaatcctaatgaaagcacaccataattgattaatcggatccccaaagtttatttttttgttaattttttggagatgataaaataggacatatattccttggttggaattaatgttacatctctgcaaaatatcaaaaataaatctcaattgcatttacctttaccaaaaatacaaatgtgttccccgcacacggaattaacattgagtacaattttaggcatgtaagcatgtttatcaaaattaagaagaaaatgatcttcaaagcttttgaggtactacctccgtcctctcatacatccaaaatttcttatattttaggacggagggagtatagtactatcagatagaccagatatgataatcggagcattgactactgttgtatgtgggaaaaaaatgcatctttttttttcagttcattttactagggttgaattggcttatattattgtttctaaatttagcaactccccagcaacaacatcagtgtaagtacactagcaagctacttttgcctttgcttacaggcaagtgctactaggaataagtggaaaatttgactttattgagctagaagatggatttgatatgacaaggactcagagcaagtctcatccactgcacacaaagaaacaaaagaaacctaggttgcttataattgcaaacattaatgagttaattagctgccttttctatttcgttcttgagtgtcatttttcttcagtaatgttacgttaatgctgcaaaacatgcatgctagctaggtgtactgtatatgtagactatggtacaatatatagctatagctccctattttagctttgatgaagcattgttaatcattttgcagaatgaattattcctgaaaattattgtatatgtttgatccgaatttcgttttgcattcacacatgcatgtgaatggatattaaagtttgcatggttggcttatagtatatctatgtggccttctttttaagattaaatattcaccgaattattaaaataaattaattgttttacgctttaaaaataggtgtatgagaaaaatgcgtcctctatattttattacttagaccactttgttttaagcttaatttttaaaatattaatttttatctttataaacaagaagattttctcaaaaaagaagtgtattaatataatcattaacgataatctactcaataatctaaatcaaacgttacataccatatactcctactaaagcaaaagcaaaacggtgtagttatgaaatactccctccgtctcaaaatataagcaattttagcatagtgacaaatcaaacatttttaactttaaccattaatagcaacaaaattaaaaaaaaatcaatcatgtaaaattaatgttactagatttatcgttaaacaaattatcataatatgcaactctttttatttaaaatatattatttttatagatattattggtcaaaataacatttcggagggagtaaatgaacaggtaggtactccaggacgcatagcggtaccctgcaaaaaaattggacatgtgtgtttgtccgtgtcggtcaacatgaacaagcaaggagacatggcctgccccttgaagaacccccctccctctagctctgtccattctgcaaacagtcgccgaacgaaagttatacgtgcatggagacttgatgcatggccggaatatttctgtgtttgtcagatcaggtctgattgatcaccagctgcttctctctctctagccttactactccctcctcccaaaaataactgcagccatggttttccgcgcccaactttgaccactcgtcttatttgaaattttttattaaaaacataagtcacgagtaaagtagtactcatgttttattatcttataacaacaaaattgctaattataaaaaaatttcaaataagatagataatcaaggttgggcgctgaaactcatgactgcacttattttgggacgaagtcagtactcgtatacttcatccgtcttataaaaagaccaacctaatatcgaatgtaataatctatctgttcagatttataatactaaaatacgttacatatctagtactagtaaattagtttttatgagaagaagaaagtatatcatagatgaaccatatatttgtgttttggatgtatgcttgcatgcacacattacatcctacggttgtagcgccatatatcagcactgtttgcagaacaaaatcctgtcagtgatcgagcgtctctagctacgtacagatatgcatgggggcctttgttggaatccgatggacaatatataacgttaaagagaagataacatgtgtcaagcaagctttaatttgacggacggggcctctctagctacatggtgagcattcactggataattactatatttcttctaaaatatatatagtagtaatctaggattaaattaacgagtactacgaattcgaatctagacaaactcttatttggtcctaaattactaaattttgagacggggagagagtatatgttagaaaagtatcattagttgtggtgaatgatgatggagttgtgagtgcaatttgtccatcaagtatcgaattctattgctcacaatatgtactctgtgtaaatttaattactacactgaaaatttatattcattacctttaattaatacactatattcttaaatcaatctgaagtgaagctcagaaaagattatacataattaattaattcgatgtatatatgattattgttgttagttttcaaggtttaaattcaacaaaaagtaatgttttcagcagcagcaattaatatataaatgtattttaatgatatgggaaatattaatgttagtcaaatatacatcaatattgtttaggactgtatcacatatatatatttgttacaaagttttaacgaaatattattaaatatttccttaaaactatctgatccccacgtaattaattagattaacttaatttctatatcacgtgttctgattcatgtagtcaagtcctggagaggaaaaaagaatctcccttaaattagtatgcacctatcaacgctcttcctttcccattctatcaaaacgcttttaatttttttttctcgccggccattctctatcaaatgccatgtcccacatcctttaagaggaagtctactagcacagtgcccttgaaagctccaggagtcttatcaaagcaaaaatttcaagttggaatcatctctagctatagcactttctttctccacctttctccatccatataaatatatacaacatatatttaggagaaatggatgagatatccatatgattgtaaaattgttccctctctggcccgttagatttgatgtgacgatatgttacatccatcgtcgttttccatctagagtacgactggcaatttttctcagaaagaagcatgattggaaaagatatatttaataactacatcctaggttatatagagcaacaaacttaaattctaagtcaaatcattaattatctaacatggtagtattatctcaataatgtacgcatcaaaagaaaacaagttttactccttccatgtcataaaaacatgtttcaagtcaaacttaatgtgaacatcaatattttaaaaatatttagttagatgtatgaaaactatatttgtagacatgtacatatatagcatgataattttatcagggtttataggtcaaatttgtacgtgggacaccatgcatgttcatgtgtaaaatgacatgttttcatgactgaagggaataactgatcgaactcatgtatattcatttgtttaaaaaacatatatggacaaaatgtacctgaaattgtatcactagcctagctatatatacttcagaatgtctatctagtgtggcaacttgtgatagcaaaccacacatatataacaataacaaccctctagctcattgttgagttcttctggaaagtagcgtggcgacgcgtttgtgtgctctacttgttaaatttcccaaatttgcacaactcaatttgagttttattggtaaccctcttctcttcttctaatatattgacgtgcaattcttttgcgcgtttgcagaaaaaagttttattggcaaccacacatatatgtagatcgagatcgagatagccatctcaaagcgacatgtcattgccgactttccctagcaagagaaagctagcaagccagagagaggcatctcactctcacacacacatctatagcttgattctgacccatattgttcccatctccagatgcaattacagcacacaaccccaccaacataaacgagatcacttggagacaacgacctctccttcgatgatcaatgcatataacaacaagatctctttcacaaacccaacaaatcaaagctaattgaatcgccttttaacaagaacaaacaaagagagaacacacatacgtacgtacacaattacattaacaaagtactactactaacaatagttacatgcaccatcgatcgatcaaccactacaagaagctagctagctctagctaatatgtttaaacacatctcaataatattctctccatcgatcggaatcatcacgctattgatcatcttctacttttgatttttgcttgatcgatcactagtacttctatcttgatcgatatgatggaacaactcatccattagctaatgtgacagcatcatcaacatcatcatcatgatcatcatctcatctcgctttaatggagagacatcacaagaagcaacttaccatctcatctatccatgatccatccatccacttagcctttagctacagctaagctcagctggatacgtagctacctagctagctagctagattcctcctccccactcgccgagctttctcgccgccgcttggcacacctcgtcggacctccacgtgtcgccgccgtccatggcgccgccgcagtagttgtagctgccggcgttgccggaggcggtcatcatcgtcatcatggcgctgccggtgcagctggagttgaggtagtcgaggagcgtcgagtcggagtagtactcggccggaccaaggtccagcccgtcgaggctgaggcttcccagcgccgacgccgagtcgacgaacacgccggcggcgccgtcgtcgagctcgccggaggactgcatctgctggtcccatctcagctcggagaagcagggcagcggctggaacgccgccgcggccgccgtcgagccggccgacgtcgacgtgctcgggctcgggtcgatgtggtggtggtacacgttgttcgggacgacgcacgccgttgctgcttctgcttgctgcaggtgggtgtcgaagtcgaacggcgaggaggaggcggtggccatggcggcgtggtggtggagtggcggtggcggcggcggagtggggtcggtggctgctccggccatcttctcgaggaggcgaggcatccaatagcagcggacggcgtcgcggaagacggtgctgttggcgtcgaccttgagctgcctggcctgcttctgcaccctcgtcctccagtagttcttgatctcgttgtccgtcctccccggcagatgctgcgctatcctcgaccacctgatcaatcaaattaaccaatcgatcttgatcagagataattgattttgattgatatatatgtgcagattgatcaaatcaatatgtatacctacctgtttccccacctggaatggagctcaagaatgagcagctgctcctccggcgtcagattcccgcgctttatgtcaggcttgaggtagttgagccatcttagcctgcagctcttgcccgtcctcttcaaccctaatcgattaattaacccaaatttgttcaagattgattgtacttgacctagatgccatggttagatcgatgatgattgcagagtgacggaggactcaccggagcagcgggcgaggagattccagcggccttcgccatggcaggcaatgtagttcatgaggaggttgtcttcctcgagggtccatggtcctcgcctcagctccatcatctcctctgccatggcctcctgctgctgcttgctcatcactcccatgggccctgcaactctcctctgcgacattgctgtctactacctttgcagcagctgggatatatagctatctagagcttcttcttctactactagtagtataaatgttgttggtcagttggtggattggatgatgaggtcgatgtatgatccccttggagggtgcaactcatacaaccatatatatagccatgtacctccactagctctcactagcttaattagcttgccccttaactactctctcaactctcaactctctaggagatcaattagggaagaaaagaatggaagagagcaagcacaagtaagtacaagagaagagggaggagagatgcatatggcctagctgcagagagagagagagagctaaattaagttattattggtggctgcttgagatcaatatatatatatatatatatatatatatatatatatatatatatatatatatatcccttttataatgacttgtggcaatcatatgaagggaatttttgagggggcatgcatgcaactgcccctaatcaagactgaaaagtactactacttgtaggaagaagaggggtacattttaatttggtgggttaattagcttcttgggggagaagagaaggaagaggagaggagaaagccaagtgcgttgttacacaccaaaaggtcagggcaatctgtcaaagcttccatctttttctatggaatgagagagagagagagagagtgagagaagaaatagtgcccagtactgatctttagattctctcctacatgaagcgtgtttgactgaacaatttgtcatccctcttgcagcactgtgttaggattagacgagagagggagagtgggatggagagatgaccaaattgttggatgcacacattggtgaaccacacacctctccacgatctccttttgcactgcaaaaaaaaaacagtaatgcaaaacgttattctttttgtttcttttggaatatatattatccttttgtgataagctcaaatcccaaatagagacatgtacatatacatatgcatgcatgggtttttatttattgatattacaccaaatcattggtatgttttcgaaagctaccacactttatggtatagtgaaatgcaaatgtgtctccacgcatgcaactacctgcctatgggcctatggcacttaaccatgcgttcaatcagaataattatctgtttcataattaattatttactaccagtttgaactagaattatttgccagatgaggtacggtctacttcaagcaaagaataagcaatcaatcagcgagacttgtgcttgcaaagcaaatagctttgtagttctttctcccgaaaagccaatgaaacactaaactttggagacagcaccctggtaagtaagcaaagattaggtaggaatgcctgtataagttcctaggataatcatataaaatattcgtaggacctaatgattcttgacctaactgtctgcatgccgaccggttaaaatgttcaattcaaatgtttagcttaaatagtttgtgcgtgatgttggcacagttgcatgcataccatggtgtgtagtcaaatacttgcaattaatcttaatatttgccgcatctaaagtgtcagttttgcggcttcccttgaccgaattttcagaagtacagtcactgttaagttggaaaagaatcaattcaaacatgcatgtccttgaaacatataatcaattgaaaggtcattgaattatactatatgaataccccgttgtgttgctgccggaaattaagttacataatatgtataaataagatgcaatataattattaaaactaaaacaaattgatacttatgaattttgagcctaaaaatgattgagattgcatggtgttatgagagaagaaagaagagataatttgaactatggatctatcagccaaaggctagaaataattagggtgatgtggcttaatgagagaagagagaaatagcattaactatacttagtggggatgaactatataagtatataggatttgagcacacatgtcaaaaagatgacaagtgaataatttacaatagacttgttgcatgatatatttaacatgtataggaaatagatgaagtgtaggcattcttgttatcttgctattaatggtgcaaacaaaaaaaatcgaataaagcctaagccatgcatatttttcatgaaaaatacaattttattggaatttgtaaatatattaagatataaataagtggtccgataatgtttgtgtgagaccagaccaatgtctaaatcaatacgtatttgtgatcggatcgagtaattctagcactagtacgtgtaagttctcatatgagccatactacggtgctctctgttggtagtaaaaagcaatatgaaccgttgttctcatttggttgaagggtttagatttatttgtactaccacttcagttagcggtattagaaatgtggaggtgcattattataaaaaaaagtgtggagggatataatcaacatttagcaatgacgactagacctttttttcaactttttttttggctttttcgatggaatataggtgtgagcaatgccagcggaatggatgaccaaataatagatctagaaaaaacataaataacaaagttacctctaatcattgtattggtaaattactaatttattcttaataatgaacgattatgatcatttggtaatttctcttttagagcacgggaacattgctctttttcatatatgttagttaattattagagaaaataattgtaaatgaggaagaaattaacatacactagctcgcataatagttttagcgtatctgcaattggttacgctaagttataacctttggtccattaaacatcatcatatcgttactcacaaagttctcttttatatgcttccttgcaaaaaaaaaagggagttctcaaaaaaaaaagggagttctctcttttatttgcggcctttttttcaacagaagcacgataaagctaacaataattcataaacatgtaactttgaaagaaacctacacaagtacaataaactatactagtacaccactagctagccatgagttagctagccatgagttagcgatcactcatatgtacacaaatataaaggattctagtatttgaaatatgttagcaattatatgggtttctaatactatttctcttacccaaccgtccctctcatttaagtttcacctaatgttacccctaaccatccttccatgcatccccatccaccccttatttagtaaggagcatcataggccttgttaagttagggaaaaattttgtgtgtggttgtcacatcggatatatggacacacattgaaagtattaaacgtagtctcataacaacacaaattacagattccgccaggaaactgtgaggcgaatttattaagcctaattaatccgtcattagaaaatgtttactgtagcaccacattgtcaaatcatggtgcaattagacttaaaagattcgtctcgcaatttacactcaaactgtgtaattggttttttttcacattttatactccatacatgtgtccaaacattcgatgtgatgggtgaaaagtttttgttttgggaataaaaaaggccatagtatgtataaaaagaaattttacaatccttaaatgataccgaaatttttagaacaaatacccgtagctcctagttttgaagatatcgagaggcaccaaattttacactggaaatatggtacctcccagtacctactcaagaactgtaaaatcagtcatgttctaaaaatctccgttcgttacctcccgttcccaactttcctccctcattttccgtgtgcacgttttttaaactgctaaacggtgcgttttcttaaaaaaaaatttctatacgaaagttgcttaaaaatcatattaatccatttttgaaaaaaaagtaaatacttaattaatcatccgctaatcgctgctccgtttttcgtgccatggagtgagggttcccaaccctcgctcccgaaggcagccttatttgatgactcaacttttcctttagaaacttggttgtttgagatcacaatgaatggtgtttcgacttctccgcactataagtctagctatctacgcaccccatttgagacatcgactttaatcttttcaaatacatattttctccattagtgcttaattaaccatcagttctatatagtataatttatctttattgtgatgtctatgattgttgtaacatcatatatatatttcgggtcctttttgtcattgacaatattttcaaatacatattttcaccattcgtgcttaattaatcatcagctgtacatataattaatctttattgtgatgtctatgattgttgtaacatcatagatatttcgggtcctttttgtcattgacagtggctatatatgctcatcagctaggatataaaagtatataaatatgattttagatctgtccagtcgtgttactcatgcataaacttgattaattattgcctataaatggaccaacctatatatctagggtgctgattgatcaagaactcgagataattctacttgaaagtaacaaacaacaactaggaggatacgctcaaaagaagagaaaaaattacattggtggtccaaattttaacacttgcaaatattgtaccagctggtaagcttttcctatggaccacgcactaataccatggcaaacaagtgattatccatatggaccacataatgatcgttgcattagctcacaaactactagaaagaacaaaattattgtaaatttagttacacatgcatgagccagttaacggcatgattagcctttctagaaaaacaacatatgtagcacaccgttttatcttccttgtcattttggagaacgatgtagtcaagaaaacttgtattttccattattgtttctaatcattatatgatataaaaactattaaatattttatatgtgatgaatccaaacatttctctagatatttgtcatcgaagtttgcagggttgaataacattttctagtatgtcctaaattctatttgagacagatcaaagtagatcatttttttttcagtagtgcatatatatagtaaattcctcatatatatgctaaaccaaatgttactcttgtatgatagtattaattatttcatttacaattttatatactcaatctatctgaaactaccagctaacttttatgcacccttcttgtttcgccttcatatctcatcctttaatttcatccttcccattctaaaaccaagcttcaaatattggcaagaaagggaacagtaaaattttggatgccatattaagaaaaataaatgtccgtacgtacgccacatgatgaatttgtccttgtttttttttcctttggcatgtacttgcaagtttcatctaactcatggtccttaaatagtccacaagtcctaaccattcatcgtcacttgcggttaaattaattacgtacccaacttgcaacagaattcatgtgcaagatctatgaacatagtatagccatgctctatatagttttgtgtatatatagtagtccttaattagttttctgttatcctatcatatatattatattgcatcatatcatattataataattattaagttaaggtaaaagagaaactctctgcctatgctctctaggacataagctagttaccatgcatgtttagtaagggaaagaaaaatatacagttgactgtgatgtgggtccatacgacataatgcatgcactatatttaataaagagtacacatcaaatttgtaggaatcttaattttggattaaaattgttcaaaaaaaagagagagtccatgcatgtcaaatgacagtaaaagagcgagtgaaataaattaacctgcaatctcatttccatatatataaattccaaagtaaattctctagctaaaataatgtgagtatattttggaactacaattactataactagtccttgcaattgtgaaagaaattcgacaagttttgtgtgcgattacgcgggtgatgtatgtgtgcgtgcacacacaccggcggcaccaccacgcactcacaccacacttacaccacactcacacaccacaatccctaagcaacgctcaaatagatgaagaccaatggtatatccctagcaacactaatttctatgtaaagtttactagcgtgtgtaatattcgtgaggttttaacaaatcataagaatgatcgtatagacataagtcttaatttgcatggtccaatcaccttgtattgttaactagtctgtgcatatttacttctaattttgtaggtcctaatgggagtttatcagctactaaactcaaactgtttcttagggaaaaaaaacaggtcaatgttgttgctagacaaatttaaagtgtttgtatctataattagtgttgtaggaaaaagttgattagatgtatacatatatgtaccctctataacttaactaattgctcctcactaatgacatttttttctcttctctcaccaaacttattttcttgtagtgactagtcaaatgtgcaaattataaaaaacatgtgatgtcatactatttaactataaagcaaatttatctcgcaccacctcatgtttaccattgtgatgcagctttaacctaatgttgcaacgcacggggtttacatgtagtcatatgggcgattatgtaaattgactaatcaattatcggcaaaccggagatgcaaactaagtggtagcttgactaagtaattaactgcgaggaaaggtgaaattatcgcaatcaaatatctttgtatgggaattcaaaattaaaaatattgtcacacagaacagatagttaaggataccctagcttgtgcttaataggattgagtaagtgaaggtggggggagggacagtaggtctggtttatgagaaaaatttgggcgtccccttaatatgattcactcaagagcatatatatattgggaaagaaaatggggaagagaaaatccatagtcgtagttaagagcagttaggtatagcagggcatgtacaatggccactgatagagttgtagaaagttcttagccttgctaattagaaatgttgcttatattgaagaaagagaaagaggagagataaaatatcgttgctataattaataatggctaagcaataactcttagcctcaatctataaaatggaaactcgattgcattcggatgacaaaaaggaaatactagtaatgaagaattattttctaggttaatggttagaacccttcatgtctcaattgttataggggtaaagtgagactattatatattccttaagaatattcctttggcgctctatactattatgaagccctgaagatgaaagggttgcttaattgtatcctccaacaaacaacttggtgagtatatcccagttggtattaagaaagcaattgttgtgcgttgtatgtatagatatgtcacggcgtcatgtacgcatgcaatgcaactctcatcaataaattaattaccatatgtatgtatgcatgcatggcgatctttttcgcagtatacacacatgtcgttagcatgcatgggaagtcaagccctgaacatcgatcgcctcatgcatagcaatgctgaacagtgtacaagaaaaatgatctagggaaataattaatagaaacaatgcagagtagtcatgaaatgtactacctccatcttaaaatacttgtcgctttaagttcttgtttgtaacttttgattattcgtcttattcaaaacaatataatttttttatttattttgtttgtgacttgttttattataaaaataattgaagtatgacttatttttttttaattagtagtgtggaactttttcgcgaacaaacaaaaaggattacatttcaatatattcattaatgtggaattgtggatgcgcgataattacacaatgctagtttgcaatgatatagtttgctccaaactacagtaaaaccaacagtatgaccactcagctaaaccatctgaattaaacactgaattttatatgaaacatatacagtgactccaataaaaattttccgtatttccaaacgatcgaagcctcagcaaccaataaattaaaggagatcaaaagcggtttaccactactgtaacacatgcttagctggttgggttctacggtcgacacatgtcaaagtttcagcttcgatcaatcccctccgaaagcgatcgccattattggccacacagaagcttattagcttagctacctagtaatcacatcgatctcgatctatctcttttcagtggtggatgcaacatgatcatgataaagccattagctagctagcgatcgatggaaaggaggtgagatcgagatcgaccattaattccttctcctacctacaactcgcccctgatcaatatgatcatcttcccttaattaatcaacggatcgatgatcgaaatgatgcgtgaaaacaacacgtcgtctccacttaataacttgcctggctgcttttaatctcactcactcagtcgatcagtgtgtgtgtgtggtggtttgttgatctcatcatctatcgatcgccagagtctaagcctactcgttttagggtaggttacctaggcgcctctccagcgacgacgccgccaccgacgacgacgaccgcgacgacggcgacggcgaagatgcagagatcaagctagatgcatatatcgatcatgcacacacttgccttggcatgtgattatattgtttacatcgtggcatgcaaaaaatatggatgaaatgacaactccaagaatcgcaaacctgaacacgctacttaattcgattatcgatcgttaactgctcttgcagtcagcttgaattggttgcttattctcatctagctagcaatcttgactactgttacgtacgtatatcgatcgatcgatctagttggccatcgaatatatgtcgataattatgacaatggatgtgagcttagatatatctggccttaatcatgcccatctcctttacatcgatcttgactagctatagctctttgcttcgatacccatctctctctcagagacacacacacacacatacacgttccaattctgcacgtttccacattattcccgtgagaatcgtatcagaatatattaattcacactgaacttttgattaggattaatccaagttagctagctctagaataggtgcagagagataaagagctttttcacagcacataatcttaactaggaccaaattaagagagaattagctagcttcgtactagtatgtacatatattgtgtgcatatgctggaaactaagagatgatgcatctgcctagtgctagctagccagctattataattaggagattcatattcctttcacataatataccactctagctaggtaatagctatgccttaggtcgacctttcatccgaacaatttttaatcaacgtgtttagttatatatagttattagtggtgttaatctagcaaggctagcaacttgttgcgtacgtaaatcaccaaggaaaacaactaatcttttgcattaatttaccaatcgatgcgtcgacgggttaaacatatatactaaattattgcacacttacgacaacctcccatgagagggaaaacaagtggtttcttgatggatcaatcatgatttatataaagtatagaatactaatatatcatcaatcgcatacactagcaacagaatgaattcgatcatcagttgctaattaatagctccgcctatctcgccgtgttcttgaggtattccagaatctggtagtgtgtgaaacaggaaagcaatctagcgagcacacatgatgcttagacgattctaattaattaattaatagttaattaattaaggcagacgtgttacgtctgattttaacggaatgcacgcacattaatcagttgtttaatttgacaccccacaacatacagaggcttgggcgcacctggccggttttgatgattaattctcttccaattaacctccaatccatgccagagacttgacaaattattaatctaatttgtttgtacgtgtgagctggatggtattgtgtaaataggttaattaattgctagttgggactgaaaccagccaggttcatgcatgagtacatattgttcatgcaagttacgagttttgtaggaagggaggagacatcaaactgtacaattcgactacctgttgcaacgaagaaagattaactaatgctcctacggatatatagtttggtgagtagactaagccatatgttttaagtataatgccatattgccatccattccatggcattgggtcatcatgtgtgtgcacatgaagctgacggcaccaaccgtctactagttgctaagctagctactagtaggaattaataggagatagagcaacatcatgtgtctaagttgctgtaaaacaattgtaattaatattgagttcctgcggtaagctaatgcaaacttcttgtttatgttaattattaactaccagtacacctagagtttttctacgattcttcctaccataattcattgtacattccaagttattgtagtttaacagtacttctggcacaatgttgacacctcctccattttttttacctttttgactttcatgcatggtatattggtatgagagatagactttgaacattatttttatatctttaattaatatttaattaaaatattacaatattgcagaaacgtttccaatggcaaatttaatgatatatttttcgtataataaatttggacagttttaaacatataattctaaaaaaatagagttatgttagtcgtatggattttgaggtatcaaaagagaaaaaggaaaccaccacatataacgaagccaaacatgatatcacaccatatgagattaaaacttaatgataacagggagccacaatattgattgacgagagattagatctgctaaacctttacctttacgagatattttttacgtacactctcccctaaactagtataattacaatgtatcaagatattaatgtcccccggccgacctacctagagcgattattctattctacaattgtcatatactagttataagagatggtgtctctctctatttaagagagacatatagagtcctactctatttttaacaactccaaatcttattttacagctacatttgtacatatattcgtattcatcacacactttaatgtttttctacatagtcttccaaagagtgcagaaaattggccgctgctctcaacgtgccactgcacttgaagtttgtttcgccgctgtacgtacatggctacaacagagttcaatgagagagtttaatcaagcataaatatctagcgagcttaataaaaaatgattaccatattttaattcaccgtgctgcttgtcgtttaacgcagatatctacttgtgtaaacattcgagtccaaggtttcaatttttctgccaacaattattttagagcaaagtccgaagtttcggatgctttgccggcctgcacagataaccatcagggctgcaatgaaaaggccttttaaccacgtattgagatgtttgggccgtatactctacgtcgtgaatctaatgggcttagctcacatgaactttgggccgtaggcgtatgtttctgctcatcttcttttttcccgataatatagagctatggaagatgcgcatgtacactcacatattttggaataagtcccatttcacacatgctcaagaatatatttcgatttatcatgacaaggaaatagtaaaattgatctctcgagattttggcacacagcaaaacagagaaaataaaaatcttccttcgagagagaactgtctgatgtatgcagttcgtcttcctttaactgaatattctgttcagagtggcagctaatctgacgccgccttgcgctagcctgagattcacaaccggcaatctgctcccgaaatatgcatctgcaacagcagcaatcaagagcaataaacccgtggtcaggacattttctgaagtgtttaactctgcatcaaacgtaaatggcactgctaatggtagtattaccttccaggagtgaatcttctgtcacgtccttgtacgcccagtcgcatgctgcagcgatgctctcagatgcataccttgcatatatagttgtaatcagttacagccagaaatcaatcaagttaagtggaaattcagaaatgaacttttggatgtgaaagcatacgtgtctgggcatgtggtctggttcttgctgcattcttcccatcctggcactcgttgtgaccattctccctgaaacatcaagcagtaagtagatcgagctgctagttgcctcaagcacaccagaaaaccatttttcataccgttatattctgcatcagtgcatcgacaaattcagccacgccttccccatagtagtcgttttctgccgttttgatgatgttgtcatcccaaacctgaacgacaataccaaagacaaaggattcctaattgattttgtcacagtcatatccatgctttatctgatttttttttcttttgggaagtgggatgctagtctgaatgctttttgcagtgggatgcttagtctgaacattggacttacatggtggagaacagtcttccttgtataccagtgcacatcaatggtgtttcctcctttatcggaggtaaaccccacatgaagcggctgtcatctccaaatgattaaacactaattactacactagtctactatacaagtacttacagagcgtactaatcacatttttttgggtgtacctggtggatgtcccccacaaagtgtgcaaggaacagaagtgcttgtgtcaggttatctgaagaactcaagatcagaaacttatcatcagcctgagactaacaaggcaaaaaaaattgcagaactgaattaaatggagcagtattacattgagtagaaggggatgttgcatcataggtgaagagctgggaagtgtagttgtt

SEQ ID NO: 14705 - DNA, 18242 bp, Oryza sativa
gtgtcaggttatctgaagaactcaagatcagaaatttatcatcagcctgagactaacaaggcaaaaaaaattgcagaactgaattaaatggagcagtattacattgagtagaaggggatgttgcatcataggtgaggagctgggaggtgtagttgttgatggcgccggcgacgcacctccccctgaagctatcctcgtccttgcagtctcctgacaatgcaacacaagaaaccaacatgatgcatgctgctacaatgtgacagcatgtccatgcaaatttcagtcgaatttgaggacaaaatcaacaaactgtcgtaggtgtagctgcagaggtggtccggggtgtcgatgtagtggagcggcgccgaccaggggtacctgagcttgacgccgtcggcccaggagcagaggctgctcaggttgcccccggcgtacgacggcagcaggcccctcaccgccgcggcggccgcgtcgctcagccggccctgcacgagacgagacgatcagatgaaagaaggcgaggagcagatcgaggaagaagacggaagaatgtgcgtgcctgcgcgatctggcagacgatgagatggccatggattccccaggcgtgcgagggagcagggaagagcgaggagaagagaagcagcagcagaaggggcagcgtcgacatgatcgactgctgcatcctgaattcctgatcggatgcgaggtagaagaagctagctagacgatcgatcagtatcagtgcctcggtgatggggtttttaagcgggaatagtggggtagttcctacctacctggtagcgatcgggtcgccccccgccccccctccctccctccacctgtttccttttttggcacctcattactttcctactttagtaaatttatgcatttaaagtttatacacctaaagtttacacatctaaagtttagagaccaaaagtttataagtcaaaagtttatatatccgattcaaatttgaatttgaattcaaatattttatatatatatatagtatttctatacatctaaagtttatacacataaagtttatatacctaaagtttataagtcaaaagtttatatatccaatttaaatttgaatttgaattcaaatatccgattcaaatttgaatttaaattcaaatatttttcatatatagtatttctatacatctaaagtttatacacctaaagtttatatacccgattcaaatttgaatttgaattatattcaaattcaaatttgaatttggatttgaattcaaatattttctatatatattatttctatacatctaaagtttatacacctaaaatgtatagatccaaagtttataagtcaaaagtttacatgcccaattcaaatttgaatttgaattcaaattttttataaatagtatttctatacataaatttttctaacttttgttttttaaaaagttttgtgtggtgtactgtagtagaaagagaagaaggggaggaggaaggggggagaggagggaggagtatatagtataggagagaggcaggggagtgatcgctgggtggatggaggagcgatcacccacccaataggaattccggaatattgtatcatttcgcgccattattttaagaaagggaaagaggatgaggaatctgtcggaactacggagcatgcacggccggcaatctcgttcacacgctgctgaaaattgaggccatgttcatacccatgcacacgcctgactactgctggaccctcctggtgccatgtccgtgcattcacagcagtgtttgttattcagtgtgtgtgtttttctcctgcaggatgaatgcaacagctagctgcatagctgtattgccccttttttttctattaagatacatattttactcgtggtttccattagtatacttttcaaaatgctaaacaatacatttttttgcaaaaaaaaagaaatatatatataaattactataaaatatcagataaatccattttttaagttcaaaataatttaaacttaatcaagctaatgattttctcattttacatgttttacacttaatcttcatgtacaatgaactcaaacaaagccagtgttgtcgttgtatgaaaatcagcctcaccaattgatttcatgagaaaaaaaatggagcaacaaatttggcaggagtagcaatgtatcatgtcgtagtctggaaattttctccgataaaaacgccagagactgttgtcggcatgataaaaatctgtataaaatttatgggccgaaattgccctcagcatcacaagcatccggcccatccggataatcttggcccactagcccagcccatgccaccgctacgttaccttctcctctcgtgctctttctccgcccaataaatagcccacgacccaaccactccggcgaggctgagctgaccaccaccggagatggcactcgcagcgcctctgctccgcctccggctgctgcctctcgccgccttcgtctccgtcgtctccctcaccgcggcgcctcggcgtgcggaggcgtggggcaagcagggccacatcatcgtctgcaagatcgccgaggtctccgcacaccatggctttgctaatccccttcctcctctcctcgcacagcacctgaagaggctgcagctagagagtaacacggagtgttgtacttgcagaagtacctgtcggagaaggcggcggcggcggtggaggagctgctgccggagtcggccggcggggagctgtcgacggtgtgcccgtgggccgacgaggtgcgattccactactactggtctcgtcctctccactacgccaacaccccccaagtctgcaacttcaagtactcacgtacgtcttcactcacctccacaatcttagcttcaaattttcttcttttaagataacgacttaattatagctgcaaatgaacgctgcatttacagaatacaaattgatcgttcaaagcgagcttaattgcgcgccattggttgcaaaccaggctgagcgagagaacgctttgcgttattctttttttctctgttcaaaacaattaattagcacttcctccatttcataatgtaagactttctagcattgctcatatttatataaatgttaatgaatatatatatatatatatatatatatatatatatatatatatatatatatatatatatatatatatatgtatagatttactaatatctatataaatgttagcaatactaaaaaattttacaatatgaaacggatggagtagtagcagtaacgtttttgggtttttcttgagtgtagagtggctctgcccttctcgctctgttaggagttatgtttagccgccgtagtagtttaattagccttccttgcttcaatttttgttttgctttttctcccttcccttggcataagccggtctggtgattacgttgtgtaataaaaactttttttcttcttatatattaacgtgcaatccttttgcgctagcgaaaaaaaaatcagtaacagtatgagcagcaagtacgtcagcgtagatgccattagcccattctgaattattccctatcgaatatccaaattataccggcacgtactgttgcttgttggggaggacaaacaatcagagaaagaggttgagtaaagatacacaactcaaactctcatcacagacagattcagagtctcacggcatcaccaatgattcgatccactaatttccttgttccaaaccacaacgaattcatgttgcattcaatcagtagctttcaccataaaaaccagacatctgtcgtaattgtgcatgtaaaatgaatgtttagactccaaggaagaaaaaaaaggacatactaacaacaggaatctgacgacttgattataataattgcgtgttctctgcttcttctcgttcttaatatctcgagaaatatcttccaaactttgttagcacgttcttatgggaccaggaatgtgccgctgacagtctgacagagacagtcacacatgtgcccacacagacctgttgttaattattactagtatagttcagagataatcctaaccactggatatgttgtttgtggtcttcaatggaatgataaagtttgctaattggagcagctgaccttaactgaggtatacattaataattcagcattccatggtgaaatctgccactctgattagatgatagcagagatgagtagagctaaggcacaaacatttctctgatttctgaaacatgagctttactttcatcatggagtaatctgcttgtggctctcaattatccaggggactgccataattctcgtcaccagcaagggatgtgcgttgtcggggctatcaacaactacaccgatcagctctacagctatggcgattcaaagagttcatgtaagcttatctgcaaaacacagtgccaaatagtgctctgattcagcaggcaggacactgatccgatgatctctgaacatccatacacatgcactgattgataaaccagacaacctgacggagagcctgatgttcctggcccacttcgtcggcgacgtgcaccagccgctgcacgtcggcttcgaggaagacgaagggggcaacaccatcaaagtgcactggtaccggaggaaggaaaaccttcaccatgtctgtactgcttctctcatgtcatgtcaactgaattattcagatcagcacaaactgccatttttcactcacaagatttctgtgttcatgtgctgcttttacaggtgtgggacaacagcatcatagagacggccatgaaggacttctataacagaagcttggataccatggtggaggctctcaagatgaacctcacagtgagagcacagacatgtaaaatgatttatcagttcagaaatgcttttccagtttctgatgtttgtgtaaattgtaggatggatggtctgaagatatcagtcactgggaaaattgtggcaacaaaaaggaaacctgtgcaaatgagtaatgatatatcctgctcaaacacttccacctgtctagtacatttttaaagagaaattgacatgcattgtttaactcaatgtcatgcagctatgcaattgagagcatacatctgtcctgcaattatgcctacaaagatgttgagcaagacattactctaggaggtgagtatacttctttatatcacagtggttgtgactaaaactagtacaagaagtcattttgggcttagggcaataataattggcaaattctgcatcctggaatacagatgactatttctactctcggtacccaatcgtggagaagaggctagcacaggccggcatcagattggcgttgatactgaaccggatatttggtgaggataaaccagatggtaatgtcataccattacaagttcagtaagggttatgatcaccagaaatattcaggagaaatgttatttgttgctgccactctaattagtggttgtgcacatattttataaaaagcacacatacctatagtatagaattcaaaaatgtaattgttgtaattgcttattggaaagcacatttatttgtaagaagcacataggcctagtacagcattcaaaactgtaaatgctgtcattcatgtacaattgaaagtagtctgtgacaagaaacacataagcctagtatagcattcataaatgtaattgttgtaattcctctatgtttgaacagtgtaccacttgaataagtgtgtttcaaatcgattcatttccctctaatcatctcatttctttatttgcaaacatttaagagttgtcgcttatctctgatcatattgtcaattgcacttttcttcattagctactgagaaagtagagtacgctaaaccggtatagggatgttcagctgccaaatcgattcaatacgtggggaaaaacaagaatcacattgaactcgatgtaacacatagttaattgaataaattttattcatatatgaatcacataaaaatacaccatctaagcaatatgaacctacatacaatcgatcaatgtgagcgaccaattgaacccgccagtaccttagtcagaacgtgagtcgcgatcccaattgggcagaagagcaggcacagagaaaccgaatgcctggtctctatgttgttcttgatgccgtcatggtacacctgcctgcattgtgatcccaaaactcaagccattttaacaacctcctcacgcttgcaacacatacaaccatcatccataggtacactactacacacatgaatcaagaatttgctcaccttgcggcgaagaggtcgacggctaggaggtggatccaggcggaggcgacggtcatctcgctggcgaacatcctgacgatccccgtcaactgcgcaggagaagagaaaggttgagagaatgctagtgatcatggagtgcagagtggtgtcactgattgattgactgacctcggggagccagtacttgctggcgaacatggcgcgtagggtgtcgggagtccaggataggtagagcaggtaggcgtagaggatgccgagggcgacgtacggcgcgctgctatccacggcacgcttggtctgcgccagcacagagaaagattagaggagcaagtgagagcaattcgattgtgtgtgtgtgggttggaggattgaggaattcttacgacgtcggcgttgggggcgacgaccatgagagtgtagaaagggaggacggcgatggtgccccaggtgaaggcggagctggcaatctgagacgacgccatccctgctcctcacaaccaaatccatggcgaaattcgtcagtcagtcctacaccaatcagttgtggtagagctagaattgaatggggccgcagaggcgttacatgcgcgaggccggaacagaggcgccctgccgcgggcggggacggcggggcgggagaccccggcgagctccggccggagagggcgcgccgcccacgccgacgctgcgccggcgccgtttcccgtgcggagctggccaccgggcagcaccaccgggcgctgctgcctcagcgccagtggcgcagccacgccaacctgcagcagcaaatcaagaactgaagctaccgcaactccgcaagtgccaagattgactgagtcatgtgttaccggctacgtacccgagcggcggaggagaggaggaggagagccgccattgcagggcaggaagcgagcaggagcagcggggaggcggaggaggggaagaggccattaccagtggctggctcaccctttgtactagtaggtcctagctgttgctgtggcgccgctccggccaccactctcactggtgtaggtgtagtagctgttgttgccttcccatggtcggcccgggtggtggacggcggccggggcccgccacggtcgaggttggccgtcgacgcgtggtcgccaccaccgaccagtgtccacgttattgatcaccaacaaagcaagaagagagatcgtgcttgttgggtcgcgcccgagtcaactggccttggtacgaagaaatgagagcgtacagagacaggctggccccgggccatgtgcaatgtgccatgtgccgccgccctcagtttgccggcgatctcctcctcctgccctcgatccgtctcggtcaccggccgcagctgcgtcgacaagtcactcacacggcttcatcactgtcgccgcttgcacccgcagagtaaaacacttcacactcctttaggaatgattggtacacccatccaacatcataaccaacaagtataggatgattggtaccccacaacatagcaggatatgatatcatcaacaccaacaagtacagatgattcagcaataatatcacacatggcatgttggtaaaagcaaacaagattcagaagaaaaaggaaaaacaaaagaagcaaaaatgtttctcatcatctgagatgctgcagatgcagaaaaacgagatagagcaaaggtggtgttagtcctcaggccgaaccatttggcccaacctttccttcttctgaccgatcagtctaacccgattaaaactttttaactctctatctctgcaaagttgcttgcatctccccccaactacgggcttgggaaaagatgcgaaaaaggtaactgtattcttttctaggatctatcccttcttattagccttcttcattcactcctagaatcttcacttcatctcctttggattctctgtataagcttttatcaactgctggacaaatatacttctagaacgacaggtgagacgccaccatggcctggagcttgtcccagtcggatgggatctccaggttaggagatagcacaaagcctgcggcaacagcaagcgtgataaccagcaggctgcccttcaggcaggctccgccgcggctcaaccttccaaggatctccttggaatacttgtccgcggccttgatagatgcctgctttccagagtccgttgctgcttctagggccgcctcattctgcaattgcaaccaattgcacatattactacggagtacaaatacctagggggtatgtgaacagctaaaggtggtggtgtcaaacaagtttacttgcttttgcatgtccttaagagttgtggcaccttgatttccattttatcaaaaaaaaaaaggaggtaacgccatttatcccaaactaattgtgctatcaagaagctctctttttgtcatgaatcagaattcactagtcatacagaattttactactatgcaaaggatagcatcacattgcatatacataagaatgaaacaaacatcataaacagtcaaacaaaacaagtaatgcaacagggacatatcataccttagtccttaagttcttcagagtcaccttaagagattcagcactgagcttatgagacagctcgctccattttgtgactatagtgctaaggactacaacactggcttcaacattttcaggatgaagtctttcctgcaaatcagaattaagaaaacttcagttgcaacattctcacttggtgttataaaggcagacagacaaagattactcacccacagcttgtaggactctgcattttgagtcaggcaccaaatgaatacaccagcagactccccggtgaggtctgcgttatctgaacataatgtgcaataatgcaacaactcagagttgcaaaacaaaggtaacaagctctatatagaaagagaagttagggtgaaaaaggatgacagctcactttcttgcattgctttcacacacaatggcaaaagctgctgtgctgcttgtttcacggtttttgagccaggaggaccagcaagggccaactccttgattgttgggtaggctgcttcaaacctctctgtagcctaaagagttccatatgatgaccagaagtcagaacatcatcgcatatcaaaatttcagcaaacaggaaggaagaattaagaacaaacctttacacgagcgctggaaacaggaaatgcagctctcatgaacagatcaaatgtaacagggggaatcaggcgttccccctttctaacagcaccattcagtaagatgcctcgagctttgggggcagacaaaattctgcacgtgaaatatcaaaaaagattatgcatataaatacttctgatatatatcagaaaacagaaaaacggctctagattcttaatcaggtttaagttgagccatacctttcgagcaactgcagaactaaatctctcgtctggggattcccacttggcttagcacacagtgtgggaaacaggaaatgagcccaacaaaacattccagtcactaggtcaccttgagatgcctatgatacatcacgcaagagatattttttaagaaaatataaaatgatagtatggagcactgaaaataattagcaccattcagaacaagtaagagcacagcagggaaaatatacctgagcaataacccaaacaatgattggaagcttttcctgcccaagatacttattgtttcccattatttttggcaggacgtttgttagtacctctggtttccttcttacagtcaaggcaagcacaacaaatattgcaacctgaacagagcaatagtcatttaaaaactataaaccaacttgaaaacaagatagaaccatccataattacaatcacaggtccgataagcaagtgtgaattatggcagtcagattattagatcagcattttaggttttatcatatctaccaccatgcaatcttcagggccctaaaacagaaaaaaaaaagtttaatctccttcatgaacaccttacataaagtaggacttgaatattctgtcatcaaaatgcagttcttcttagaatttatataaactttttagcaatcgtggtgatccatagatcggagtaataaactaatacaaatgatcgaatcgaatcgaatctgcttattatcttacttcttgtgaggaagtgttaaaagcaatgagaaaaggctaaactaattgaattacacaatcagaaacattcacatctatctaaagtaaatggtattgacaagcacaagcttccagcaatgcaggatgtgagcaaattgttcatataatatttcaattgcaaagcctacatttttttttctcattgcaaggttgttgcttcattagatgacagcattagcgctaggctcagttgatgtgaatacaatataggacatatcgcaaatataaaacgcatgctatttccatcttgtagagcatttttatgctgctttacatcacaagtccatgataccatgcagaggcttgtatagtgagagttaagtcgtgatcgaacaaggactacctgggcccttggagtttgctgtgcggccttctttgaacccttagcgcctactgcttgacctgacagttcagacatgatgctgtctatgcaccacatgacaaagtctcccagggcatcaggagatctctgattgatccagtcactcgctgtgttgcgaactggttcaggaatatggcacaagggaatctgcacaatatattaactagttagatgcaaatctaaaaatagagagacacggaaataaagggacattttcatgcttataaaatcaaaacagaagtactagaatccattaatacactgaattattaattgcacgagtatgtgtcgtttcttttctggaatgaaacatattgcatatttatcaagcattcgcttccgatttattaaaggctaagaaatgccatgctattccaattaatgtgaaccatgatacacccatttactcctcatactacaatccgcaccaaccccccaccttccaaattaacttgcctccacgcctccccctttcagagcggaaaatggaaggaactgaacacaataccatgtcacaaatacagaaagatttttggacaatgcggatttcaggtaaaccgttaaatgtaaactcaagttgttgcagtaattgcattgaacttatccagctgtatcctgttatacatgaataatcgtgttcggaaataatttgttttaattgataatgcatccacagggtgagcagaaatagcataaccatccttaaaactagcatacttgacaagcacgtttacagcgacgtcaagtctgcaaataattcgaataatattactggcagttaccaaaagcagcattagcatttcacaactcaatgatgacgatgcatgaatcagtatcaatgttcatgcacaaccattaattttcgtaaaatttgtaagtagatacaagaaaaagatcataagaacttaacaatcagataaaccgcagtaacatttcatatgtgatgcaagtgaatcaccctataaactgcaattgcctttttatatctggtccaaatgcaatatctctatgcgtaaaagagttagggcaactctagtaactcacatcaaccatcttggacactagtgattccttgaacatcttcgcccaggggaactgggcggcgctcacgcttgcaaatgacctgccaaagtagtcggcgaaccgcatgagctgaatatcctgctggttctcgtaagattcctgcacacagaacagagggttagaatctacggaacaaaacagaaaagagctatgacacgttaaaagatctaatagttgcaccaaaacccccatgctttccaagatcccaagatcccgtgtttttacatcaaggagatcccaactttctggtacgaccagaattttcctccatcttaatcgaaaactagtagacacccaacattttgtcggaattttgaaaaaacccgaacgatccagcactaaaccctcatcagatccgatccttaacaaaaagacaaaaatatgatccagtccaaacaagtcgagatctgacgatttccgaagaggaattcagcgaaacaggacgggtattaccgagatctgcacgagatgcgccgcgaggttctcggcgtcgatcagagcggccgcctcggcgaccgtcaccttgggcttcttcggcttcttcaccttgggcttcttcacctccccctcggggcgagtcgcctgcgcctcgtcggagtcgtcgtcgtcgtcagagtacgcggaggccgtggcggcggcgatccgcgcggcgtcggggtcggccgcgtccctggcggccaggagcgcgcggtggcgcttctcggcgttcctgtcgacggcctcgaacacgttgaccttgccgccgccgttgggcaggaaccccagatcgggagcagccgcggagggcagcgccgccgccccctgcttgcggtggcgcttggggtaggtgaccttctgccacccgtgcgaggggtcggcgaccacggcgtccatcgcggaggaggaggaggatgagccggcgaggtcgtccatggccatggcgagtcgaggtgggcttcgtggaggcgagtcgaggcgagagcgatgagatgagcgagttgcgcgaggagaaaaggagacgcgggggattttattcccgtcgacgcgaacgcgagggcgaggcgtgtgtaaaatctcgctggttttctgtgtgctgcctgcgccacctctgtgtctactacccactttggtgtcacgtttgtttcgggctcttctctctctcttttttttctccttttccgatgtaatgtaatcttcttccccgagttcttgttggattatttttttctcactttttttttttgctgctgctccttttttattcaggtgagatacctctggatggattctgttagaccatgatgatgtggatgtgagtatacttgtaaatggatgggataatattgttgtgtatatatggcactatgagcacatttttgtctgtcggacatattgttaggtttcaccggtttaccttctcacatgttaataaaaaagctagggttttatttttttggtaacgaatagcgtaaatataaatgtggatataagttatggtatctcagattggataatacgatgcgtggcattactagttttctcctcgttcttaccccttataaaatactaagcatttttaattatgggcgggtgaaatgtatgattctgacgtgaattacatggcatgaaaaaaaaaatatcgtacgttaatattgcgataaacggtatatggattttttttaactagtggtaaatacatgaagcgatatgtgaacatatggttgaatgtcaaattacctatcattaatatataggtggaagttgttggaagtctattagtactactagagatgagagagatgatgttgacctactgtgatgtgtcatagtagttggcatgcctcactttcctatagcaatattgatttgtccaattttacaatacgtcgtgtgtgtttgttgattatttattattaataaatggtaatgttgaaaagagttattccttcatgtatagctaacagagttctctacgcaatgttatgatataagtacaattgtacttgatatacatttttacttataaatagcacattgtgccacctttatctcataacgagggttctccactgtttttttttccttttttcaatgttgtagttgtccctgacttcttattaaattctgatattgttatgtggagtagctctatttcaatcctgttgtacttcgaagatatagatagacataatgagaatgatcatatcaacgataaaaatcataaatgacacaatagatgtatacatttttgcatattcgtctttgataagttccacgagtttacctttttaatcttggcacaaatacacaacgcaacataaaatttccatgtgatcaatagcactttgatcttatcccaccttatcatagtgtattgatttatactatatatgtagtactggtatacttatgatctacctaaattgtccacatgatattatcaagggacagatatttccatatcacacaaaattaatttattagaataaagttgatttgtcagattttcttttttagctttgcggatggatatgacgcatcatggtcagataagatcagaaagggcagctgcaaatgcaatgacatcatccacggaccgcacctactactctgcctctctctgcagagaccaccagtccacgtgtgcaaatgtgttgggccatctcagaattggatcaaggcccatcactctcgactggtcagataggcccatttcaacgtaacgactttgttgggccgaatgagagttgggccgaggaggacattgcgaatttattaggcaaccaactaaccaaccaaccagtaacagtattctgattctccatgaaccatctccatcactgacagaagaagtgtcaaggacgctatggaagtctgtccgtccatgtgctgctccagcaagcacaggacgccttttttgtttcgacgaaaaaatctgaaagaaaaggccaacgtcaacattgacatgctcgtttttcgttcttttttttttctggaagaggataacaaagtcttatcagcagttttgtttctgttccgcagcaacgaaacttcgatgctccatcagtacagagaaaggaccatttgggtacctggattggacaaaaacagatttggtttcggctttaaaaaatactcctatcatgtgggcttaaaactaacatggcacttttctgcggattacttgctaagaataccttaaaaaaagaatttacttctattttttagatgccttcttcaaagctctttgtcaagcttatttaccaatatatatattttttatatttataatcacttagataatccactataaacatacggatctgttcaaaaacttaaccaagcggatcatcctcaactcatgatgattttcagctgcttaacacaatttctgtccttaggctattttgttttttcacggcaataataggatgtgtttatgggtttttttttgtttggtggcatgcttctgcacatattttggggttgtttgaaagtgttggatatagctgttgtagcagccagccaacacggttacaggcttgcagccagcgagttgttatgaaacgtgcatcaaagctcattaaatgaatgccgtagcggttatacgatgtacattcaaatgttgcgtcgagagtccgtgctgtgtagttgtagttcaaaacgttgtagcaagcacttttaaatagccccaaggtaattaatttttatagccccaaggtaattaatttttatcactcaataataaattagtatgttaccaaattgttggcatgttgtataatttgtctcgcgtatcacttaccatatatacactttatgacacttgctgcactttaattccacccatacatcaattagactaccgctaacaaaacaccacatgcaccaaaaccttaatcgccatgagtatagcgaatactctaaatcaagaatcaagacgatgtgttgtgtctcttttggcaccgaaaactctgatggtgaaaggtagggagagggaacaactgtgatatgatgacacaagcatcaaattcaggtgcggtgaattatgataattgagaatttgctttgggtaaaaggtgattgcctgacagtaagttaggaatttgtttactttcttaaatgtaattatttcgacagtccatagctctaagtttgcaaaagagattttcctaagctaaaacttcctagtttcgacagtcaattcttttcttctaaatataacagtgaaacaaagttccaccttaggtttaaaaaaataaaaaacttcctagtttttctttgttcgaaccatgctgtacatgcttttctaccatgtgcgtctcacaatatgaattccagacggtaaacctgtttaccgtttacaccatggggaagaaaaacccagagagatggtcaaaatttcgttaaagaattatcaggaaaaagaacacaaaagtagtactctcttcataggatggaacgcttcataggattatgaatatggacaatcccaaaatataagtattttaaactaaaatgtgacacttagaacctgtttagttcgcgaaaagaaaatttttgggtgtcacgtcggacgtttgaccctcggaagaggttttcggacacgaatgaaaaaactaatttcatagtttgcctggaaaccacgagacgaatcttttgagcctaagcctaattaatccaccattagcacatgtgggttattgtagcacttatggctaattatggactaattaggctcaaaagattcgtctcgtgatttcccccctaactgtgcaattagtttttttaatttatctatatttaatactctatgcatgtgtctaaagattcgatgtgatatttttgaaactatacagggtcttagtttggttagattctacagagtgtttttttttttgaaacctaaggcggaactttgttccacttttatatttagaagaagagaattgacccagtttataaggaaaaccgggcctgaaaaccacacaattacacggttaattatagtaaaaccggctgaaacccaccgctacacaactaacaacgacggcggagcccaaaagcaggatgtcaccgccaagctaaacacaaaagcgacataacaactcccacatcgtagaagaggtgttatcattgccgagctatccgcccaagcgacccagcagcgccgacttcacaactgcagcgacactgaagacacgaaagtcgccaaagcgaaaagcagctctgacatataacaatggacatcagccaagccatcgaggagccactttcttcacgcggccagcaccagaactccttggaagagacttgtaacatcctgaaaattcaagacaataaaaatcactaaaattttgaactttttaaaacttttacatcatgctggttgttatgattgctattgcttgccaaaccgtaaatgatcacaaagaaagtaaagtaaggatctaaaatttaagtaatagataaatttacgagaatataatattgttaaccctacaaataattacgcacaagaaaacaaagccagacaaacggaaggttaattactaatttaaattatggattaaatactaaatacgtgaaccatgtgttgcgtgccatgacgtctaaatacacatgaaatgatgaccatttataatggaactctatctataacatagtttcactaggagtaattaatgggatattactaaactctaatggtctatatatataaaggtaaaccaattcacatgaaataatggtcatataattaaattaagctttataaaattttgtgaggttttaattaaacaattagattaatattgtgccgagtctcaatttactatttatagaataaatagattgaacctatccgtgtaaaatatattgctatacaactaaacttgaccaatctgctaatgtattaatcatgacaagtcgttatattaaatttaatagtaccccaaagtcttcaaaaatatataagttcaccttagggccaataactcaaattaatctaaaaagaattcatttgtgcgataaataaataaatatgggtaatattaatctagggtgaatccattggttagaataacacaaatattgagtaaacttcatttgtgtaaaaattaggatttatagaataaaatttatataggaataggctaaaatagggttaaatagccggctagcactgttcattagccccctaggtgttcgatttagttcctagccgtcctacccctcctccttctcctgcccgatgccgctcgtgtcgccatcgtcgtcgcccgcgccgctgccgcgcgccatcgccgtcgccgtcgagccgtcgccgtcgccaccgcgccgtcgccatcaccgccttgagccccgcgcgccatcgtcgtcgtcgtcac

SEQ ID NO: 14706 - DNA, 1149 bp, Oryza sativa
tccgacccaaggaaatatgcgtggggggccgaatgcccgcctcgatatcgagcgccggcgcgacgctcgtcacgccgcccacgcaatgaagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccgtcaccgaaaaatacgacggaagcgtcaaccccgccgagtttctccagatctacacgaccgggatcgaggccgccgggggcgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggtgaagaagcggacttgcatgcggtacagcgaagggacgatgagtctcttcgctcgtacattcagcggttttgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggtgtgacagctccggccgcccccgggtccgccactcggtcagagcggcggaacaggaggaggaagaaggggccggcccgttccgacgacgagggtcatgtcctcgccgtcgagggcgcttcgtgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagcttggctgagcggacgaggaagtgggaggaggagaagaggcaggagcgccgtgagggcaagacccggcggctcccgccggcaaccggcgaggtgaggccaagcagaaggccaccgccgaggacatcaacgatgggggtaccgagctcgaattcgccctatag

SEQ ID NO: 14707 - DNA, 442 bp, Oryza sativa
cgaggcggccggtcggtgaagacgtagacgcccaacaacggcggcataataagtcagccgtgcaggcggaagcaccagtcggcggcggacgaggcagccggtcggtgaagacgtagacgcccaacaacggcggcataaaggccagccgtgcaggcggaaacaccagtcggcggcggtcgaggcggccggtcggtgaagacgtagacgcccaacaacggcggcataataagtcagccgtgcaggcggaagcaccagtcggcgacggagaaggcggccggtcagtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcgg

SEQ ID NO: 14708 - DNA, 2526 bp, Oryza sativa
tttatctggccccattttatattggaatttattaattaaaattagatcttcttttcaagacttttaaaattattttctagaaattccatttaaccaccaatttatataatttgaatttttagggtgtgacaaacctaccccccttaaacagaatctcgtcctcgagattcggaagaactggcgaacagatgcggatgagctgacttcaattcatcttctcgttcccaagttgactcttcttccgagtgattactccactggactttgcaaaaacggataactcgattcctggttcttctctcatctatttccaagatacggattggcttttcaacataggtcagatcctcttggacttctatttgttcaagattagctccttcggtaggtacccttaaacatttcttcaattgagacacatggaacacattatggactcctgccaaagattgaggtaactccaactgataagcaacttctcctcttctacggacaatcttataaggtcccacaaaacgcggtgccaattttcctttggtgtgaaaacaatgaactcctcgaagaggcgtgacacgaagatacacataatctccttcttcaaaactcaaatctctgcggcgattatcggcataactcttatgtcgagactgagccacacgcaatctttcttgaatgattttcaccttttcttctgcttcccttaggatatctgtcccgaaaacctgacgttctcccgtttgatcccacaaaagcggagtgcggcacttccgaccatacagtgcttcgtacggagccatctgaagactagcttgataactgttattatacgaaaattctgcataaggtagattcttatcccaacttccaccgaaatctaaagcacaagctctcaacatgtctttcaaaatctgattcaccctttcggtttgtccgtctgtctgcggatgataagcagtactaaagttcagcttagaacccatctcttcttgaagtttcttccaaaaatttgaagtaaactgacttcctcgatcagacactatcttcttagggacgccatgcaaacacacaatccttgccatatacaattccgctaagcgacttccagaataagttgtctttaccgaaatgaaatgtgccactttggtaagtctgtcgactattacccaaatagagtcatggccagatgacgttctgggcaaaccagtgataaaatccataccgatttcttcccatttccattcaggaatcttcaaaggctgcagcaaactggcaggtttctgatgttctgccttgactcgttgacaaacatcacatactgctacgtattctgcgatttcacgcttcatacttgcccaccaaaatctttccttgagatcctggtacatttttgtactaccagggtgaatagagtataaagtatcatgggcttctttcagaattgcatcttttaaatctttgttgtcggggacacagattctctcgcccaaccatacagttccgtgctcatcctccaagaaaccaatagcttttcctcttctcatattcttcttgatttcttgaatatcagaatcattaatttgggcttctctaacttgatcaattagagtgggcttcgcttctaaggctgcaacgaaacctctactgacaattcccaaatttaatctttcaaattccttgcataattccaatggcaactgtcgtccttctgtagcattgcaatagcctttcctgctaagagcgtctgctacaacattagcctttcccgggtgataatgaattcccatgtcataatccttaattaattccaaccatctcctttgtctcatgtccagatctggctgagtaaagatatactttaaactcttgtgattggtatacacctctgtacgagtaccgaaaagataattgtcgcgtcccaaatcgactctaaaatacatcctcgaaatcgtgctgagaataattaaaattcatgtgaaagccttcaacaattaaaatgtgcaaatttaaaagtcaaataaggcttggaggatttttgtatatttcctaaaagcctaaaatgcgtaaataaattttagtggaattttcagagcaaataataattgagaagaaataaacaaagttaaaaaggttttataaaaagaaaatccctaaaagtcttctttccccccccctttccctcttgggccggctcggcccaactccctccctctctctcctctcccccgcggcccatcggcctcctccccgcgcgcgcgccgccgacaggcgggcccgcccgccaccctcgctgacgggtggggcccacctgtcatcgcctacctcgcgccgcgcccgccgcccgcccgtgccctagcgccgccgccgccgccgaatccgccgcatcccgccgtccccgcgcgccataaagagggggaaatcactccccgtgattccctccctctttccccctcttttccctctctctttccatcggattcgctcggattattcccgtaaagttcgccggcgcatcaatggagcccgaga

SEQ ID NO: 14709 - DNA, 1953 bp, Oryza sativa
  unsure (1)..(1953): unsure at all n locations
tctttttagctttaggaacatgaaggatatttttcaactgaatattgcgtatgggggtatgaataatagaatgaccaatatgcttaatgtccatacctgcaccgcttgccgtgtgaatctgttctttgccgttgtacttctcatgggttgtcagcttgtccagttctcctgtgatgtggtcagtggctctggtgtccatgtaccaatttgtatctacaccataggaagccgcagctgctgtttttgaatctggaatgaaattttcatcatacctgtaccagcagtctgccaccacatgtccaatcttgccacatagctgacaggtggggcgcggtttgttggagaagcgcgcgccgccaccgtttcctcgcccccggcctccgcgatcgccgcgaccaccgccacggacgcgaaacgtgctggtgttgccggtgttgacgttgttgctgaagccgccgccgcctcccttgcctcctcgtcgtgcgctgttgacggaggaaccattagcctgctgtcgcagcttggctcggctctcaaaactcaggagctgggtgtagatttcggcgactggtacagcctccgccttgccgacaagagtggagacgacgggctcataatcgtcgtcgagtccggcgaggatgtacgacatcatcttctcgtcatcgaggggcttgccggcggatgacatctcgtcagctagcgtcttcatcttgccgatgtactccgtgacactgagatcgcccttgcgggtcgtcaacagtgcaagctgcgtgttcagagcacgcgcacgggattgtgaggagagcatcgttgtgatcactctccatgtcgcagccgccgtttccagattgacgacttgggtgagtatgtcctttgatacagatgcaaggagaaatccaagcacctgttgatcgacgacaacccattcctcataggctggattgatcttggtgatgaccttgtcgcctttcttgacgtcgatcgctgccgacggagcgcgagtcgcgccggtgaggtacccctccatgcgggcaccgcgaatgatgggaaggatctgtgtcttccatagaaggaaattattccttgtgagcttctctgggacaacttggccggagagtggattggtggtggaattggaggaactcgccatttttggtagatgcgatctcacgcgtgcatgattggctctgataccatataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcacgtaacaactctatgtaacaaacctctatctctaacaggctgcaggcacgcgatgcggacaaatgatgcagggacaggacgccagtgctgacagcgatgcacctctggtttccttcccagccgtagcggcgctggttcactacaataattttacagttaaataaatgttgccacaatcagacatactataaagggaggtcaaattggcatgtaaaatcatattgcttgtattgtttcaatcaacatgcttctctaacttccgaagctctcataaaaactttacgtgctttcaaattaatatattcatcattcaacactattagcaatttaactcccaaaaatgacatttcaatgtagagttatctaaccagcggtcctgtacttggcgtctagagccagtgggccttttagaatatcggaaaagataaatgataatacatataaacttgaattgcctctaaagtttgaggttagtcccacatttaacattttcgatttggagctatatttgagagaaaaagatnnnnnnnnnnnnnnnnnnnnnnnnnnnnnnnnnnnnnnnnnnnnnnnnnnnnnnnnnnnnnnnnnnnnnnnnn

SEQ ID NO: 14710 - DNA, 114 bp, Oryza sativa
atttatgtacgtagtttatgtctacatgtctgttatctatgtgactctaatatgttcgcaatgatcaatagtatattgcatatgaaatagtcaaataaaatagagataatccat

SEQ ID NO: 14711 - DNA, 1182 bp, Oryza sativa
agaaagaacacacgcgcaagcctactaactgctcgtctactgctgcgacgggccaggacgtaaggtgagcacagccgcatcctccgtgctaccaacgccggaggcttccccctcctggggaaccacgggcgcgggctcggcacgaggggtctcgacgaagcaggtccacgccagggactgacgaacaagctcgggcctgaaggtgctcttgcgggcggtgatcttctggctgcggcagacgcggcgacgcttgggacggcagtcctctccctgggcgatcttgagctgatgcagctgcgcctccactgcgtctaggtccttcttgagctgcaggttctcctgacgcagctccaggatcttcatgttgttctcgaccatcccgcgacgcaccatctgatggaagtcgatacgagccgcgtcgtacgcctccaccatgcgcgccaggtgcacgatggtagcgtcatcctccgagctagcatctcggaaggtggcgtagtcgcgggctcctccgtggcgagggtggtagcggtagggcgagtgctgcaactcgtctgggtagcgctggtgaagagtgccgatggcgaggagagcggcgctctggcaagcggcggggaaggaatctccacccgcggtgactgtcagcgaagtccgctcgggagagccagcgaggatcactgcagtaacctcccaaccagcgtggggctctgcatcgtcaccctcctgctccggaagcggcctggcctggtagtccactccatgtggataccccaaggccacgcacatgccccgcagctccaagacgaaaccagtcatgtccaaaccacgacgggtgacgctgccggccatctacaaacaaaaacaaaaagaaaacaacattttaaaggtcagattttggcgataaatgaagcagcaagacagagatagactagacagttttcacaaataacaaaggatttttatttttgaaaatattgctaaggcttgggatctacggctcgtcctaaggtcaagggtggctctgataccaacttgtcacgacccggaataacccaacgggcgttcctgacgtgcgtgcattaatccttgccccaggaggcaaggtacaccaaaaagtgatacaattcagagtttaacaaggcggagcgtaatagttaacttattacatgggcagcgaaggcccaa

SEQ ID NO: 14712 - DNA, 714 bp, Oryza sativa
catccaaaatttgaccaaaaacttgaaatatgatatttcataatttttatacaaattttgaaaccttttctcccaggggtattttggtcatttcgacaaatttgtacagtactaacggagactaaccggacggcgatggtaaattttagaagttaagcaaaagtcgatggcatattgtagaacatgataaagtcagtggcaaatcgtagacgtgtgacaaagtcagtggtatataatggattctctcaataaaataattaagtgaagcacccactagaagtgaaataaaataattaagcaagtataaccattggaaataaaaaaattaaattagtataaaaatgaagtgcaattactactgttagtgaaataaaataattaagtataccaaaaatatgcagtgtatgtggaaatatgttaaggaaaataaaagaactaagtgaaataaaataaaataaaattgctgtaggcaaactcacctgtgacgggctctatctgtggggccatcacaggtgacctcacctgtgatggcccaaagtgttgggcccgtcacaggtggcctcacctgtgacggctccacagttggcgcccgtcacaggtgaggccacctgtgatggccccatagttggcgcccatcacaggtgagtttgactagggttggacatcttctagatcgatccagatctggcacccactatcactcactcactctct

SEQ ID NO: 14713 - DNA, 1384 bp, Oryza sativa
cccgtataggaatatgagaaagaatttcaatggacacaaagatacagccggacccccggcagagctaacagggatagaggtgcacaacttagtgatgggaataaccaacgagtttggaaaaaagaggaaaattggaaagcgaaaagagaagagcacatcgaaggaaaaaacagaggagcatgtggaaaaacaaaagacaaaagagaggagcatgtggaaaaagaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcgctcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactaaagatcttaagttggtaggaatgaagtcgcatgattgccacgttcttatcacacagctgttgcccgttgcaataaggaatattttgcctcctaaggtgcgacacacgatccagcggttgtgttccttcttcgatgcaatcggccagaagatcattgatcccgagggactagatgaactaaaggcagaacttgtgagaaccatatgtcatcttgagatgtactttcctccaactttctttgacataatggaacatcttccggtgcaccttgtgaggcaaacaaagtgctgtggttcagcattcatgacgcagatgtatccttgcgaaaggtacctggggatccttaagggttatgtacggaaccgttcacaccccgaggggagtatcatcgagagttacaccactgaagaggtcatcgaattttgtgtggactacatgtcagaaacatcttcaattggattaccacgatctcatcacgaagggaggcttgatggtgttggtactgttggaagaaagactattaggttggatcggaaggtgtacgataaagctcatttcacggtactacaacatatgactgaggtggtgccgtacgttgacgaacaccttgagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcttgaatggagtgccaccacctggcaaggatatgacataaatggatacacctttcacacggtaaagcaagacagcaa

SEQ ID NO: 14714 - DNA, 5419 bp, Oryza sativa
acgacgcccccctcatcctgaacatgatatgatgaatggatgaattgcagtttggttggatgacttgcttgaattgaatggatgaattgcatgattgatgaaatatatgaggtgatgaatttgcactgtttgtggatgaaatatatgcactgtttttagtctttttgtattagatgattttaggattaattttggccttggtatatggaatatatagccagggttaattttggccttgattaattttggccctggtgattaattttgtggatgaaatatatgctactgctgttatatggccctgctactgctctgctgtttatgtttctgttgtttctgtttatgtttctgttgttgtttatggccctgctactgctgttatatggccctgctactgctctgatgtttaattttggccctggtgattaattttgtggatgaaatatatgctactgctgttatatggccctgctacagtgctactgctctgctgtttattaattttgtggattaaaaataatgactctgctgttatatggccctgctactgctcttattgcgcctacttgttctttttttttatctacaattgtttatatacatgatttatataccactgctgttgttgcccctgtacttcttattaaatggccaatgatgaattgctcaataaaattctatctatacctgttcttttctttatggataagaacagactatctacacttgttgatttatatacccttgctgtcaaggatgaatttccctctgctgttgctgtttatgtgaatttccccctgttgttgctgtttacgtgaatttccccctactgttgctacccctgtggcatatatacccctactgctgttatatggccatgctactactcttattgtgcctacttgttcatttttttatctacaataatatatgcatgatttatataccactgctgttgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctactattatatggccatgctgttgctactgctctaatttcctgcacttgctcttttctttatggataagaacagatgaactacacttgttctattttatggataagaacagatgaactacacttgttctattttctttgggttgctttttcctcctagtagctgatttcctctttttatcccttcatgcaaatgattataattgatgcatatttctgagcaaaactgaggccatatctttcatagtataccccgtattacattggatctaatgctatttagtataatggtaggaaatttataagctttttcgcgaaaattagaccatgtcaacgcccggcgcaaacccgctctccccaatacctgcgaggatccaggaagaagcaaacccagccacggagacagttgccgaaggtcatcccgcgacaacggcggtccaacaacccaaaattcatggtaatttataggataaattttcaccacatgaccacataaattttagctagcaccccttagcaaatattggcttctgtttgtgctgcagaattgccacaggaacaacatacatcgatgtcgggcgggacaagtgcaagtaggtctagtagaaatccctagtcacaaaatatatggccgaccatagtgcaagttataagagaggttgacgctagtggtaggcccacggcgcccaggactgtcattggaagatggtctaactgctgcgggctagaggcacgtaagaacttcgggatcctccataaaaatatcgggaaggtcacagaagccgagaaagagcgagcttggacggcaatggagaaatggttcacatttccggctgaagcaaaggataggctcaagcggaaggcattccaaaagatgggcaaagcttggaagaattggaagtcgaagctcttcaccgagtttgtcaacctgcccgacaatcatacgccgttcgatgaataccctcaaataaccgaagcggtgtgggaggaattctgctctctcaagacctcccaagagtttagggaatcaagcgaggcacatcgcctactacaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggtgcgggcaaggggtaaggtcaacccggacggctctgtcacatttgagaacaaaagtgatgccgtcgtctatcaggaactggtgagttcactacttaacctaactaatttccgctcgtataaagtacaagttcgtataaacgactattttcttttctagttgggcttggttgctgaacaagcttcacaaagcgagggttgagtccgcgccgaagaggcgcgaagatgacatcctcacaaaggcacttggaaccaaagaacatcctggccgaactcggggaattggtagcgatgtgccctggaagcatggactctctcagtacagctcccaatacaggaaatgaaaagtctccaaggaagagagggatgctcgtttgaaggccgaacataaggttgaggtcattcaagaactagaagctagcatgaatgcaagggtggaagaaagggttaacaaggtcctcgccgacatgaatataccccgtcacaacacctgctgtgcaaccaactcctcgtgcacaacacgacgcgagtccgtcacagcataggagtagttgtgcatccacagaggtgccggcccctggtcttccgatcgcaccactagctgcagtggaccacatcgaggtaattgttgttatccgatccatatctaataaaagacatttacacgttccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctactagctgggtatgccaaggtgtccatcgatatagtaaaggacacctggtcaggctatccgctgcccgtgcccccaaatgatgaaatcatgactttaggcgatgcgcgcaagacgttcatacaatggcccaaagaagacatagttgtgaagatgactcctcgtccaagtcgaccgacggagtttacacctcccaagtttaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacacggcaaggggaaggtcggggagttggcgccggagccaaaaagagacaaggctgcgacgtcgatgccaaaaaggggcaaggctgcgccagctcaatttgagctaggcatgccattggtggaggacaatgtgttagccgtgatgggtattgcttgccgagagctacataaacaatacatggagctaagcaatgccaagcggaaaatgagggagtcatccatagttagacatcacgaccaccagccgttcctatcgtcgcctgcctatataactataggctttgatgacctcttcgaccttttcaggatccggaaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagccaaggagtacatcatgtgcgcacacaaccaagagtaagaggacaatacccttcgtgtatattgtttttgaagttaaggttcttagtactaacactacataaccactgcgcaggcgacattgaattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaaggacgaactttatcatgacaccaagtttgcatgcgcacaacagatcggagaccaatgtggtttccacgtgtgccacaacatgttaacacttctaagagaggtgaaagatttcgacccttaggttgttgctaatggcgaataagctcatttcaatacctacattgctattgaaaacgtgctaattaacctcttatttattaaacagaaaggtagagctggcttcaagatctcacccatcaaccctcccgctatcagaggcgaagtgtgcgccttcattcttgcagaaataatgaacaagaaaggacgttttcatgtcaaatagactcatgaacttggctagataatttattgtgatgtaaaaagatgtttttataatttcttgcgatgtaaaaaattatgtttttatggagtgcaatgtaatttactttcatatgtgcaatatttatggtagtttactaaattgtcatcacatttgatcaactacgatttacgttgtactattcatctgttttctccttttttttcccttattgataggttgtggaggtcgagtacattatggctttaatccatttggtaagtatatatgcggttctatgagcaacgaccgaaattgtggctttcaaggggtgtgaatttgctgtgcaaatttgtggcatttgaactgcatatatgtgttgttggggatctgtgatgtttgagatggatctgtgatgttatattgggggggtgatgtatctgtgactagaatatatctgtaatgtatctgtgtttcagagggcatggctagcaaattctaagactagccaatatttagcatttatttattttttctgaaattaactcatcagtgacgggtcggaacaaaaatccgtcaaaggtaacctaacctgtgacggactagcaaataaagacccgtcagaggtgacctacttgagacgggcctttacttttggggccgtcacaggtagatcacctgt

SEQ ID NO: 14715 - DNA, 21992 bp, Oryza sativa
  unsure (1)..(21992): unsure at all n locations
gtcactgcaaatgctaatgctctcacttttagaaggtcttttggggagagagaatctgaggaatggctagctattgtgcgatatcattaactctattgagttgtctgatggcccagatgtgtttctttgggggcttaataagaataaaacttacacctctaaatccatgtatcgagcaattctctttagaggagtgactaacactagaatgcagggtgtgtggaaatgtccctgccttgaaaaaattaaacactttctgtcgcttgctttgaaaaacaggattcaatctactgaacagctgaagaaaaatgggtggaagggttctgagttttgtgttctttgtgggatgcttgaaaccactgatcacattcttttccaatgcccaatggcctctttagtttggtgcatatgcagagatgcttttgactcgagtattatacctaggtcttttgaggatttctacctgatcaatggctctttgggtggggatgatctgagagttcttttgtccctacttgctgcagtttgctgggtgctgtggtccactaggaacaacatgatttttagagaaaaattagtctactcacccctatcattaatgttccaaatcaattcatttttgcagctcgggagaatccttagcagcaaggacgctgagaattttgacaagattactcggaagctcatggatgctacttcaactctgagacaaccaagatctggagttggctgatcgtctgaagtttttagttcttagtcgtttacttagcttgagagttttgatgttaagaccgtcttagagttgttttggttcctgttaatgctgttcagtttttatccccccctaatggtgttaattctggaccttttctgtgcgtgatgtaaaatgggtatccccataacgatgccgtgtttggctttctataaaaagccgggctaatggtctcagtttcaaaaaaaaaaaagatccaccaccacccgctcctcctctgccgcacttctctcctcctccctccccaccaatagtgggtccagcggttgctcattgtaacaccctgaaaattcgaccaataaaatgaaacccgaagttgagtactttcaaaaacttttaaataaattgcattgccaatgttattggttcttttgttgtgcatcatgatggatgttatggttgttattgcttgccaaactataaattgtcacaaatgaaaattaagctaaagctatacaactaagtaatagttataaaattatggtatttattgtgaaccctacaaatatttacacacaacacaacaaagcaatacaaagagaatgttaattactaatttaatttataggttaaatattaaatattggagccatgtgataagtgtctgtgacatctaagtacatatgaaatagtcaccactacaacgaccctaataattaagttgatatgtataacttgccttgaggctctcatggaataaatttcactcacataaaataattagtatgtaaataaattgagttctatatataaaaaggcttatatgagtactcgattcaatatttagactgatattgcaccaagtctcacagtgccttcatggaataggaattgaatagattaaacatatcaaaatgcaatacattgccatacaaataaactcgaccgatgtgctaatgtattattaaaggtcacattagaatattttaattaactttagaaatatcaaagccttcgagttatataggatgaatttaggatgatataaagtaaagccaatttcattttgggaaatgatgaatgaataaataaataaatattcaaatcaaatatttgaattcttaaacccaaaatgtataggttacatctcaattcagaattccaatccaagacattgtgcagtttggcccctccatcttttcctattcccttttcttccttttctctctttttcccagccgccactgttcctaggccgccaggtgctcgaccagagccctagcccaagccgcacacacaacgccacacctccgagccgcgaacgtgtcgcgcacgaccggtgcgccctcctggtcaccttgcaccgtgcgccgcgccgtgtgccgtgccacgcccgcgtgggaccgccgaccgaccgagccgccgaaatcccgcacaaaggccgcgtcaccacaagcgcctgcgtcgtcccgtctcatcgcgagtcgccaacgagctgagggataacggccgccacgttgttccgcgtcaccctagaaaatagcctgcacctctgtatcggcggtcgttaccactgcccgtcgccgctaatcatgtcgccatcgcattgccatctcgtcgcccctagctgagaccgttggataatgcgatgtttcttccccagctagtactccctcttctgaaaccctatcggctatcgcataggcaatcatgcccgatcgatgcattgaacccgaatcataggtggaggaaagcttagccgcgtcaacctccctaaacctaggccgtagacagccatcgagcgcgcctgtcgtcgaccttatcctccatgccattatggcttatccccaagccaaacccccataaaaaaaaacccatccctctctaccttcttcctcaaatacatttcatcgaacaccttaggtgcatgcgtagccgaagccggcgtagctgaccgcgggaaccgtggctcgggccgcctctgttgctgctgatgccttcgatcaacgccgggtgccgctggagcccgaggacctgctgtcgaacgcctgtgcgctcgccgccgtcggcatcctctgcttccttaccgcctccccaccgcgacgccgcgtttcgccgactcgccatcccaccttagcgtcctctaccctaatattagcacccatggccgtgccggcccggctgctgttccgccgccggcgatgtccccgtggacatgctatcccggaggcttccccttccatcttgttagaaaaacggaaccaccatacactgtagaagcttgcgcacccatctatttggttggaacctagccctaccgccctgtccccttgcaccccggagctcggccatggcggccatgccgcgccgctcgcccccgcgccgtactgcaccgttgttgccggcgggaggtcgctggagattcgcctcatcctccccggctgctgctgtgccggcctcgcaccgtcccggcatgcgcgctaggcgcatggcgcggctgcctctgcctggcgagaggtagaagacgacgggaaaaagaaagggacgagagagagaaaccgtgtggggcccacatctagtttgcgcacagtaatcctccacctaatggtgattaacccactcaatgacatgtggggtccctattattaaaatctaagtaaacttaattatagattttgttacaatgacaggcgggacccaccggagattatatggccggcttaaccacagtcaaaaaggggccggacccacctgtcaatagcacatctcatttcctttgaaagaataagataaagaaaaggaaataagaatggacccacctgtcagtcactaccacatacggttaatgctggaataaaaataaatcaattatgaatagtaacatttcacaattattggaattaattcaaatttgaatctttaaacttgcataactcactcattttaactcggattcgaatgaaacttgaacctaaatttatctaaaatcaagatctaactgttggtaccactttctcgatttaatttgtaatttttgaatttttggtgattttatttgaattctaattgaattcaaatcaaatctttcgcacgtaaatttagattccgaaggagttgctgagttaatcgaagatccgggtcagcaaatctgcgagcaaggcaagtcatcactaatctttgagcatgttggacttattgcgaacttattttgatttaaataaagtttgcatgctatttatatgtgaatgtcctaccttgttatatgccatacctttgatattgattatccatataatctttgtaatccatgatatcgtgtgtctttagtcaatatttgacaaatgcttagcccatgctaattttgatccatgcatattcatatttgtcaaaatgctttatgcttgggcaattatcttagggaaggtaattgacatacagcatgtggagacatgagcgccacattgccatgataatgatgagatgatatgtgaaagaaaattaaactgaacaaatgttttcgactagggcggctggagggcttgggtggtgtccagtaaaggctagtgccgtccctgatcagttaaggatcgagccatgaagttaagcatgaaacgaccccagtacaaccgtacttctcgaatgggtatagacctagcggagtagataggcgagcggaggcagtatccctacatagtggtttcacttaggtgtgtggacgaacaagcagtttgctggctgatacccgatacggatggccaaatggcggatacctgatatggatggccagagactgacttgtcaagattacaagactacaaggagatacccaaaagaggacagcatggattgggttcaactacaggatgcaatgttaggcttgcgtgagtttccccctcgggagtgccagaactcctctctgtgctagaaacttatgacgcttagagtgcatgaggatgtaagttcatggagcgggtactgccaatgtaaggtgtcacgcccggaatttctatccaaaattccaaacgcttacatatgtgtgaaccctcgtccaggaatcagccgaggcacacaataacaaattgataataggatacaattattactctaattaataagcgaagaaaatgtcattacagaggtagatagttcctctcaaacaataaagatctaagcagcggaaaaaaaagataaacggcgcagacggctccactccacagggagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaagtaataattaaacaatattaatccaacgctatacaacataccctgttgtataggcccatccattctgaacaaccatcccggctgcacagttctatctccaaaccaggaatataccattccaaaccaggagctaatcaaattattaccagttatagcatcttctattatggtgagaagggtgagactaatcacgaaagacattgttcaacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtacaacataacccattacagcgcacctttcctggatcataatcaccccctttaaaacaaggcatggactccccagcgacccccatggacttctcgccacttctcagtctggcgcactataatgaattacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccagattttaattatcaattagttaacatcacacgattgaccatcgtgagctaccattaaatataaccattattaacaataataattatgtaatataatttatatttaaccccttttagttagctaatgtttctatgcatggctaagcaaacctatatatagcatttagctgaaccaatccaatatataaggttcatgctaatcaaattatagcccataggaaaataaagtcatcttcggccaataaataactgggaaaggttcaccacccgatgacattcgaaaacaatgcatagttgaaataaaacaatagctttaaacgggatcaacatgctcaaagggttgtttgggatctgtgtgacttgccttgggcttccacaaacgcttcggaacctttctcaacggaaacgctctcctccggaacgtcggaaacaaaagcaaataaacaaaatcaacaaaacagtacaaaaacaagcataaacagtacatgaggatatttttaacatgtagatctcaattttagaaaaatttagagacttgaaccaactaaatcggagctacgatgaattagttatgattttttgaagatttaatcagattaaaacacttatattgattttaattgaattatgacgcaataatgaattatttttgaaaaggaaaaagggatttattgcgtcagcaggctagggtttcggtggaccgggcgcacggcggcagttcacgcgaacggacggccgagatcgatccatccaaaacagacggccgagatcgatcggtctacgaccggctcacgggagagggcgacgatgacgtcggtgatgacatcaccaccggcggcggcggctcgacagctcggacggcgcaagctcaccggcgaacggcggcgcttcggcacgaacggaggacaccaacgggtagagcgcgacgcggcgaactcaccgatgaccaaaggagcggcggaagaccaacggacggcgacggcgatgaggttgaaacggcggagctcttcagcttgacgacggcgacggtgctccggcggtctacaacgacggcgaaggggcggacgaggacggcgatgacttggcgaccacaacggcggtcttcccgagcgacggcgacgacgagaacgacggcggcgcacggcgggagcgacggcggcgacggcgacgctagggcacacggcgctagggcgtttccgacgacgagaggagaaggcgagggtggcggcgggtagaggagacaccggggagccttttaaaggggtttgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaaagtcctcttttggctttgggctgaaagtcggcccaaaaccgcttcctctctctctttccctcggcccagtccggcccagttcgtagccgcccgcgccgcgcgcgcgcgttcggtcgctgacaggtgggtcccacctgtcaggcccgtcgtcttcctcgggccgaaaccctagcgcgccgccgccgagccgccgccgccgtttccttccaaatccggccgcccctttccgtttccggccgaattgatagaggggaaacactctccgggatctcctctaccttttctcctttggaatcatcggctaaatcggtttggaaatcgagggattcgagttcgtctcggattcatttttcccgaaccttccttcctcatcgccggtcgcagtggcccttcgccttcgcctccgagcccctttaaaagtttccccgagctcttctctacccaccgccaccctcgccttcgcctctcgtcgtcggaatcgcgctagcgccgtgagccctagcttcgccgccgccggcgccactccagccgtgcgccgccgtcgttccagccgtcgccgtcgctcgggaaggccgccgtcgtgttcgccgtcgcgtcgccgtcctcgtccgccccttcgccgccgccgaagaccgccggagcgtcatcgccgtcgtcgacccgaagagcttcgccgcttcttcctcgtcgccgtcgccgtccgttgatcttccgccgtcgttttggtcgccggtgagttcgccgtgccgcccgcttcgtcctggtgctttccgttttcgtcctcgcgccgccgttcgccggcgagcgtgcgccgcccgagccgtccgctccgccgagccgccgccgccgtcggtgacatcattgctgacgtcatcaaggccgtccgccgtgaaccgccgtggacccgatcgatctcggccgtccgtttggattggatcgaatctcggccgtccgttcgcgtgaaccgccgcccgtgcgcccggtccaccgaaaccctagcccctgacgcaataaaccttcttttccttttcaaaaataattcaatattgcgtcataattcaatttaaaccgatttaagtgttttaatccgatttaatctttaaaaattcataactaattcatcttagctccgatttagttggttcaagtctctaattttttctaaaattgagatctacacattaaaaatatccacattactgttcatgcttgtttatgtgctgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctttatgtattggttcaactagatattagatataattgcttagccctgcttagaaacattagctcactattgggataacttatgactcactgttatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaagtgtttgctaaaagctgcttttgcaaatgaaaccctattatgccatcctttgttatcctatgcacttgcatatttgctgcgtggcttgctgagtatgtcatatactcaccttgcaattattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacagctaggaggcgacgacgaaggcccatggcggccggcgacgagatggaaagctcgagctcgaagagagaaaaaccgatccaattcgaactcgaatccaccgatttccaaaccgatttagccgatgtttccaaaggagaaaaggtagaggagatcccgaagatcatttcccctctatcaattcggccggagaaggaaatgggcggccggatttggaaaggaacggcagcggcgcgaaactagggtttcgggcggcggcggcgcgacgaagacaacgaccctgacaggtggggcccacctgtcagcgggagagagagagaggagagcggcggctcggactgggccggctgggccgaggagagagagaagggttttgggccaactttcggcccaaagccaaaagaggacttttaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaaggcttttaaaatcatttctaaaaattccaattaaacaacaatttatatatttaggatttttagggtgtgacataaggttattgaaaggctttgccgtgacgcgtctcctgtgttgggacgaggctcatgtgttgggcagtcatggatgtcacatcctgattttcgcctcaggatttataaattatttaataaattaataatagaatttatattaaatgttcatcaatttacaagtgaagttaaatgcgggaaataaaatttcctaaataaaaagcatggatggatttaattcttattaaattctccatggttaattatactctctggaatattctcggatttttcggagctcaattattaattttaatcatacaaagagaagttcagcaattatttaaatattaaattaatcatataatgatctaattataattgttaagtgcttttcctgtttaaaatccttaaattataaattgttgtttaaaaggaattaatagaaatgattttaaaagtttaaaagagaagatcttttcttttaatttgctaaagttcaatataaaattgggttagataaaattttattaaacactttgcttgttcctctattttctagatttttctgggaattatttgagcaagggaagtatttttaataaatgaaacaacatttcacgaattattttaattgaaaaagttttaaaaatcctctcttaggccgttgggccgatttcggcccaactctctctttcctctctctccccgcgcgcggcccacgccggcccaagccgccgcccgcccctctctcccagccgctgacatgtggggcccacatgtcagggccgtcttcctcctccggccgccgccgcgcaagagcccgaaccctagcgccgtttcccgcgccgatttcgcccaaatccgagctcgattccttcgattggttgaggggttttgttcctctcgatctcctatttcttttcccccaagaatcaaaacgaatcgtggaggtttggatccgaatcgaactcgttttgttttatccctaaaaaaaccgagttcgatttcttcccgattcgattcctctcgtttgcggcttgatctcttcgatccgagttcatataaagcttctccttgatctcctcttccgtttgccccctttctcgagctctcccgtgcctcctagagccgccgccgcgtgcattaggtttgccgccgccgccggccatcttcggtcgcgtcgcgccgccgcctccgtcgtcgccgccgctcgccgttgccgccaagaggagcgccgtcgtgtgaggaagctcggccgccccttcttttccgccgccgaccaccggagccccctcgacgccgtggacccgaaccgccgcgccgccttctctcgtcgccggccgccgtcgtgcatcctttgactacgtggtgagtaccaacgggttcgcctcgttgtcctctacgcgtagatggcctccgtttccgccgtcgactttcctagcgccggcgagctcgcgaacccgagccggccgccgttgggtgacgtcagcgtgacgtcatcgcaagggctgacgtcatcagggccagggctgacgtcatctttctctctttttcctttttcccgttttttctaatagattaaaactttggaaaatcataactaaataaccgtagatccgttttaggtggttcaagttgctaaatttttctaaaataaagatctacatattaaaattgtccataaattgaattaaatttgtttaattctttttaattgggctttaattagatttaatcttgtaaaattcataataaattcatttgaagtcggagtaaggccgttcaagtctcataattcatctaaaattatgatctacatgtttgtttactttttatgtactgtttatttggtttttattagtctttttcttcgttttacgtgttagtttgtcgtttccgtcgttgcgaaggttcgtgagtgcgtcggaagtgatcaggaagattaattgaagactgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccttattccttgataccttgggtaataaattgattagcttgaaccttatgtattggtttggttcagctaaatgttagatataattgcttagcaaagcttagaaacattagttcactaatgggatgaattatatatactacattattatttgtggtcatatttaatggtagctcacgatggttaatcgtgtgatgataattaattgataattaaaacctggttaaggtgggttgtgagcatatggttttgatggttgtgctcatgacaattaaggaccggtttgcgagctactgttgtgaaacatttaccgtaccaaccacaagccagcgtgggcaacggctttatcttttgtatagcatgattcattatagtgtgccagactgtgaagtggcgagaagtccatgggggtcgctggggagtccatgcctctggttgtagagggggtgattatgatccaggaatggtgcactgtggtgagttgtgttatgtagggggtaatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatttgtacagccgggtacggttgttcaggatggttgggcctgtgcagcatgggtgtgctgttcagtgttgattaaaatttctgattaattactctactgttttacttctcttaaatgttttgctaaatgctgcttttgcaaatgagcctatattttgccatccattggaatccttgtgcacttgcatatttgctgtgtggcttgttgagtatgtcatatgctcattcttgcaataataaatcaacctcagttgaagaaaaaggatccagaaggagaagacgtttggcttataccccagttgagctgcctgtgggagtggagccggagcttcgctagattttattttttccgctgcagttttcttcttggtgaggactaagtgcctcataagtaagtatttatcgttttagtttattatgatggatttgtatattaaattgtcagtttgtgtacctcggctgattcctggacgaggattttatgcacaaataagttcggaaattattagtgaatttccgggcgtgacaatggagtacgggtgaagtgtacatccactgcagtgtgagtaaaccgaatatattcgaatagccgtgctcacggttattgagcaccgggacatgtattacacttggctagactctgaactcttaaaatgatgggtgggatatgcataatgattttttgactagtggatcaacttctcgagaggcgagaaggggtagaccccagaaaaccatgacgaccagtggcgagaagctatccttgggagcacaatggatggtggacagaaccatcgctgtttaatgaactatggagataaaatttgatcagttatgctaggtcttaagcttgtgaaaagaattgcaaaattgactttatgcaaataaaccattagcctttcattgaatatcctctatcatatgcatcgttgttgtgggggcttgctgagtacggttggtactcactcttgctatttacaaatttcatcagaagccggtgatgaagtctcggatgacccacatgcttactaccaggagggtgaagaagatggcggcgcttaataggtcttagttatggtcgttgcctgtggcaatggcgtcgccgctgccttgattccgatgcttatctatttctgcttttggtatgtattccggaccgtttggtcctatgttctaagactccctgcgggtctatgatgtaataaatcgcgctagacaatctatgtatgcgcaattgatattccagcaatgtaatcgtgaataccagactacttgatccagggaaatggtactattaacacgagagattcctgttataaaaacaggggtctacactcgtgcaagcgggggcagctccggtggcggctagcgcaggtgatggctcagcgacggaggagggggatcatgaaggtggtggcaactacccgggaaggcgacgacaaggagaacagcttcaccgccgggccactgggggcacggatcggccaccaccgggctcctcctcccttgtcccaggtctagtaagcagtggtgttaacaataaaatttggtaagccccgaagagaattctcacatcgccaatagtcgaattcatgctatattcggttaaggaaattaatctattaaaggaatcttatccagaagtgattgacttcaaggaggatgtggtatgcaagttatctattaattaggaatagtttgttagtttccttttatctttagggaagtgcgtttagtgtcctataaggactttatgttttccttttatttttaggaaagtttctttcttgtcttacaaggactagtatctccccatgggtataaatatgtacactcggggtcatcgtaaactatctctcgatcaataatactctcggcgcatcgccaccctctttaccgaggttttccttatcattcggcggaacttggcacctgatgtggggttgcataagctttcgatctccggcgaaggggtaagtcctacgttccaccggccctggcaactatattggcttcatcggcgtcgttcaaggctgcctcagtacgttcgatctcttggattgctctggttcggtcgatatatttacctacttatttatcatatgtctctattaatctagtcttagcatatcaatttagctctatcggccgcttctcgctttagggtttccgctggtatcggctaaatcgtgttgctagattagattagcttagacatccaccaccctgaaaatcagttaacggcttgattgtctagatattatgtttatttttatacttagtgctgcatcagttaagtttgatctactaagtcgtgtttagaaccataatctctagcctgtttcttgactgccaataacggtttcatcgggattttagccgatgaggtatctagacgttgcatcggcctacaaggattgcatataagttggatttagccgatgacatccaaggtttttactgtttatctaatcttgtggattttatgacatcggacttccagccaatgtatgctttaaccttcagatcattgcttagtctatcatatcattattagccgattgtttctactggatattattattgttatattatatcactatcagccgatcatctttatttatatcaagtgtcatattctatatcaaacatatagccgattgttcaaaaccctattgctatcgactggtatcagtatcggctggaatcactccatcggcttgtcagccgatcggttatttgatctgctatttgtatatcttgtcagttgcaggattaaactggctggcacgtcagcatctcatcaacctttggatctgcactggagctaagcatatctcccaggcaagtgtgtgtttttcacgtcaacaggtgggtcggggcgtggaattatgcgggcagcaatgtctgcagcgaacacagcgggcgtcacacatcttctggctggcagtgcagatgcatagatttgctttgtgacttgttcttggatttgctttgcaattgtgctcattgatgtgtggatttgcattgtgacttgttcttggatttgcttaatgcaaggctgctgcatctgggcattttcaaattttgtttgaacatctttgctggcggtcagagcaaatgggtgtgctttgttttcaactttttctaaaccaaaattgaactttgcaggcggccgtcgtaagacagatgtctctgaaaacggattattgtagacggcgtgcggaacacaccgcaaacaaaaactgattttcacttgcagcccacgtaacacagccgccagcgaaaacctattgtcgctggcggttcaaatcccatcaatgatgaactttgattttctctggcctttggtcgcaggcggctagcctaaccgccagcaaacgttgattttagccgccaggaaactaatgtgtttgtagtaaatgggaatttagcaaagactcctaataatcccttctttctatataaagctatgtgcactaaacacctaaagctcagcatgcaaacaatgtatttattagcactcctaaaacccagatgcaagcataccacatcaacccattaagcacacaaagctcaacgtgcaagcatatagtaattatatctacaatttatttcatttaaaactaaacatacacatgctaaaccatcattctcaaatcattttcataatatttgaatccaaataattttatcatttctccattagctaacatatatcctgcagcaaagcgcggggcatcatctagttatagtatggagtagtatatatagtacgtatagtatccaaacataaacgtaacataacaaagttatttgttaatgaaggtgggatgtaaaaaaactccatcactactacaacatctattttcgcaagatgacccccttactgtacatatggttctctgcagcctactgcgccttttcgccaaacctggtggttttcaccacttctaacaatcttcgcccgacgaaacaatatccatctccagtccaagggttcgatgacctttcctccaacggctagcatattttctttgctttgggtatgcctagtgaaacactgccatcaaataattattaccttttgcaactgtcaatgaaccaggtgtgtccctagttgtttgcagattgtcacagtgatcggatggcagcactttatgctgagattgctgctgaaccttagtctttggttgtataatccacgtttgctgatcggccgataaccgcgcatcctcccgccatgcggcacagccacgtggtgcgcggagagggggatggcgggagggcgcgggagagggggcacgtagcggttttttctattttttcagtattttttgttttatatatacatatatatatatatatgtatacaaactttgtatacgtgtatatatttttttatacgtcaaaactatatactgttggcaactttttatgacaagtcgacaagcacgatcgcaacacctaaacgccttgtggtgatatagagtcgccaaccacctcgatctagccaaagggccaaatcaagatgggattcgtagaaaaacagctaaaccggctagcgaagccgatttagagatcaaaatcagcctctaggccgatttagatcgatatgaggataactacccgtctcgtgggcaaaacggaaggttttcaggacaaacctacaaagaggtgtcgcactctcgcagcggcggcggacggtttacggcgcaaactgacaaagatggactaaactagggtaaaatagaaaacatagtaaaagaacgattcaagtagattgtattcggggattttacaatgaaccggccttgtcccttaaataggggttggtcttgccctctacatgctcttctccacatccaactcgggatagaaaccaaagaaaacacgaaacctgccttcccgagtaaggaaacccgtcactttccaaactttggcaattttcccctatttcgtccataggtgccatatttgggtgtaaacacatgccccctgcctttttggtgaacagacgtgaacctaaaagcatagaacatgttatctccgggcgataatccaattaccggccataggacttcctaagcatcttgccaaatgctcgggaagtatttctttaagtatttcccattaattgatctctgaaaacaccgtcttgaagtgtcttcatctccctcaaagtcttcaaacgctcgtcgatgacatcttcaaaaattacttcccatcaaggtcttgtaatcttcaaccgacaagtcgccttgcttgaaataccgaagagagccaagatttacctcaactggcaaaacggcaatttcaacaatgttttgttactcgactcggcttatccattagcccgagcgtagtaaagagaagaactcaacaacttaatatcataagattcggcaaaacttctcacttccttggacataaaagaagctcctttaatgttttaaggaataccgaatctatgaacgatatgcttcaaaataaagtcaattacttccgcataagtaatattctcgagcgggacaaccttggcccacttagtgaagtaatccattgcaactagcacgaaccaatgccattttgatggcgaaggataaatttgacccatgaaaaccaaagcccaacctcggaacggccatagtttaatgataggattcaatacagcggtaggcgttaattgaacattgccgatccgttaacaagcttcactctctctatagtatttagaacaaaatcatcaattaattgtcggccattgaaaccccactctcctaagcaaccaatttatcttacggccgattgatgaattccacaaatcccttcatgaacttctctcctagcaactttagattgatcattatctaagcatttcaacaatactccatctatttttcggcgatataatatttgaacatttgccgccgaatcttccgatcaatcttaagtgtaggatctttcaaatatctaatcaaaggaattcgccaagctatttctatctcatgggcacaaatgtccgaattcacaattaattcggccttttaatcaattgtaacgtgccccccagcctcctgtctgggttcggtcagaccggccacgcaatgccggtcagaccaccctgtctgcccggtcagaccggccatgcagagccgatcagaccgcgggtaccactggtcagaccggccgtgcaatgccagtcagaccacccctagtctatgactttgccaatttcgtccaaacttttgaaatcaagcatcggcctttagtatataattttttttttcacataatagctagatgcttggtatatcaaattattggaccaaaattccttctctatagacatatgaaaaattataacattcaactaatatgtctagatgaatactaattcaattggcttttgaaacaataatcatcatgacatcaaaacacttagccaattgaagcataatcaataatgaatcaccaaagtcatatgtgtcacatgcatatattccaataaactaaaaatgtaagtaatcggcttgagcatgtatgcaaaatattaacaatgccaatgttcctaaagaaaaccactctagagcaaatcatcacattgaccattgacattagccgaattactagtaagcaaaactttcatgatgcaataaatatgaaatctatatcttatatggtgatccataaaaacacatatgatttggctttaaataaatattaaagagtcatgagccaaatcatacttcaaacaaattatatgccaacctaccaattctactacctagaactggcatttgcaacatgtatgtataatatcaatttgataagcaaaaacacacatgtgctagatagtaagcaatattctaacatggcataggcatataatgataaacacaataaactcataccttgccttagcatccaacaaatggcggcacaaagatgtggtattgtatccatcgccgttcatcttcccttggttccctcatgagcatattaatgtcttgccccacaagcaaaatcgcctttctcgactgcacgatttcgaaggcaagacgaacaccgcaccaacatcaatagcatcatgcgaaagagacttatctctaatgaccgatgattcttctctcatcaaattggatttatcactactactatgggaaatcaccggtctcttaacttttacttctttagatctccacatttgcttaagtgtcgttcgaagctctaaaatgttacatgttttgttctccacatctttggcctccttttatttttgacctatggcccgaagacgctgtagcctcctcttttgagagcgagataagccagaaggtatccacttcggctgtggttgttttccaggagctaaacaatgattcttgatattttttgttgaagtgaagctcttatgttgctctcaattttcctactcttctccaatgccccctggtcaggccagcctttgggcccggtcagaccggccagtaaggtcggtaagactgcgcgtagactggcggttagaccggccacctgtcccggttagaccaccaatgttgacagtcacggtgtcgtcttcgatctcctttgcttgcgtggtttccaccgcatctccagtaggtacataaacatcttgagactcctctttcatagcaatgacctccggagcgttggcttctttcctcacccacaccttcttcacctttttcacttttttcacctttgatccaccggaccgattcttttgtgggaaacggtcctgccttgggttagacgaatgatttagcactgtcctaggtgattccttccatccttgataatacggcataggtggttgaggcatccatggcatataatacataaaaggatacccatatagtgacattgaatatagataccatggcatcacaaccggaggtttgtatggagttggtatggttgatggctccgattgctttgatgtttgaccaaatctcttcctacgagatgatcttggtctttttgaatcactagtttgattatcaactcgttgaccagctaatcctttcttgtacttagccataagcatctcaaaagtgagcttcagttttttggtcttttgggaactagatgactcatcctttgcaactttacgatcttcggccttcgcatttttgatcctattcttgggccgaggatccccaataataacacttgtccctttctttttgtcaacatcaatagaattaatagggagaggatcactaccaatttcgatcttagccatagatgtaaccgaaatagtttcacaagtgccgatgaagtatcaatcggtctttgctccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14716 - DNA, 1008 bp, Oryza sativa
agggtgctaacaaaagggtccgctacaccaatccctatccagggggatcctcctcgcagcagcaacaccagcagcagcaacctcgctccgcgcctggacctcaattcgtggtgcgcgtcccacagccgcagcaacagcagaatcagcaggggactcgtgcaccccatcctcctacgccaactgtgcagtctggtcaaggccgcagggacgctcaaggtcagcagcgtctgtgcttcaactgcttcgagcccgggcactttgcggataaatgcccgaaaccaaggcgtcagcaaggccaagcgcctccccgctccaagaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatttgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattttgctagacaccaagaatttggatgtgatccttgggatgaattggttggctcaattccaaggagtagtggattgcgcgagacgcactgttactctgtaccgagggccggcacaaccagttgttttctttgcaccctcaacctctatcagaagttcagaacttcatcagataggactgtcagaaatccccatcgtcagggagttcggagatgtgtttccggaagaactacccggtatgccgcccaaacgagagattgagttccggatagatcttgctccaggaaccactcctctgcacaagcgaccctaccgtatggcagcaaatgaactggccgaagtaaagaaacagttggaagagttgaaagaaaagggatacatacgtccgagta

SEQ ID NO: 14717 - DNA, 1515 bp, Oryza sativa
gtgtgccctcattccatagcctttcgaagtcatcgattatcgggtcaaggaacacatcgatatcgttgccaggttgtctcggtccttgaatgagcatggcaagcataatgtactttcttttaaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttaggcatgccagcgcacaagcttagcttgttccttgttcgcaaacattctcttcatgtgctccgcaattgggagataccacaccacctttcctgggcctcccctctttgacttactttattcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaagaagttctgtaaaactcttgtccgaccagccattacaagccttaagcttcatgagttccaacacgcatgacaacttgctgtgcttcgacttgcattcatcatacaacggcatctggcaatcttccacccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggttttctctacatcctgatccaacacttcttcagctgcaatatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacaatgcgcatagtacatccatctacgatccatctgaaatcaacaacatacgaagaaaaataaatgataatcgatatgttgagaatgaatggagaataatgtgttttttaccttgaattttagcaaaaaatcgccccccttgccctcccaaccgatttgtgaacagtaaaatggtcgggatggaaagcagttggcagtttgaggggtatttatagacccaacacacctcaaacgggttagataaaaaaagcccgtcaaaggtattggtcatacctttgacgggcttctattcagaggcccgtcactggtatcccct

SEQ ID NO: 14718 - DNA, 1709 bp, Oryza sativa
atccattttcactggcagtccatagccccccaccccttagagtattttcgctggcggtgatcatgtatagccaccagagaaaaaaaataggttgacggcatgaaaaatcgtaagcccgttctaggattctgaaaaggctatcaattagaaagagaatcatatagaccatcaaatttatgtataacttgtgtaacctatggcttagattggatttataatgagacaatgcatgaaccacttatgaaaatcttattgaaatccgttataaacacggctgtatggatgatctaaggtggctgagcctacattaggaaatctcatacaatgtatatataagttttattgtgaatgttgagtgccatttcctttaatattatgtgctttaacttaggattctagaaaaatacacaggctatgtttgggaggtgaatttggaacttaccggaaagaacacagctatagtagagtgtaaaatttcaatttttgctcagatgaatgatccgagaccatggatgactagagctcatcaaataatgtgaaatatactatatgcacatttgttgtaatcagagtatctagagtttgggtgaaattacggcacaattgaattaattagttcggatcatccgatttccattattaagagccataattcttttgcaacaaaaagaagagagagaaatacagagatgctggagggctcttgcatgttttattaggatgaacaatggtcacccggttggctgctcatgtttctgcacatgcccatgtgcctgagccgtcgataccaccggtcgcagacatgcgctgcatgtcacatcaggaaattaccatggatgtatctatcaggacgcatggcagttggtctcgccatggctgggtctcactaactagttttgccagctcccaaccatgttggtgctcatggtcgtgaacgggcaatatggatgcccgatgcctccgaagcctagccacatcaattacttgttcgtgagatccatggctgaaaacaatgcaggcgagctgcttatccgcttccccaggagtacaacgcatggctgaaaataatcgacctcgacagatctacgcacgggttcatcgaccacgtctccttcgcttcgactacatcgactatggcacaaagggctatcatccgtattgagcattctcgatggttcattggtggagaaaccatttatactctcggttggtaaccccttttagtcccggttttccaatagggactagcaatccgggactaaatatacacttctttagtcccggttagtgttaccaaccgcgactaaagagaaggtatctttagtcccggtcttttttttcattgtttcttttgccatagtttaatccctgtattttctcccaaatcgagtgggatgcatatcccaaatcccaaatcaaagtaacatcccataacattcacatcacagatcttaagttacttatacacacaaatcaaatacatcacaaatcttaaaaaaattacacacaaatcaaacacatcacatattatacattttagatccatgcaacgaatcacaaaattatacatctaagtgaatcacaaattgaaaaaaaaagagaaaggatgctggcagtggctgccccctgccgccgttcgccactcgccacaggcgcggccccgctggctgcctgctgcgtgtggtcccgccggccttcggatgggaagg

SEQ ID NO: 14719 - DNA, 9446 bp, Oryza sativa
ttaagttcgggtggaatgcacggacgttaagagcgtgccaatgactttttcgacctagagcgtcggcaaccacgttggcctaccaggaatgatagtgaattcccacatcataatccttgatgagttctaaccatctcctttgcagaagattcagatctgactgggtgaaaatgtatttcaaactcttatgatcagtatatatttcacagcgattcccaatgagatagtgccgccagatttttagagcatgaaccaccgctgctaactccaaatcatgggtagggtagttgccctcatgaggccgtagctggcggaaggcataggccactacatgaccatcctgcatgagcacgcaccccaatccttggcgcgaagcatcacagtacaccatgaaatccttgcgggtatccggcaagattaacaccggcgaggaaaccagcttttccttgagagtttggaatgccttctcgcattgcgggctccacacaaatttctcttctttcttcaacaattgtgtcatgggtcgagcgattttggagaagttctcgatgaacctctggtagtatcctgccaaacctaagaaactgcgaatttgggtgactgtcttgggttgcttccaatcggtgacggcggtcactgcttcggggtccacagcaactcctttagcagatatcacatgccctaagaatttgacttcggtcaaccagaactcacacttgctaagcttggcatacaattgatgttcccgcaactttcccaacaccaggcggagatggtgctgatggtcttcctctgagtgtgagtatatcagaatgtcatcaatgaaaaccacaacaaacttatccaagtattccatgaacactttgttcattaagttcatgaagaaggcaggtgcattggttagaccgaatgacatcaccgtgaattcatacagtccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctctacaaaaatcacaggagcaccccatggagaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagtcctatctcatgaagttctgaacttttgacagaggttgggggtgcaaagaagacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaagcccctgaatttctatactttgctgtcataacccctccaggggtggtgatgagcagagggttcctaagcctttctacccccaactgatttctccccacgaatggcacagatataaaagagtgggaagctccagagtcgaacaaaatggtagcagggatggagtgaatgaggaacgtaccaacgatgacgtctggagttgtcagcacgtcctcggccgtcacgtggttcacacgaccccgaatgacatccttcccaccattgttggagcggggaggcgcttggccttgctgacgcctcggctttgggcatttatccgcaaagtgcccgggctcgaagcagttgaagcacagacgctgcggacctgaagcgtccctgcggccttgtccaggctgcacagttggcgtaggaggacggggcgcacgagtcccttgttgattctactgcggctgcggctgtgggacgcgcaccacgaattgaggtcgaggcgcggagcgaggttgttgatgctgttgctgcggctgcgaggaggatccccctgggtagggattggtgtagcggaccctttggttagcaccctgttgattgcggaagttcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctctggggcataacgggccagattgttgaactcatgcaaatactccatcacggagcggttgccttgcttcaactctcggaactcccttttcttaagagccacgactccagcgggcacatgggttcttcggaaagcggcggtgaagcgagcccaagtgataggttgtccctctggctgcgtagcctggaagtggtcccaccagagagatgcgggcccctgcagttggtgggcggcgaagatgactttctcctcatcgctgcactgcaccgtgtctagctttttccccacggcatgcaaccaatccaacgcatccacggggttgttggagcttgagaaggtaggtgggcggatgcggaggaactcggcgagtttagagtgttgtgggggtggtggtggagcattatgttgtggcggattttggaggtggtggaggaaagcagtcatcatgttggcttgctgggcgaggatttgggtgagaatggcgttggtgtctggtggtggtggcgaaggcggaggaggaggtggaggtgggttgccctggtggttgtggttgctgctttcgggttggttgccatcaccggtgttagcatttctcctggtcgtcaccatctgaaaaccccacacagaaccagcaaacagagaaagagctaacaattaaaactaaccacccacgactaccataattcttgaatttattactgctattaaattggttcattaatgttcaagttgcttaggcaaataaaataagacaggctccgacacagttataccacacaccggcataaccatgccccacacgactcaaaaaaagacaaacaagaaagaacacacgcgcaaacctactaactgctcgtctactgctgcgacgggccaggacggaaggtgagcaacaacgcaccctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagacgcggcgacgcttggggcggcagtcctctccctgggcgatcttgagctgatgcagctgcgcctccactgcgtctaggtccttcttgagctgcaggttctcctgacgcagctccaggatcttcatgttgttctcgaccatcccacgacgcaccatctgatggaaatcgatacgagccgcgtcgtacgccttcaccatgcgcgccaggtgcacgatgggagcgtcatcctccgagccagcatctcggaaggtggcgtagtcgcgggctcctccgctacgagggtggtagcggtagggcgagtgctgcaactcgtccgggtagcgctggtgaagagtgccgatggcgagaagagcggcgttttggcaagcggcggggaaggaatctccgcccgcggtgactgccagcgaagtccgctcgggagagccagagaggatcactgcagtaacctcccaaccagcgtggggctctgcatcctcaccctcctgctctggaagcggcctggcctggtagtccactccatgtggataccccaagaccacgcacataccccgcagctccaagacgaagccagtcatgtccaaaccacgacgggtgacgctgccggccatctacaaacaaaaacaaacagaaaaacaacattttagagatcagattttggcgataaatgaagcagcaagacagagagagactagaggattttcacaaataacaagggatttttatttcgaaaatactgctaaggcttggggtctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacggcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattataatataaagggttagggttgcagtaaacagcatttaaagacatttagttgctccaaagctattttgtaaacacgattctagaactatacaatgttattaatcacggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggcagaggtgctactgtcaaaaccatgcacccctagcccagcccaaaaccattttagggattttgaatagaaggagcggtgtgaagccggttccacgataaccagaccattccaaagtatccaggtgacttgaatatttcccaaagtctaaagttgtaaaaccacctaatgttacctaattaacttgcgaagcatctacctaaaattaaactagtggtgccatgagtagagtgtccactagttggggttttgtttattctagggtgaacaaggtaatattaacaataacaataataaggtcataacaaaggaaaataggcatggctaaataaaacagtgataacgcgggaatttaaataaagtgataatgcaataatttaaatcaacataattttacaaactgggattcaatatgttcaaagatgatgtgacttgccttgctcgctttcccaaacgtcgtcttcaacttccacgaagagcggatcttccgaagctgcagcgtctacacgaccaacggaaaagaaaaggctattaccctaataaactccatataacagcagaaataaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggcccacggtggaccgggcgcacgcggctggcgtcggccggcgccgtgggtcccacgcgttagccgcacccacgggcgcgggcggctgacggccgggcccacctggcagccgcgggcgcgcccgaaggcggcctcgccggcacggccgacgggaggcggcgcacccgcgccccgatggtcgccgccggcgaccaacggcgcggcggagcggcacccgagagagaggagggaagagggaaagcgaacggcggtccacggctcaccccgggacgacgagggcggcggaaatggcgaccggagcggaggacgacggcggcgcgggctcgggtcgacgaggacggcggcgttccggcggtcggcgagcgaagcggaggggcggacggggtcggcgaggacgcggcgaagccgaagggggtgacgccgaaacgggaggaggtccggagcgacgacggcgactgaccggagctcggcggcgatggcggagagagagaacgacggcgcgggctcgattccgacgggaagagtgagcggcgagcggcggaaacggaggagcggagctcgggaagcgattaaatagcgccgggagagggagagagcgcccggaggggaaggaatcggccgcggaaatctcggccgccattgatgacgccggcgaagatcgcgggcgcgatttcggacgaatccgagggagagagagaggggaaagagggggaaaaaagggagggaatcacggggagtgatttccccctctttaatgcgcgcggggacggcgggatgcggcggattcggcggcggcggcggcgctagggcacgggcgcggcggcgggcgcggcgcgagaaaggggatgacgggtgggccccacccgtcagcgagggtggcgggcgggcccgcctgtcagcggcgcgcgcgcgggggaggaggccgatgggccgcgggggagaggagagagagggagagggggaagtgggccgagccggcccaagaagggaaggggggaaaagaagacttttagggtttttctttttataaaacctttttaactttgtttatttcttctcaattattatttgtgcgctgaaaattccactaaaatttatttacacattttaggcttttaggaaatatacaaaaatcctccaagccttatttgacttttaaatttgcacattttaattgttgaaggctttcacatgaattttaattattctcagcacgatttcgaggatatattttagagtcgatttgggacgcgacaaacctaccccccttaaacggaatctcgaccccgagattcggagggactggcgaagagatcgggatgggctgccttcagctcatcttcacgctcccaggtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacgcatgaaacacatcgtgcacgttgcccaaggaggcgggcagctccagctggtaagcgacttctccgcgccgggcaatgatacggaaaggacccacataccgaggtgcgagctttccctttgtctgaaacctgtgtacacctcgcaatggcgtgactcgaagatacacaaagtcacccactgcgaattccaggtcacagcgacggttatctgcataacttttctgccgggactgtgccacctttagattatcccgaatgattctgactttagcttcagcttctctcaggatatcagtcccgaacacttggctttctccaacttggtcccacaatagtggtgtccggcatttgcgcccatacaacgcttcataaggtgccatttgtatgctggcttgatagctgttattgtaggagaactcggcataggggagactcttatcccaggtcttcccgaaatctagtacacatgcgcggagcatatcttctaggatctgatttagacactcggtctgtccatctgtctgcgggtgatacgcggtgctgaaatttaatcgggtacccagctcttcttggagcttcttccaaaagtgagaggtgaattggcttcccctatcagatacgaatttcttgggaacgccatggagactcacgatcctagcgaagtagagctcggctagcttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgttggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctatttaagttctctgttatctggaacgcatacccgatttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgactaactatgcttagattcagggcttccatctgttgactaagttcgggtggaatgccacggacgttaagagtgttgcaatggctctttcgacttagagcgtcggcaaccacgttggccttaccaggatgatagtgaattcccacatcatagtctttgataagttctaaccatctcctttgccgaagattcagatccgactgggtgaagatgtatttcaaactcttatggtcggtatatatttcacagcgatttccaatgagatagtgccgccagatttttagagcatgaaccaccgctgctaactccaagtcatgtgtagggtagttgccctcatgaggtcgtagctgacgtgaggcataggctactacatgaccgtcctgcatgagcacgcaccccaatccttggcgcgaagcgtcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattatggagaa

SEQ ID NO: 14720 - DNA, 763 bp, Oryza sativa
tgttgaactcatgcaaatactccatcacggagcggttgccttgcttcaactctcggaactccctcttcttaagagccacgactccagcgggcacatgggtcctccggaaagcggcggtgaagcgagcccaagtgataggttgcccctctggctgcgtagcttggaagtggtcccaccatagagatgcgggcccttgcagctggtgggcggcgaagatgactttctcctcatcgctgcactgcaccgtgtctagctttttcccaaggcatgcaaccaatccaacgcatccacggggttgttggagctagagaaggtgggtgggcggatgcggaggaactcggcgagtttagagtgttgtggaggtggtggtggagcattatgtggtggcggattttggaggtggtggaggaaagcagtcatcatattggcctgctgggcgaggatttgggtgagaatggcgttggtatctggtggtggtggcgaaggcgcaggagaaggtgaaggtgggttgccttggtggttgtggttgctgccttcgggttggttgccttcaccggtaacagcatttctcctggtcgtcaccatctgaaaaccccacacggaaccagcaaacagagagagctaacaattaaaactaaccacccacgactactataattcttgaatttattactgctattaaattggttcattaaagttcaagttgcttaagcaaataaaataaagacaggctccgacacagttatgccacacaccggcataa

SEQ ID NO: 14721 - DNA, 19778 bp, Oryza sativa
cctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtacttgaaggtatggcatgctgacaactactggaccccacaaccctttttcccccatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtccacaagctttcctgcttctgcttgtatggtttgcttttgattgtaacgattttggagcaaatagagcactgaccatcgtgtacagtactgagatccgcggaacgaaccaatgaggcgcgcatcggcaatggacctctcgccctcttcaacaccatcgccgccgtcaaggtactgcaatatccacgatccaacaggatggcagtgagttgggcttgctggatgggatcatgtgaagcttcccccacacatgtttttcctacatctctattcattgcaaaaaaaaaaaaagtgggctaccttggcattgaattagcaattactagatgttattatgagaatcagagagcgagaaatgaaattatccttagcaatattgccagttgactgacaattctaattgtgaatgaaggaagtaataactgaggcgtacgtgctgccatgtatatgaatattcatgtagtacatttccatttagtttatattttttgaaattttgatatactgcatttggaaccaagcttcttgttttatttaacaaagagattcaagaacagtttctgttttatttttgacataacactcagtaatattttgaagaacagttatatcactgtcgttatgaattggaccttatcaaagtaacaacaatactcggttatttgcctcggtataagtgagccgtaacactgttgaatctttcctagttcagtagatttctctcagttcctgtaaaacttttgattgaatactctggtgatgttcactgggcaaagagctaacttccccataacctaccttggaatgcccctcacgatccacagactcagaaaggtccacgtgcagtacctcctagacaggattaaggcaaggctcgcttgatggaagaaaaaattactctcagcagggggagaagagaattagtcatagcagtcttaagttcaatgccgatctatatcatcacagcgctcaagatccacaagcagctcatccaagaaattgacaaagctaggagaaaatttctttgggacagaggcgatgagatccatggaggcaaaggcaaggtgaactagaaaagggtctgcaggccaatcaagtatggtggacttggaatacctgatttgcaaaaaaaacaggacacgcaccctggctgcgatgtctatggtacgagcggaccagcccgaacaaaccatggataggcacgcccacaccctagatgaacaagataaggagctctttgctgcctccaccgaggtcctcgtgggggacggccgaaaggcactcttttgggaatcaacctagacctcgagcaccccccccctaagaacaattgcctcaaatctatacaagcactcaagaaggaagaagcgaatagtggcagaggccctaggaggagataaatggatggatgatatcagacacaacctgaccacaacactcgtcactgaattcttcaaagtgtttgaatgtctgtggaccacaaacaccatactaactcaagggactgaagacaacatccgctggaagtggacagaatcaggggaatactctgccaaatcggcataccagatgcaattcctcgacggagttccctcgatcacgacaaatgtggtgtagaaatgttgggcaccaactgcaaaatgcaagtccttcacatggctgctccttcaaaacaggatccggacgacagataggctccaacaaagagaatagcccaatgaatatttttgtcaactttgcttgagaaaccttgaaacggtgcaacaccttttcaacgaatgcccgatgaccaggaaaatctgggatgtggtggcaacgcggatgacctcccacagctgaaaaccgcaaaactggttcgacacgtcatccctcgaggaatggtggtgccagagtgtcaaggctgcaacaaaggagaaaagaggggggggcatcaattagatcctcatctcctaggaaatatggagagagcggaatagtcgcgtcttcagaaaagaagaactgtcgctgcaacaaataattgaacggatcacggatgagatctggttatggccggcagctggtgcaaagggcatcaagtgtctgatcccaaacacccaagacgctatcagtagcctgtaacaaaacatatgtaattttaggcatgctaggcatcccgtggtcgcccttccctcctccctcctctttttctttccttccttcttttaatgtaaccttctagcccttggctattgtacagtttttccccctaccttaatacaaaatacaagtacaccccgacggggtttaaaaaaaataccctggtgatggtagtaagattatgccctttctattttggattgagatgaacatatgcttgatcatgttcacttcaatcaaaacaggtgaaatgtgtgggatattgtgtgagaaacaactttgaatgtgtacataacttagctttccttgaatttaactttattgagttttactatggtgctcaaatctcttttttcatgccatcagtggttgtggacatatattatgattaaatatgtattgaagtgattacacataattgtgatattaaataaactttttcaaacaaaaatatgatatgttttacttttccttaaatatatttcatattatcatatatgacccaaatcaagtaaagctcatttggactgattagagaaaaattaatttgactaacatgcaaattaatagtataatttattagccaaaatattattgtgtgtagtgttagcacagtatattaatagtcacaatgtaaaatgtgacgacgctagcatagttttaattttgtacgaatttgaatatcatgtacatgaatagatgaataataatgacgctatataaatgacatatttgtaattgcatggattaaatgacatatggaccatccctattttttaatcacccaggtagacatccacacatttattcagtggcggagctagaaccaaattgagggtggtgcactgcttcactatatagatggtggcaattactctaaataatggtttttgaccatttatagatatctattgacaccaaatcattgagtagcaagtaaaagtgtttacagaaatttaagatgaaagaaaccacgaatggaaacataaagaaagatatacatcctcgacattaaagttgtcaatgtcaatatcatcgatagttcatagcctacaataataccagaacataagttagaaacatcttaattttgaactaaaaatttatatccaatgaacatgtaaaaaacataaaaataaatatgtttagggtttagggtttatgttccaatgaacacaaaaagatattgggactatcgggcgctttcctcttgagatacttgtccataacatgtcaattaaataattttattatgttagactatacgtgcactgtacaatagaacaatgtacgcttcaaaagcaatgatagtttgataatagcatagtgtcacagtgtgcttacaattttactagtgatggtcccttcaagagagatgatcaattaaaactgaaacatccagttcttcaaactttaaacggtttaaacactagcttatataaatctggacaattgaaaaggcagtatatgtcaacaggttacaaatctaactaatcaacaagttacaagagaggaggataaattcaaagtttagaactaatcaagagaattagagaatgaataatgataaataccttcatcaatttcaatttggctgtgctgctgtgcattgctcggctgccctagtgccctgctttgcagtccagctgctactgcctgctgcgagcctccgctgctccctgtctccctgttgtctgtcgatgcacgcagccacgcagccactgcgatggcgcgatgcacattcacccgccactacctgcggcgctgctgcctgtcgatggtgcagctggctagagagactaggtgggcgacggcgatgctgcctgctagtgcggcggaatacggatgacgaacagacggggtatcgtggagacgcggaatcgcggtgggaaaaagaaaggaaaaatataaaagaaaaacgggagacgaggagttcagaggtgcggtgatcgagcgagcctcgcgggtcgcggcgcgtcgctcctgggtgcgtgaggtgcgccgtgcgcctcccagctttcctcatgggcctaaggccttcacttgttcgctcatgggccatgggtggtgcacgatcttgagctaagaggttagtccacttagactcccttaaatgtcggccgaatctaaatcgtaacccttaaccaaccggataaaatgactctccgacctattgaaaccggtgcaatttgactccctgggtggttttgcaagcggttttggctgacgtggcgcctacgtgacggtgttgacccggtcttcgtcccacatgtcgtcgacgtgtcgcttacgtggaattagagtaaaaataaaaaaacaaaattctgtaggccccacatgtcattcacacaaaaaaagtgggacgctcgtcggcaccaccatctcctcctcgtcgtcgtcgagcaacacctccgaactccggccaaggagagctcttccagagcaagagtcgacgacgacaccatgcgcgtgctccatcgccgcctccattggtgacgatgtcctgctgcttcatcgccgcctccagcgcccacgccgtcgggccgctgcggggagtcttggcggcatagccagcggacgaaggaggcggcctcgcgagcgcggcagcgcaagaggaggtggccaccgccgctctagcgcccacccccctgcccgtcgcagttgccgccacgcccgacccctctcttcctcttgcagactcgcacgcaacaccggccccggaaggtaaagagaggggggccactgccgccgtcatcaccaccactccgcccggccttcgccaccaccgccgctagcactggatctggaagttgcggggctacggcggcgcaacgggacgaggaagctgcggcggcgaggggcggcgcgagaggacgtggccaccgccgctctagcgcccacccccctgcccgtcgccgccgctgccacgcccaacccctcttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaagaaggggaggggaggaaggatgacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgccatggacgtggagtacgacgtgatcgtgctcgggacggggctcaaggagtgcatcctcagcggcctcctctccgtcgatcgcctcaaggtggtctccttctccatctctctctctctctctctctctctctctctctctctctctctctctctcccgcccggatcgatctagctagggcatcgcgtcatggatggaggattaatttccatttctaattgcttgatcaatcgatcccctcccgtttctggctaaccaatcaaataccctttcgtcctttgtgatgccatttttggatttttttttaccgggtaaaattattcgaagaaacgacagatctgatcgtgaatcgctttgtgatctgattaacaatcacaaattcacaaataatgatgtgaaacaaaccagcaattttttttatgttttttgcgagtgatcttgaatttgtcattattttgtcagcgaaaaaaaaaattctcatcagaaaatgatgaaaaacgtgtcccatttctgttttgtcaccaggtgctgcatatggacaggaatgattactacggtggagactccacatcgctcaacctgaatcaggtgacaaggcttcaccctccgtagcaaaaatttgccaacattatcttacctacctgtctgccaacttctgttttcctgacgtgctaagggatgttagaaatttcctcatcaatattagtttcagacaaatttgtgtgaggttggttacctatcagatgaaattatctgatcaagctcattgtttatgtatgccagctatggaaaaggttcaaaggtgaaggtactcccccggcgcaaattggggctagcagagactacaatgtagacatgattccaaaggtcaggcccggctccaatttatatttgattatattctggagtttgtgtgtagtttgttgggcttagatggcactgctctactttattatggagagtggagacatacacaaaaacttattggaacttgggttttaagtgtcgcacagttaaatattcttcgcatgcgcatatgcaaatatttataggaaattctttttagattgtgtgatgattaatttcaccctacttcctttctagttactgacatattgtgaaatgctattttgtctagtttatgatggcaaatggtacattggtccgtgtacttatccacactggtgttaccaagtacttatcattcaaagctgttgatggaagctatgtcttcaataagggaaaggttggattctaattctaatgcgtgtagatcactccataactcaattggcaaatctataatacaattttgtacatgatatttggatcacagatccacaaggttccctctactgatatggaagctctcaagtctccattgatgggattgttcgagaagcgcagagcagggaagttcttcctttttgtccaagattacaaggaaaatgatccaagtacccacaagggatatgaccttaacaaaatgaccaccaaggagcttatctcgtgagtacccatgtttactgctgcttttctacctttttttttatttcacgaagaataagtgcttaattttattttcagatgtaagtagttgatttggtttgtttgtgaaatttatatttgggtcccatatggttcctgtatgtactcagtcgtatcttcagtgtacatttataccacctaaatgatccatgcacaaaggaattgtatggttttatttgtttatatacatatataataccttagaatcaacaaaagtcctgtcaaaaaaaaaagaatcaatgaggggcctcaattgcttttttatatgctctgttcaataaatctgcaacatggtacagtactacagtggtactcacatacggatacattcaggccaacacatacagatacatcaatttaattcctaaattttcataatgtacatccacatggatcaaaaatagctccccttcattgaaatatataaaaacaattatgccagttccgcagctgcacttattttatcatcacagagccatccttatacggtacacttcttcagttcatttatagataagcataagaattaggtgaattttattcattagcgatgaattgacacatcaaacttattcatacaatctgatttatgtttcatatatattttctgatattttggtctatcatactatttgaagaacctgaagttgtagtgcctcttaatgattcaatttattgagacttctctgctcccctttatttttttccagaaaatatggtttggatgataatacaatagactttattggccatgcagtggctcttcataaagaggataactacctgacagaacctgcaattgacactgtaaagcggatgaaggcaagtattgagtctttcaacttcaaaatattagaaaagaagctcggatcaaactagtcctgacagtctgatgaaattccacatcacactttggcgtacatacatcgaatagaacatcagctgggttatctgtggacaaaactaaagccattttagtcacaatatattgctggaaatcacaactatgaacatgacgtgtctctgtcaaccaactaaaccacttcttccaacccgttcgaaactagacattttactgctgttcccatgctatagttagcatatatggtcacttcactttcactcccagatattgccttttacctaacacttctttgaattattgcagctttatgcagaatcagtgggtcgttttcaaggaggatcaccatatatttatcccttgtatggcttaggagagctgccacaggtcattactattaaactgtgtcatcaattccagcaatcacagagatcataaatggttgattttctaacttgtttttatttgatccagggttttgcaaggcttagtgctgtctatggtgggacatacatgttaaataagccagagtgcaaggtataatttgtgttgttattgtgagttgaaccttccaaataatttctttggtgatttgggcatggtgatcacaatgtgaaatgaaaattttaggattttaaggtgcaaaagcaagaaaaaaaatttgaggggggagggcaggagatctgccaatttcattaaggaggatagaaatgatacaagttcgcctctcaaaggttccatagaagaaaaaattaggaatatgatgattattgctttgaaaaggaagaatagatcaagctgtcagagtttgacaaaatatattatgttaacataatccaggcttggatttcaccagttgtatgcatggtagatgctagtgctaatgaattgtggcatgacaatctaaaaattgttctagaagctgtaatgttaaatccatttcagtggtaaatatgtgattttctgatcaaacatacatgggcatattcagatagaatttaatgatgaaggaaaagtttgtggtgttacgtcagaaggggagactgcaaaatgtaagaaggttgtctgtgatccatcatacatacctgataaggtaaaacacttttttttcatacaaacaaatagttgccctcaaagggagtatatcttagtgattaccttcctaattagttaattatactgtacttttcttaagattatttgaaggagacctactatgtctgataaataaattgtcctttgttgcattaaatttatttattacttattcagaatcaaatagaagtatgatgcaatttagtgtctctcatgttagcctcctcagctcttctgtaaatataagtcatcctagaacattgaagtacttctatacagtatctttttcacttttgtcctatatatataaatgatactgttctcatggataaatgacttatcttttgcattctgaataacaatcaagggtgagttatttagttaatttctaagtcccagttctgtttttcaactccaaacttcaatttcctcgttttccgttagcacgcttttcaaactgttaaatggtgtgtttttgacaaaaagtttttacatataagttatttaaaaaaacaaataaatctatttttaaaatttataataattaatacttaataaatcatgtgtggatgatgtttctcgttttgcgtgcaaccaaaatctgtctacaaaaccccacattgaacggggccttagttcctattcacaagtccaaaacaacttatgcttaggattagaggacgtagaagtttacaaaatgttggtactgattagaattatctgctgttatatcaggttagaaaagttggaaaagtttttcgggcaatcgctatcatgagccatccaatcccaaatactgcagattctcactctgtacagatcataataccacaaaagcaacttggacgcaaatcagacatgcaagtattctgtatatcacctctggtttttatccattactgggcattacacctatagattactcttggtctacttgtcatttctattattgtaacaaaagaatgttcactggtgcatgccaggtatgttttctgttgttcctactctcacaatgttgcatcaaaagggaagttcatcgcgttcgtgtcagcacaagcagagagtgaaaatccagcggcggaattgaaaccagggatagaccttcttgggccagtggatgaactatttattgatacatacgacagatttgaacctactaatgacccatcttcagacaattgtttcatctcaacagtaagtcatcgcagaaatatcaagtgtatgtaggttagacatatgaccaaaaaactgcatttgaaataaacatttaattcgatttgcttttcagagttatgatgccacaacacactttgagtctactgtgatggatgttctttccatctatacaaagatcaccggaaaggtacatttgttttctgttcaacttttaatggctgcactagagtacaaccccaaccttctgaattgaaccttaccagcactaattgaaccttaccagcactatgagttcaacattgtttgcacttgtgctattctaatcttgtattccacgtggcaactataatcaatctattctatcatgagaaggaaatgggcttttcaattccacagatacagtgctttataaaaaggcagctagttgagtagcaaccttgtaagaatatcagtatataactcttagcatcatattcagactgtatcaatcagagtaacttacattccaggatcgcaaagtgataattgaactaatattgcatttttcatgatcttgtatcaacctaaaaaaacgtgtgtttaatgttttaaatttcctttgtctcgatagtgatttcctagttgcttatgctaatcgacatgccattttatccagacggttgatctcagtgtggatttaagtgctgcgagtgctgctgaagatgatctctaatagttattggactgtcctttggtgcacagaggaaaagatttgtgcgttgtttttccattcatattaggtttatatatgattttttttcttttattccaaactatagtggctgagttttattaataatttgataatgctgtatattctaggttcatagcaatttagcctgtgagtaaacagctgtttttgttgttcagtttacttaatttcacctttaaatgttgtggatagtgctaatgaacaccgaactggtacctccaattattttgaagaataccttgtaagatttctataaaatatctttgcaaaacatgttttgagatgcaaattgtcacgtaagagctatgagatacgcgaccatggcatcaattgatcattactatttgtgtcatgcatgtgctcaactgctcaggaaaatcataattactcattccatattgtgaaatatcaggaatttagcatgtgcggtataaattgcgacttgatttccaaaaaaaaaaaaaaatagggcttcagctgaatccccataccccttgtttggtcctcctcagtacgtactgatgagctttatttacagtttactatcttgctttttctccattccatttatctaacatcaggctacatttttatttttgaaatttcatattttcagcgtagttgcaatagagaaactggggttcagctgaaccccatacggtcataccccattattttttttatttatcgtcgacatgactatggtctgatgtccaatctaagccgatttattgaaaggtcaaatgttcactgaggctgtgctcctacgtggagcgttgcttcgttgcgctagcgggaagattcattgacacgtcggcaccatgtgcgtcccaactgagccgctcgggccttcgatgggggacgagttcctcgctcgcgctcaaggacgtgcggcgaagaaacgaggatgcgctaggcagaaataacttggccatccgtattgtagaggtcctgccctggcatcatgtttccatcacatcgtgcgtcagactatgcagaggaggtcacatgcactgtgaagtgcatggcatacggatgcttttggtttgatttcattgcacataccagctagagacacgcgatgcatagtttgcactgctactgccctaagagcaccacgcaacaaaggtgaaacatactggaaacagtaagatacaaatatagtgaagatatgttccaccaaatgtgatataaaaaaatatcgtgcgacttaaaaaaacgtaaaatatctcaaaagcaattggtgatgagcatcgatgtcgtcactacataccacattattgtgattgtgctggtcaaatcatttccattatggtggttttgcaattgtgttgtggtcttcatggaatacatcatcgtcaacacgaacatgaacataggtcgttgcattaccaaaggtcgttacatcacccttgttatttagccttagttgtgtgattactcttcaccatcgtgaatgctacctagcaacatgctctagtcttatatgacttataacaagagagcagttcttttctccaacaaaaactaggtaaacttttagataaaagtggcacgctttttaaactgctaaacggtgtgtttcgtatgaaaactttctatatgaaaattattctaaaatatgatatatatatatatatatatatatatatatccatttttcaagtttgtaataattaaaactcaattaattacacgttattaccaccttttttgcgtgaaacacttacaaacaccacctaaaggtgtgttggagaatactacctccgtttcaggttataagactttctagcattgcccatatttatatagatgttatatgtctagattcattaatatctatatgaatgtgggtaatagtagaaagtcttataatatgaaaaggaggaagtagcagtaatgggcatggaggattgcgctctagtttgtcttcgtcgagaagaaatatcacttcagcgaggaagtgagtgtgaacataacttttgttcgactcaactaaaaattgtctgatcggcttaagtaaaagtaaaaaacacttggttaaagatagcaaatatattattatattctgacatgtttaacttataggtctatctttatcttgcgacttatacattatgatactatctccgtcccataatataaggatttttagaatagtgctaaatcaaacattttttttaactttgactattactagtgaaaacataaaaaaatcaatcatataaaattgataaaattgatgttactagatttatcattgaacaaactagattccgtaattctatttcaaaaaagagtgagactcaatctccttatgccatcccaaaattgatgctactagatttatcattgaacaaactatcataatatgcaactctttttatttaaaacatctcacttttatatatattgttagttaaagtatacctcgaaaatcgtttcaaaatttaaaaatacttatattttgagacgaactaagtacatttcaaatttttacgatcacccggaagatttccctactccaaaatcttacaaaattttaaccatcagattggaatccaacgtcccacatccatccgccgccactcgtctcgtccgtctctctctctctctctacgaaccacgcagctcgactcgcgagctctcgccgccgccgccgcctcttcccccaccgcacgcgcttccactccgccgccgccgccgccgccgccgaggctccagcactgccgttctccgcctccagttcttccctcccccgtcatcttcgtcgtctcgggtgtccggtgccaccgcgccgccctcctgctccatctccggcggctcctgctgcccgccgcctccaccgactaccccctcctccgccctcccgatctccgttccccgcgccaccgcccaccgcggggcctccgccgccccggccgcttccgtctaaccctggatccccaccacgaaacctaactagtaagcgccggagccgccgcctcctccgcctaagttcgctacactcgctggagatggagaatgttactggagaaggaatctcggatcagatagagaggttagcgattattaagattttgccaccattttttttcagtcgaatgttgtgtagcaaaccgattgattttcctcttttttctttcagatttcaaacacagctacaaatggatgggcgagggagaaagcacaggattttgatggtgtcagatttcttctttccaaactttggcggcgtggaaagccacatctattatctgtcgcagtgtctccttaagcttggccataaggtccctaatctcctgaatggtctatttactgccttgttcttttcatgcataattttagggactatattagggtctagatcaactcatggatatgcttttgattctgccccagctcacttgttatatgtagtttaaatattggatttaatatctttctgctataatgagttgatgccaataatggttagaggatttttgttacatatcttatccaatcgttaaatgataggcagagccacacaacggactaaattagtgctactgattttgttgcgaatgtttagacaacttttttgtttgattcccaggtgattgtcatgacgcatgcatatgggaatcgttctggagtacgatatgttacaggtggcttgaaggtttattatgttccatggaagccattcctgatgcagaatacattgcctacattattcttgacatttccgattgtgaggaccattcttattcgtgagaagatctctgtggtgcatggacatcaggctttctcaacattgtgccatgaagcactgatgcatgctaggacgatggggtacaaagttgtcttcacagatcactcgctttacggttttgctgatgctggaagcattcacatgaataaggtgctgcagtttactcttgcagatattgatcaggccatatgtgtctctcacacaagcaaagagaatactgtcttgagatcagggatatctccagagaaggttttcatggttcctaatgcagttgatactgcaatgtttactccctctccagatcgcttgagctgtgatgaaattgttattgttgtgataagtagattagtgtatcgaaagggtgcagaccttcttgtggaagttattccagaagtatgccgtctttttcctaaggtgagtcacaaccatagcactctttggagtcatgcatgaaataaaaagggtgaactatgggtatggtagaatcatttcgttatatgacatatcaacataaagcaaaatgcatacacaatagttgaactctccttatattccatcataactttcccatcctttttaatgttcacaatgttttggatttagtaaatggtcatatttgatcaagtaagcaactgtacgaactgtcaggttcgctttattgttggaggtgatggtccaaaacgtgtgcgaattgaagaaatgagggagaagttttcccttcaggatagagttgagatgttaggagctgtgcctcatgctcaagtgcgatctgttctgatatctggtcatatttttttgaacaggtagctatttaatattttcattgctttatgttgaaacttttttatttccttagttcctttttttcatcagggattgttgatacacgtaagactgctttctgtctatccctttaaattaaatatcatctttcataatacataatgttaactagaccctaatatcattacaaacatagaagaggacatatccggtgaaaatgagctaagtgttgaaaactcgtgaaaatcatacctaaaagtttcgtaaatttatgaaaaaaatactagagat

SEQ ID NO: 14722 - DNA, 21240 bp, Oryza sativa
ttgagtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccattttagttcgcttacagaggccttttgtatagccattttggaagcagcaagttgtggattgttgacagtaagtactagagtcggtggtgttccagaggtatgtgcatatatgtttatacatttctcttgtagaaaaccctgtactgtagttaattaggaaatttggagttgctgtcaaataactttttcctttttcaggttttaccagatgatatggtagtacttgcagaaccagctcctgaagatatggtacgagctgtcaggaaggctatcgatatgcttcctggcatagatccccaagttatgcatcttcgagtgagtctcaactcttgcatgttgcatgaacttgctgtgcatctgcagtttaccgtttcagctatgggctctgtgcattacatttcctttttttttctttagtttttagtggaaaagtgatttgcaagttcatttatattgatttggttgtttctaatatgtatctagatgaaaaagctttatagttgggacgatgtggcgaaaagaacagagattgtgtatgatcgtgcaatgcagtcaccacaaacagatttgctagaacgccttccacggtgagtatattgcttttgaaacattaacctatttttgtttacaatttttatgcactggggcatcaaatatatagggatgcagtccatctgatttttctacaatggtgtagatacctcagatgtggagcttgggcaggcaaactgttttgtcttgttatgatcatcaactacctactatggtgcctcctagaatatctgcaggtgaatttctgcccatacttttatcatcttctggagatctggaggaaatctaactagttcttttcccctcagcccactgaaggtattgaagaggtcccagatatcaggccagtacatgctcgtttagaatcagtagatgatacatgtgaaactcaaggaaaaggaatttagaatttgccattatcgaatcattgaccagcaccctttcctggtctgtagaatttaccttctctttttaattttacttgccctgaagcccaggaaacattttcgacagtagagtacccatgacctagtcaccccacatttggggaaatcctttgacatgcttttgaaagctatgttgtttgtaaatatcagtggtaacaccactattttgttatgtaagtggatgatccatgctcttgaaaactatgctgttaacgatcaatcgacaacatcctttggatttggaatacatgtactaatatttgttctttgtatgacgccaaaagcaccaaaaaaacaatttggagcgacctcaaaaaacttatcattaagaaagtcccattttgtagacactatgcataatgtcattaggaaaaaattctccagctttgatgaaggctgattgtctaagcacccaattctatgataatcaagattgtaccaacttcaatgatccttccctacgcctgccaattcgaagggaaacgaaccaaacagggtgttcaaaggcaggcaaatgaccggttggaagtgaacaattcctcagtctatatgccccagctagaacggaacaagctataataatcagattccaattccagtggaaaccatccaatgatcattttaaaccagagagtttgatcaaatgttgctgcaaaacattaagaaaattactgcttttggtggacgtagcggttacaaacagattgtttgtgacgttggaactgttaagatctgtgtaacgcaaaacacccgcttgcctaagagccaaattggatggcttatccgtcgatggataagttgatacaaacaaccctaaacaactgcctcaggccagagtgagcatcttcctgtaaagtgcttgctgcaaaataatgttacacttatcttgcaatttgaacgctaaacctaatagtttgccaacatataaatataatgttctatgccacaactcatcttgatttctcagcaactaagtctaagccaatctcaggtacaaccaaaactgacagcacagcaccccgtggcatatgcaattgaagccagtgctcgcacaactcacattcgcgtccttcgtctgatacccatgtcatcatctcgttccacctgttccatacaaaaaaaggagtgtaaataaagcacgtagtatgcccacttatcactaccaattagttttaacataatggaataacaaaatctcaagggctgatgctactatcaatagtagaggcaggtctaacgcaggagacaatatgtataatgtcctcaagaaacagtattgagattgtggtggttgctagctctttacctcagtgataagcttcttggattttttccctatatttgatctcaaatcagaacctcgccctttaggtttctttgctaccggttcatccaaaagatcatcttcatccgtctcacctgcaatcatattttagattctttttcttagtgaaggtcaaattggaaatgacaggctattaaccattttggctggtaaaaatccaacagatgtaacatattagcttgccaaggcatatcaaaatttccttcacatcatcacagtactctgaaatatgttgaagttgaatcggaacaaagggaagtaattaccatcattatcatcatcttcatcatcatcaggaaggcctccaaaatcttcaatgtcttccatgtcatccatttcatcatcaccttcaacatactccacctcttcctgtgttaacaagtgaatccatgataaatggatagttcatgcaaggtgagatgagcaagtctgcactcagtaacaatgcttacttcttcctcttcctcagtaggagctacatcatctttttccatttcaagaatagtgtcaaattctttgaagggatagttatagatgtcaccatagacacctttcttcaaccgttccttcaattcactttcaatattctgcatgacaacaggtacatgttcaataaggcaaaccatcaaagggcgtggatagcatcagaaataataaccttttccaactgagcggccttttcagctttatccattcttctgagatggcgctgagtctccttcctgggcattgtcatcaccttctctctgataaggggagaggaatatgattaatctttccattgcatcagagagaacagcagaaagttcacaaaaagagtatacatcaacaagcaaatcagattataatgaaactattacactaaattataccaccaaagtagaaacttgtgagatattgctaccattattattttttccattagttttaaaaagttctgcaacaatgtgaacacagtgcatctaatacaatcttaagaccatagaacaagtcaacaaaatgtgcaacttcaaaattctgtaattgaatataaccaaacactgagccagttcttattcttaaatcctagtacacaatttggcactgacagtagcgctggttgtggcagtatgaaatacatagaatgcctataagacaatcaaccaaaatcggatccccacccccatctaaaagcaaacctataaatcaatagagttcaatctacagaaatctgttactttatactactatgtttcttttttaatgacaccctacaatccgcatcttcaacctttcaaaagttttactgctaatatatttggaactactgaaaatcacatcattaaatttgtaattaggaatactttcataataatataattttattattatacttaatgcaaaagtataaaaataaatggtcaaagtcacatcttgaagacagaaaagtaaaacaacaaacaagtaaaaaggaacaatgccctttgcaaccaaaacatgctaaacaggtaagtacttcagcaaccatcttcccacatggcatgtatctcagaacagttgtcccagatttaagattttcaacctgatgagttcagcactctaatagaattttatcgtgttcagcttaagaccataatgaaaacactatggaaataaacctaagagcctacctcactttcagttgaagcttcctcattcttatccgatactgagtcatttttgtcaggcgctgcttaattttgtgcacaagtaacttgggccaaaattcctacataatgaaagaaagacaagctatgagacttaaaataaaagttcacatccagatcgaatgacaaagctcgaagtgcatacaagatgcttattgatgacttccattgctttctcataatttctgggtagtttgaccctctcccataatttgttcggaagatgggctctttcagctgttttcatgtataggtagaaaatacctgcaaggccagaaaaaagagagagaaatgaaacagaatgtaacaaaaaaaatattaagatggtatacataagttgggaaagaaccgggagcaaaacaatgtgcttaacaagtatgcttagactgcaatctgtatccttggacgaaaggattctgaagccctcatgtttcatccagagagcaccacataatacagcgattcactcgtaaaaatgtaactttctgcagtaccgagttcttgactttaaaattaactaatgaaataagcttccatggtagaccgcattatcttaaaacagtcattggttgtgtttgaactgagggtttatcccatccatagactcacaatatcatcttgatggcagttaataataacgatcacagtcacgactaaataatttccctcgaataaagaccaatcgtctcccaataacaactgtaaatgtaacccaatgtttccaatagcaactgtaaacataacccaatgcttcctaaagctattgccacaaagggcgacacagtgcatcatcgaaacggttgagctaaaaagatatttcgccccgaaaaatggaggaaagtgcggggtagtagtactcaccgtcatggtcccggatggtggcgtagcggctgttggcgagagggcaggagctccggttgcatattccggtggcgttgtacgggttccggcagaatatccccgtcgtgatcctgccgcaaaaccaaaaccaatttatcgtcagaaatcaaagaacaccacagcgacgagagaaagaagataggattgctgctcgcatacgtacttggccatgaagctccagtggttgtgccggatgcagtgccatatcacgtcgtcgctcatcttggccgccgccgccgccgcgggctcccctccttcctaagatgctgctattggtactagaggctggttaggcgagagagaaaagcttccagatctacaagggaggagtgagcaagaggatgggcgtgggtacgggtggtcacctcaccggcggctggcggcgcggcgcgggatgcagtgggaaggcggcgcggcgcggcgggcgaacgagacggggagtcgagggcgcggccgaggagaaggggacatgacatcatcatcatcggctagggcaaattaatactgacaggtaatgggctttggcccactcaaggcccatttattcttagagcggcccaaatccaaccctaggccactatatgaaggaataagtccactttgaccataatctactctgtgatcatgcaccacaaaactagatatcttgacccctatatggtgctgacatggctaacacatgacacctgctttgcttctttctgtctcttgctcactcctccattgtactacctccgtcccaaaaaaaattgcatttctagctctaaggctttgtcccaacaaattgattcatctagataagtttccttaagttctctcagcttgtaatttaggtatgctaattatatgggttaattctctaaacttacttttaatcatttgtatatatgaaatatgtgcatgcaatgggttcattaaataaggtcattgtggtcatttttcaatcctactgttttgtcctaaattagctagaaatgtaatttttatgagacggagggagtattataataggaaaaagtacaaattaattaccccctcccgaactatcacggtcgattaaattacccccttaaaacataaaaccagacatctcaccccaactatacaaaccggacaaataaccctcctaagtactgttttgagttgttttcgacttaaacttgcacacgtggcgctaacgtggcaatccagtcagcaaataaaattaaaagaactcgtggacccagctgtcatccctctcctctccctaatccctgttctctctctctccctctcgctcactcgagtggccgacagcggaggcaaagcttaggcggcgggcggtggaggcagaggcagagagaactcgggtggccagcggtcgaggcggggtgagctcaggcggctggcggcatcacgggagggcgctctgcggtgggcgaagggtgcaccgaggaggacgttgaaggcggtggcgtccaacaccttgctgtcggcgacgggagggcttctccacactgatgtgcttcacaataactatgtgcttcagattagtcattgaccacctgatgtggttgacattgttttagtgctagaaaaggattttcttttatttttaaccttatttttaatttaaaaaaatgaaccctttcaaaacttatttctaaaatttgaaacttttcgtcacaccaatcgacatggcgtgtgaaaataatactgacactccacctgaccatctgagatggatgtgtatcaaggataggggtggatatcgagctgggtcggctcggctcgttatcctaacgagctaaagtgttggctcggctcggctcgtgtgtcagctcgagctagctcgtttagctcgtgagacagaagaaggaaaagagtagcggcatatgccatgggatggggaggaggaagagggcaaacgctcacaaacaaacagattggaaaagaaaatgaatatgatgatacatcacgagcttgcactgatcgatcactacaaagcaaatgtaattgagtggccggattaaaccagtactgcaacataaatcaggggcattccagatctaaaaatgcaaatgaggaatcaataaagacaaaaattgctataagacatcaaaagattacggtctttgctgtgagacatccaaagatcgtgaatcttttcgtggacaccgtaaaaaagtgataactagctgttggacacttctcacattattttattattttcagttaaatggagaaagaaagagttgtgtaagtaccaaaatactccagatctctcttcttttcttttcccttcttcctcgcgcttgctactgccgagcagaggtgcaacgcacgcggccaacgcggccggcccgacccgagaggtgtgacgcgcgtggccaacgcggccgggccgagccgggacggctcggccacggcggggcggcggcgcatcgccgggttcaccgccgacagcgacgacgcacctgaagctgccgaggagctcgttgatggcgagcacgatgtcgttgccatcattcgccatcacgccaatttccggcaatccattacatcctaaattttttccctacccatagaggcactgcacccaatcaattttaaaaattagacgaagatgccttgccagtccaaactcaattgggctgccgtcaagctcatcatgggcacacaaccccgacattgctttgtcctgcaatcgttggaaatcgacttcccaaagttcctagacaccccgtcgtacttactgcttggtcaaattgaagctgcgctatatttcccctttgcaacccagtctcccgcaccgacaccctagctgtgcggctctctcgtggcgccgctgacgggtggccaagctccaggcctacctcctccaaccagctgccgcatgctctgccccagccagcaactgcacatgctctccattgccgctgctgtgcacacgcatgagagagaaggtagcagcaggaagaagaacatgaacagagaaagctagatatgtgtgattgacaagtgggcctatgggtaaacttgtctttaataaatatttctctagatataataaaataataccgtaggtgtccagcagctaattaccagtgtcatctaacaaaaacgtattctttcagtgtcctctagcaaagagcacagtctttggatgtcctagcaaattttgccatcaataaaacatgcaagagataatcatcttggaagagatgtacaaatgttggtttggctggtctcattgactcgttcaccttcctagctccttcttcatcgatggtgtagatgcactggtgccgacgaagccacagaggcaagggccggcagcggggccgacaaaggtgatgccgcgagggccggcggtcggggccgactgaggcgagggcctaccaaggcgagggtgccactaccgcctacgagcaatcgacggcgcgacctcgtcggtgcgtgagaagtggagagcgagcgatgctagagtagaaaggggatcgggaattcaaagtgcgagagacaggtcatgtacgtgtctctccatctagggttagtatttttctttccttcatgggctttttcttgatgggccagcttggtcgcttcatattgctgctggccaactaggtacttgagctgttgtgcttggctcgtttggctcgcgaacagctcacgggccagcttgatctggctcgttataacaaacgagctaaaaccctggcttgggttgttaataaatccaaatgagccaagctagataagagctgagtgagtcaatgagacacgagcttttcgtccagccctaatcgatggtgttttctcttaaaccgttttgtaatttgcaaatccctgtggtggagttgttccttggtttgtctagtttattctgtaaagtttgcaactcaatccaacggttggtttaagagaaagcgtgtttttaccgaacctctatcgtgctgtttttaggctgacggtcagatcgcgagaggacctgcggtcaaaccggccaggctttggttagacctaccatagtaggtcggatagaccaccgaatgtatattccattggtttttaatgttggggtgtgttttgatctatcaagattcgattatttgactttcgctggcgtaatctaccactcacccttttctagtagacttggttacttatgtttgatcctatataagaggaccttgcttcatcttgttttgagtttgcaacataagagtgtgtggacgtacctgcactcacccaccaaatgtaatcttggtgagcagcgatctgctcatgctcgactaagaatctcatattttcgcttatgcttatacttttcaactaaaatttgatttttcaacattaaatttgaagttgattttaaggtttttttatcgaagtttatttttcagtttttttcttttaaatcgctaagaacacgtatataaaaattttatccataaattaattacttttcattagaataagcgaaatgatggggccgtttcgcttaccattgcaattttggatacttcggcaaatataagttcatcgtcactctttagttgcatccgatactactttgtaataaaaaaaaaagttgaggttaaggtagataatgttcgatatggtggaagcgcgcagaataaactagattccccgttcctctcaggcctacaattggcgggtctttcttgcagttattggcgaagccaaacgttgacatgtaaaaatgtaccctgtgtcttctgctccatatatatgtgctctagcctcccactttgctccatatatcttcagctccataatagtaagaatgtctccagttggacctttcttttagtgttcctaactcatggaattccatttctgtcattacatgtcacataatgtaattctcttatgagtaaattgaaacactgataaaagaacttggaatgtgggtgcggtttaatacagcaacttgaaaagttcctctcagttaatgaactcatgatgatcgatgacattacttggtatgtctcaaacgagaaatcccactcaataaaatattgcgagctttgcaattgttgttaaattcagttttcaaagcagcagtattaatttgatcaggaatcacataaggctgagcaaccttttgccaaacatcataatcttcagccatcatgtaagattacatcttgtcacaccaataagaaagtttcaatccatcgaaaacatgtggcttagttgtaaacttgttaaccatggctaaaactttagatcggttaaaatccaaagaagaaaacaaggctctaatacccacttgtaagatcgaacaacaagaactagcccaaccaggagggtgatcggctgtagtactaaaaaaccaaaatttttaacggaattaaaagttaccctcaattttgatgacatgcggtctaaccagagtatatgcacccatctgatcgtctagaaatctccggtctgaccgaggtagtttctccggtctaaccgccgaaacctgtcaccgccaccggtctaaccgccgtgtccccgccggtctaaccgttgcaatgccgtcggtctaaccactagtgtcccaccgcttggagtgctgaacccgagaaaacacaaatagaagatctctcaaagtagattgaaactttattacttctctatgtgtttacaaagggcaacaacatcactcgtcacgaaaattttgactaaactcgaaacgctaacttttctcttggctcaactctctctaaagcgataccaggaggccacaccctccctctctatttataccctagtagacagcctaaagctacgaagtaaacttgtacaagaagtcctaatcccctaggaaaccttcccatacaagaaacaaattttacaaactccaattgtactaaacttggactctctccaaattcgactcctcatcccatatgcacacaatatctccatcttataccatatggaatcttcaccaaccacttgcattgatctttagcctaagcatcccgcatgatatccagattgttcggatgtcatcttctcccaagttgactcccgatccatcaccggcaacgctctcccgagacatcaagaccacctacacaagcatcaaccaagaaaccatatccgagcataagttctcactaacttgtctcattgttagcaaacaacagtattacatacgcatagtattcatctcgaagtcataaacacgaattatccacggatatcgaacaaatcaacccgaaacctaaaccgacacagagtcggccggtcagaccgtgggctagccagtctgaccgctcacatagctccggattgaccggcagcacctgcccggtctgaccggtccaaataaccagcagtccctgttcatcacttgtaaaatccaatcatctctaaaaccacatcgccaataatctccaaatatctaaaccaataatctcatatgccaattgtttatcatagaataataatcaaacacacgttgatttgcataccatggccacactctttttcagatgtacgctatgactcaccttagaatagagcattttaagatcaatgattcatcataaatcatatcatttattactataaagttataacccactaatactatagctctacatgcaaacataccacctcatcatccattagtaataattacatacaaaacttatgtaagcatgaaacatcatctataattcattgaattctataaatcaacatccaatcatcttgcttcatattttttttcacaatatttttaacatatatacatccatcatttttataataattaacatatattcatccatataatcaaagcgtgggatatcatattttatctacaatcacatacatactactaaatttatttctctcctaacatatagtttgacaaaccagttttatttgttaataactaatatcatttttagttttagctcaaatattaaaaaatattaaaatttacttagtaatttccgcagcaaagcgcggagattcacctagtaggctagtactattagaagatatgcgcgcgcgcgcacaagcttctctcccttaaaaaacgctcatacaactttaagaagaaaaacatactggcattaagacttaacattgtggtagtgtaattagtaagcattcacatgaaaaatcagttgcatgacactggtaatattaaatcgcaagaaaagctgaaacacacatgcaggagcaaaacaaaaaaaaaaagagcaacaaacaggaactaagtgatcttgtaagtatcacgtcacacattttcatccccagccaaggtaaagccatcctcagagaatggagcaacaacatgttgatcaccgttgtctccgttagcataagaagtcgatggtccagcaacctgctcttcaccagaggactctctaacatggaatgtccgcaaattacctgagtgtcctctgttttggaggtctcctcttgccagcttctctgccaaggtctccatccccatgtaatgcaagagtagccaaacatagctcaggaactccacgcctgtaccgaggcccttagcatgcaagtaccctcggcatctggcagcagaaaagcaaagcatctccacccatacgccttcaatcactctccacatcttctcgtcatcttctaacttcaggagctcttcagcaatggaccaagcatcttcaatgagccctcttttactggatggtgacttatcttccccagttatctcctcgagttgttgctgcacctcggcgattattctctctgcaagttctctttcatccagtggtggattcttttccttgacgacacccttcagttcgttgtaggcgtctgtgaataggtttcgccttgtgcctggcatcaacatctcaggattgacaaacagtaggtacgtcatgtaattcgacatttctcggcactgaacagcatttttatggtgaatagatttttcgcaccaagtagggcaccgattattgaggccagaggatcgctctatgcacattgttgtggcatgttcacggccatgagatggactgatatggtagaagcacaaatccgtggcgagatgccagagaaggacactctcatcgaaagctccctctaagctccagcctaatccctgaaagcaaccctcaactttgagactccattgacccctaatatcattgaacatcctgtaggtgaaaacatcagttatgtgatccttccaccaacgcttcacatgcccaagaactacgtttgtaatgctgcgcgatgaaaagcaggacttcattcgccaacgtcggtcaagatagtttctgcacccaaagaatcccacaaagttcattatcgtagaatgttttttgttgcgaacaaagtatcctaataggttgtattgggaaaccatgtcatcttgatgttggtaaaggtagcgttgccttggcctttgactgagcttggaaactgagcttgatcgttggtttagtgtcacacttgtgaatacctttacaaaagggttgtaaaactctatgacagcagtacagcagagcaatgcataagtaaccttgacatctttatcattataagattttctgttactctggtgaaataggccgatggccgtaaatggtagaaacattgctaattcacgtattacagtaccaaaaaattcactgagagagctaaatagggtataattcaactgtttgtataattcaacaaaatgatgaaggccagtctcaagttcttcggtagggggagttttaagggacatcttttcttttgtatagagtagatcaaaggtgtcggacaggttgttctgtaacaaataatatgcttcgtctccacaaagtgctgagaatgacattagttttcttacgcgattatcagtacaaggagatgcaaggtctacaaataactcatcaggtgtaaagtccgctgatctacttggtttctccagatgatcatttccacaaaaaaatccccttgcacttcgcacaaaatcttcgatcgaatcaatctgcttgccttgcctgttaatcgtcctacggactttctcgtcaaaactcaccaggctattgatgctagctctattgagagcccagggcttctccaagcatttgagaatcccaggcacgaagagcaagattgccgactgcaacaatctcctgtcccctcctggccatgatttgcaaaagacatagatggctacggtgatctgggacagtgccgtgagaacatgtcgcatccacagctcattgtcttcaatattgtaggcagttatgctatcctgtccaccaaggtgaatcagtaggataggagcccaaagaatctctaagacatcgttgttgtgtgtgtgaccaacatcctgtttcttgtgacggttaaatagggttgcaagggcatatattgctagggcatcgctaccgaggtatacaaaccagataaaggatctgaggtaggatcggataggaaacttatgccgggaggctgtaatgaaaaggaagtactggaaagcgaggctgcccaagagaagaacccggagctgccactcctcccaccattgcagagcatttgagatacccattctctctccctgtccctccctctgtctatttatatatttatatatagtggcatccggagcacactctcaatgtcaatgaatttaatactgcgtccttagctaaaaaatcatataatatgatgagtattccctccgttaaaaaaaaacaacctaaatctagacatatacactatgtccgtattcgttgtactagaatgtatcacatctcagtacttagattgtgttttctttttttttacggagggagtatatatactattccatattcgttgtactagaatgtatgatacttccttcgtttcacaatgtaagtcattctagcatttcctatattcatattgatgttaatgaatctagatagatataaataaaacagagggagtatcttggtacttaggttgtgttttctttcttttttttttttcggagggactacatgacctataaacagtaactgaaagtctgcggtcatcacatgcccgctggattccttatatcattgtttatgtcaataccttgcacgactacttatgtcattgttcaagtccgtactcaatagcatggccaggtcactaaccgtggttgagtctatttattttcttgattcaaccaaatatttccattgacttctgttaatttatctctttcctgtaaacgcataaaatcttagcgtgtcatactttacaaatgaaatgatttcaagaagcaatcactgccaacaaggcaatatggcacacagaaagacaagaaccatgatctcaacactcaagcggccaagttgtgtctattttttttttacttcttctagacaaattctctccatcccatgataactttatttttcactcatctaatttgtaccataaatactccagggatgtttgattgccagccacacttaaccatagtttgctacattgatctaaaattaggctagtttgatcaacttgacagatatttggttacagcaaccgttgtggcaatattatattccaataaattaaatccctacatgtcaatgacttaaaaagaaaatcaagattcccttgcacttagcgcggtgtggcaaaaaacaattgattgcaccatgggatgtttgtttgtatcaaaggaattggtgggataactcctaactaaatattaaaatttagtaagtacacacaaagcttaaatatacgctataggaaatttcatgatattgtacaaaaatccattataaaaaattcaaaatattgcactgaaaatccaaaatattcaacgaatgtgatcaagtgctccacatttaaagcaacgagtttgacctcctcttttcctgtacctgacattgttcatagcttgagaaatcttgttagcagccaaagcccagtcctcctcctcgaattgttcgagttgctcatcggacatgtcattaattaaagcaagagcggtagaatttgacgatgaagcaccaatatccaaacaagtcgagggagaaaccaaagcatgcactagacttagaatcaactttgtgagaaagaatattcatctcatgtgttttgagttttgtataaagtgaatccaaagtcaaagtggacatatcaacagactcttgaatagatgtaaccttcatctcccaaacagacatatcaagaccattcaaaaagtggcgaggaatcttagattgtgaataattagtgtcataagcagaatcaatggatctttttaaatgtactccttttttaaaagatctcgatgaagttatttaatgtttgtagttccttgatgaaagtttttcaaagcattccaaatctcattggcggtttgaagatgtgaaacaggatcaaaatccgaacgagaaatcccactcaataaaatattgcgagctttgcaatttttgttaaattcagttttcaaagcaacattattaatttgattaggaatcacataagtctgagcaaccttttgccaaacatcataatcttcaaccatcatgtaagattgcatcttgtcacaccaataagaaaaatccaagccatcgaaaacacgtggctacttgtaaacttgttagccatggcaaaactctagatcgattaaaatccaaagaagaaaatgtaggatcgaacaacaagaactaagccaacaagagaggggtgaatggttggagtacccaaaaactaaaacttttagcggaattaaaagttactctcaattcgatgatacgcggtctgaccggagtagatgcaccggtctaaccgcctggaaaccgttggtctaaccgcagtagtcgctccggtctgactgccgaaatcacttgtcgtcacctgtagccgccaccggtctaaccgccgttactccaccggtctaactggtccgatgccatcgatctgaccggtggtgtctcgacggttagactgccgaacacgagcaaacacaaatcgaagaactctcaaagtagatgacaactttattacttctctctgtgtttacaaagtgcaacaacagcactcctcacgaaaatctcgattaaactcgaaaccctaactattctctcaactcaatgctctctaaagcgataccaggaggccacactctccctttctatatatacccgaggtagttagcgtaaagccatgagccaaacttgtacaagaagttctaatcctctaggaaacattcccgtacaagaaactaactttacaaactccaatcgttccaaatttggacttcctccaaattcgactccgcatcccatacgcacacaatacctccatcgtatgccatatggaatctggactaaccatgtgcattgatctttagcctaagtatcccacataatatctgaccgtccggacgtctccttatctccaagttgactcccaatccgctatactatctcgaggcgtcaagatcacctacacatgaatcaaacaagaaaccatatctcgagcacaagctatctccaacttgactcattgttagcaaacaacagtattacgtacacatagtatccatctagaagtcataaacacaaattatccacaaatatccaatgaaataacccgaaactaaaaccgacacatagtcgaatggtcagaccgcgggctggttggtctgaccacacgtatacctctggtgtgaccggcaaaccttgaccggtctaaacggtccaattatccagtagtccctgtttatcatctgcaaatccaatcatctctaaacccacttcgccaataatctctaaataccaaaaccaataatctcatatgccaattattcatcatagaataacaatcaaacacactttgatttaacaaagtatataaaagtttttttcacaaattacttttcgtttgcaaatatgatgtttcgcttattccgcgaataggcaaaacgaagaaagtgttatcatttgagtatttttcagtccttcgcaagataccttcttagcataaaggaactgcaagtacgttaggatggaccttgtgctacgtaccttcagctcttcaagtaacttttgggctatgaacatgaaaaggcttgtcgactagaacatgttgtaaacatttgttaattaacaacctcatttagttagtttgtttgcaatatgttatttctcgaagtattagagaagtatacctatcagcatatgttcgaatcacacgacagtgaaacttgactagagaggagtgtaaagttcacttgtagggctagtttgtttctttctctagtcccgtagctgaagccttgtggacatggtgagcaataccttcgtaagtgtagacaatactgaacatcacaaccagctcccacttagatctctctgagcctacgccaaccaaaatttcagataattaatgagcagccaaatggaatcttggtgagcagcgatctacccaaacggcaaagcctgatatcgacgtgccttatcatctatttctgcaaagaaagggtcacaatgtagttgcatcctacttgcaatgctaatctgttgactgatgtagcttatgttgcagcagttgcaattaactagattcccagtcaccttcaagcctaaaattagcagaacaatggtgttttcagcccaccctatcatatagtacactatgctctcatgggactcgattttgttcattatgccatatatatagttatatacgtcttcaatcgaactagtcgtttattacaccatgacatttcacacagatgacactagaaatgtagtgcctttatatcactgcacgtctgcacacgctataccattttctgtccatggttctctttataaacccagatggcaggagttctgcctacaattaagaaggagaatactacaattagtaggtctttcttgcaactgttgaagaaaccaaatgttcatgttgctatgtaagcaccttttttgtagtcagctccatttgtgtgcattctagcttcctgtatttctcgaatttatacatctaaaagcaataatgtctctctatccaaacctttcatttagtgaacctaactcatgggattccatttaatgtcattatatgtgtagttctcatttgagtaaattgcaccttggatacaagaagttgccaagtgggtgcagtttaatacaagtatataacagctagcttgaaaagtttctcttgtagttgtgaacttggcaagctcttattactgaaacatattataatttagtagtgaatcggttgtgttcattctgctggagaccaatctgttggctgttgctatccaatctctacttctctagctatttctcattacccaattggttgtgttaatgaggcaccacgcatattaaggtagaggaacagctaattaacactagctagcaactgtggaacaacatgtaacttccacataaggtcagagaagaccctcaataagacaataactagctagaactcaccatgaccaatttacagattaagagaaactgatctggagaggaatgtaaagtgaaatttgtatggctaatttgtttgttttctggttaagcgtggtgcgcatggtcggcaaatgactattagcttcacaagtgtactaaacaaaagaaaacatcacaatcagttccgaggtcatggagggtcactgcttaactccattgctccaatcaatttgagaccgtcagaagcaagacttcggatgtgcattgatcacccatcaacacacgggatctgggtgagcagcgatctactgattcgggagaacaagtggattttttgatacttgtgcaaataagttcacggctatgttgcatctagggatgaaaatggtacagcgggcttattttcgaaaacggaatttgtcggtcagaattattttggattttttcggaaattgaaacgaattcggaaatattttctcagaaacgaaatcgaatatgataagggcagtttccgtcggaactcggattcggtcggaaactttccgaaaaatttctcggaatttctggaattataaaggcccataccatagtctataattcctccccagcccaacctaattcagtatcctaattcctaagtcactcaattcagcccaacccaatatactcaattcaaacttgatagttggattttcgtccgttttcgtaccattttcatccctagttgcatcctacttgcaatgcaaatctcttgcctaagctagctaaagttgtagcacactagcagttgcaattaactagattcccagcaccccccccccaaaaaaaaaccctacaatcaatggatctttcttgcagtgtaccttgtgtttttagctccatctaagcgctctagcttccagcttcccacattgctcgaatttatacacctaacctaagaacaataatgtttccggccaacattccattcagtgcaccagccatagggattccaattcagtcatttttcatgtcactgagcaatttccttaattacccaatagatgttttaaattagatgacaccatacacaatttaaattagaccgcataatgtgttattgctgtttttatcgaactgtttcaattctcgcatgccacattcactactgcagaaaccttttattggtgccagtcgggagctggttaaaactaccggtttccagtcagaaccaatttaagagtagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcgaaaacaacgaactgtggtatcatcccgcatttaactatgtatgaagatgaccttataatttcacccttgcatcattacgctgccacacaaccccgttatatgatgattaataagttgacaataagattgataaataatataaataaagttcaatgatacttcaacatcaatgtggctaaagcatacaatgtggcttacatgataggattacagcataactaatat

SEQ ID NO: 14723 - DNA, 331 bp, Oryza sativa
aaggtggccggctgcgacgaaggccgtcggggcgaaggaggttgcggccggcgtcggcgacttggtggcggcgcccaacatggcgcggcggtgccccagcgccgatgaagacgacgatgcggtcaggcctagttggcttctttattcggaatgggctgctccttaatgcctaatgggctcctcctcctgctagccaggcccagccgacttccttcttcggaattttgtcggaaatttgatggaaattaccgataaaaaacggttaccgacaaaacggtcggaaaaaaccccatatcatttccgctaccatttccgaaagagattaccgttt

SEQ ID NO: 14724 - DNA, 750 bp, Oryza sativa
atacagacggaagacgtgacatagtttccaacccatcctagccatagataagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggcagaggtgctactatcaaaaccatgcaccccgagcccagcctaaaaccattttggggattttgaatagaaggagcggtgtgaagccaattccacaagaaccaaaccattctaaaggatccaggtgatatgaatatttcccaaagtctaaagttgtaaaaccacctaatgttacctaattaaattgcgaagcatctacctaaaattaaactagtggtgccatgagtagagtgtccactagttggggttttgtttattctagggtgaacaaggtattaataataacaatacaactattattttgggcataacaaaggaaaataggcatggcttaataaaacaggggtaacccgggaatttaaatgaagcgataatgcctaatttaaatccacataatttataaactgggat

SEQ ID NO: 14725 - DNA, 1101 bp, Oryza sativa
tggccataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgcttcatttaaattcccgcgttatcactgttttatttagccatgcctatttacctttgttatgaccatattattattgttattgttattattattaccttgttcaccctagattaaacaaaacctcaactagtggacactctactcatggcaccactagtttaattttaggtagatgcttcgcaatttaattaggtaacattaggtggtttttcaactatagactttgggaaatattcatatcacctggatcctttagaatggtttggttcttgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccgggcgtaggcgggattgggtcggtactcttgtctatggctaggatgggttggaaactatgtcacgtcttccgtctgtataccgtggtggtatgtggcacgtggttgcacgtgaggaagatgtgtcttgggggtaaagatgtacacctctgatcagaggaaaatctattccaatagcccgccc

SEQ ID NO: 14726 - DNA, 5093 bp, Oryza sativa
agttctaggatcgcgtttacaaaaaagccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaataatgacgccaaattttcaacgcatgaactactgcagctaactcaatatcatgagtagggtagttcttctcatgcggacgtaactgacgagatgcataggtaaccaccttcccatcttgcatcagaacacaacctaacccaagtttggatgcatcacaatacacctggaaacccttttttggatcaggtaaaatcaagataggagctgatattaagcgattcttcaactcttgaaaactctgctcacattcttccgaccacttatacttcacatctttctgtagcagtcgtgtcatgggcttagtaatcttggaaaaattctctataaacctccggtaatatcctgcgaggcctaagaaactgcgaatctctgaaactgtctttagttgtttgcagttggttacggattccacattactgggatcaacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctcttgttcgagagtagataagaatgtcatcaataaagaccaccacaaacttatctaggtattccataaacaccttattcatcaagttcatgaagaaagcaggggcattggtaagtccaaaagacataacagtacattcgaacaatccatacctagtggtaaaagctgtcttaggtatatcttcctctttgattctcaactggtgataccctgatcgaagatcgatcttagagaaaacagtggcacctttaagctgatcaaacaaatcatcaattctgggtagtggatacttattcttgatagtcacatcatttaatgcacgatagtccacacacatcctctgggtatgatctttcttttccacaaaaataaccggagctccccatggagatgaactcggtctgatgtatcccttctgaagcaaatcatccacttgcctcttgacttctgccaactcattggctgccattctataaggcctcttatgaatcggagttgttccaggtaccaaatctattctgaactctatatcccttttgggcggcataccaggtaaatcatctgggaacacatcgggatactcccggactataggaatctcttccaaagttatctggttcagtcttgaccttaaagactcagaagataatgcatgaacagttacaactcgaccatcactactggtgagagttacttttctgttagcacagtctataacacctttatgtctggttaaccaatccatccctaggatgacatcaaggtctttggattctaacaagataagattggccagaaatggtactcccttaatttctattctgacagaggggctacgttgcaaagagagtgcttgattacttggggtactaaccatcaaaggacgtctaagatcttctacttccatcccatgatttcccgcaaaactcatagatagaaatgaatgtgtagcaccagaatcgaaaagcactgttgcatgaactgagttaacagggaacgtacccaaaatcacatctggagcgtcttgagcttctgcagctgcaacatgattgacacgggcctttgatgctggtatagtagagttgctctaggcagggacaaccttcacgcgtcggggctttggacacttgtcagcataatgtcctgggtctccatagttgaaacacaccacgggcttgctgccttgctccctcttggcaggcggttgttgtgttggagctgcaacaggacgtggagcttgattacggatgttgttgccagcattgttgttgaagaactgacgctgcggacgaacaacagatgaagaacctccatgtggcatggactggggtacaaaagtaagacgcggcttctgattattcccctgttgtatcttgaattgagcaatccggcgtttcttctgctccatgcgattatacttgtcctcctgacgaatagccttatccactaatttctggaaattagaataatctccagtcatgagtgggtaagaaagctcatcattaagtccttccaagaacttctcctgacgctcttcatcattgcgcacatcttctggagcataacgagctagacgattgaactcgtgtagatactccgtaacagagcgagatccctgggtgagcgacctgaactccttcttcttgagagacaccactcccgatggtatatgcgtcttccggaaagcagcggtcaattcaagccaagtgataggttcagcagtagtcctattcaggcggaagtgatcccaccattcagaggcagggccaagcaactggtgtgatgcaaatgagaccttctcctgatcagtgcactgaagcaaatccaacttcttctctatggcatgcagccaatcaccagcttcaacagggttagtggtactagagaaaataggcggcctcacacgaagaaattctgctaacttattctgaggaggtgcatggttatttccttggttctgctgattctgaagttgttgcatcatcatgtgcattagctgagtctgttgagcaagaacttgagcaagggttgggttcccttcattgttattgttgttgttggggttgttgaggttgggaccattcccgttgctgcgagtgttcaccatctggcatggacagggcacaagaagagaaaccggggaaactacttaggacagagaattactttaacttttattgatcttaactgagtttcattattacaaactgaagactctcacaccactaaactcaccaacttcctaacactcagaggcaaacaaacgcatgcacttacattccaccactgatgtaaatcacatgcaagacccacacacacaaccaaacttaaaacaagcaaactaacacaacgatctaagacaacggcttaacaagtcactctagttcttccgagcatcggaggtcgattgaaggctcgttcggctcgtcttcatcatcttgagttgctacccactcaatcttggaatggttgcgcttggattcttcttcttcatcatcacttacgttgacgaccggaggatctgctggggcaacttctttctccaccacacggacctttggcgccaattgataacgagggacaaatagagctctcttccttgcggtaagacgaatcctggccttctgcggcggtgcttctcccttcaacgcagctagttccttctccaaacgatccaccttgtcttctagcttgcaaatcttaccacgattccaatcttcacgatcttgggctgctaacacagtctctgcatgactttcatccatagcccatagcatctcaaccaaatgtcttgtggtagcatcattctcaattccttcagtctcaaggtaactgccacggtcacttccctgtggttgacgaggatggtaacgatactcagtgtcggccaattgatcactgtagcgatcgcggagctctcctatggcgatccttgccacttcctgacatgcatggatgtagtttcttcctccagcttcgaacatcactgatagaatgtcttcactattactgttcaaggtgactttgactcggcacctctcttcatgacgatcatgaggaatctgagcataaaaaggggcagtcccaaatccaatgacaaaggacattgtacgcaactcctggacaaaaccctcaacaccaaacaagtactcaggcttgtagcgcggcatctaaacacaagtgaaaggagggagttaagacatctatccaattaatatcacaagtttttggattaatttgaataaagttttagaaattcaaagtaaaaggtaagtaaacaaagtaaaccaagtttgcaagataagttgaaacagttggaaaccaggttacaagttttatacttttgaataacaggttccaaaagaaataaaagaaagttataaaatcaacttgttaaatttattttattgcagcaagattaaatgaaacaacattgtaaaatttttgctggaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttagagggcttctatgggtaaccatttggcataacctagggtcaagggagctctgataccaacttgtcacgcccggaatttctatccaaaattccaaacgcttacatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacggcgcggacgactccactccacaggcagcttgaccagggctacacctaatcctccacaccatcagcttcactgtagaactcttcctctgatgaataattgcaaggtgagtatatgacatactcagcaagccacgcagcaaatatgcaagtgcacaggataacaaaggatggcataatagggtttcatttgcaaaagcagctttta

SEQ ID NO: 14727 - DNA, 1825 bp, Oryza sativa
  unsure (1)..(1825): unsure at all n locations
gggcgaattcgagctcggtaccctccaaaatcccctcctctcctccccggattcctcccccaaacctcaccaccaaacaccacaagatccaaccaaaatcaaaatcactccgctaagattagagagaccctcttcctctcgctacaaatcccctctctctctctctaggctactcctactactctggctctcctctcctctcctctcctcctcagctatggtggtggcctcctcttcttctcgccgctgctctctcgtcttgtggcctcctcctccccctctctgccttggccttccgtctggctcgctttctaggcaacccgctcgcctcatcctcgttttgtcgcttgccaccccccccccccccctccatccccgcatcggacggcccggatacgcgcgcccggcgatcccgcatccgacggccacgggctcgcgttgcgccaccgtggcgggcaccgccgccctcggatcggggcagggaggtggggcccacacgcggggggtccgagagcgacgctaccaccgaacccccgcgcaataaaatctctcttccttacggctcaagcatgggccagaaaccgacacgtggcggttgcccgcgggcgggaaaaatctaagcgtccaccggcaatangaggtgggtggtggatggggaaaaagggtccccatttagccccctaaagaaaaatactaaaataattctggtatattttaataaaatcagcactaaaataatattatgccttattttatatgaatttaatattggctcgttgtccgcttttggtgggacccacttgtggggccatgtagatggtcctgatctggacagtggggagggcgggggggtttaccggggctgacgtggcacggcgtcgcaccggttgctgcgcttgtgttaaaagggcggaaagtctccaggcaagcattaacggtggggcccacgaaccggacgtagcctccctcacccctcttcgctttttctactcgtgggcgccgacgtggcagtgcgatgacgttacgtgggcgcccactagccaccaaccttcacagcactactctcactcgcactatttctgaaatactaatgctatttattaatttattatgccgaatataaaattcgataaaaatactgttttaatttcgaaaattggtcaattttaggagtattctagtcagctccgccatcattcatcaatccagcaaggggatcgagaagaagccatcacttgcaactaaaatattcgatctactcactaaattaagcaaagaaacctgaatacggagtaccaatagagttaatctttgctgcggtattcggaatccgaatgggtacttctaccattttctactagtgacgtacttggttcgtgcaagctcttatttaaatgaaaagaatcacgtgcgtcgtcaccagtagttttggcttaacaccgagggttaattcttcatgcgtctacgtggacagatttaaccacaaatataataattagacatacttcctatatctcataaaatataaatttagaactagatgtaacaaattatagtacaataaatctaaatatatatatgtcaggattcataataataggatatgtcacattcagtactacattgatttttcatgcgatggaggaagtacgtactatattggttttgatggacggagtgagtacttcagaaattccccggtcttttggagaattgtgttttattatgtggatagtagaaaaaaaatctactagcaatagcattagcagttactccactaatgacgctagttaannnnnnnnnnnnnnnnnnnnnnnnnnnnnnn

SEQ ID NO: 14728 - DNA, 696 bp, Oryza sativa
  unsure (1)..(696): unsure at all n locations
nnnnnnnnnnnnnnnnnnnnnnnnnnnnnnnnnnnnnnnnnnnnnnnnnnnnnnnnnnnnaaattttagaaataattgtattttgagacggatggagagggagtaggtgatttctagatggccagagttggtgttcatttttttactaaaagactgaagatgaagttagggcccgaaaaaaaaatcattagtgcctgattagtgagttttaattattataaacttaaaatatatatatttgatattttaaagcaacttctatagaaaattttagcacggaatgtatcctttaacattttcaaacactctcgcatgctaactaaaactaataaaaaaaaagaatatagcctagactactttacccccggttcaccgcacacctggaacgccgagatcacgcaaccttgcgccagcgccgctactacaaaaaggccgcgccgcgtctgtaatccgatcgaccaacgcgcgcgagagacggacagacaccagctgctgcaaccgcgcggagcatagcgagagctttagccgagtcgacgccgccgacgatccgctttcactacacctgccaccaccgccgtcgaccgcgccccgcaagagacctctttgccgtcgcctcgcgcccacgacgtgcgcgcgccgcgcggtccggtcatcgtcgccgcctcttcaccgatcgatacggaggcagccgcgatc

SEQ ID NO: 14729 - DNA, 692 bp, Oryza sativa
gctctggcccgcagatggacgcttacgtgcgccaggtgcggcgtatggagcgccatttcgacgggataaagcttcggcacgtgcccagacgggataacgcggtcgccgatgaactctcaaggctcgcttcctcgcgagcccagaccccaccggacgcctttgaagaaaggctagcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacagagtcctcctgaagtgcattcctcgggaacaaggcgtcaagcttctcgtcgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgg

SEQ ID NO: 14730 - DNA, 763 bp, Oryza sativa
  unsure (1)..(763): unsure at all n locations
atgaagtagacggtccgctgcacctttagggggggccgatcctcttcgccaggggccgcatctccagggcgctcttcgtccgagaggccacgcggggcgcactcggcttctgtgccgacgacctcggggtcagagggcgacaggcgcggtcttcccgcagtggccccggagccatcctgggggtcgggggcgcctggcaccgtcggacaagcaggcggagggccagctccggccgtcgggggccttgggccgccgttcggctcgggggcctctcctccctgctctctcccgggtcgagtcgacacagggtgaggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatctgctctatagctcgtatcttctcggggttggcctcgatgcctcgggcagagaccaagaacccgagaagcttgnnnnnnnnnnnnnnnnnnnnnnnnnnnnnnnnnnnnnnnnnnnnnnnnnnnnnnnnnnnnnnnn

SEQ ID NO: 14731 - DNA, 672 bp, Oryza sativa
  unsure (1)..(672): unsure at all n locations
nnnnnnnnnnnnnnnnnnnnnnnnnnnnnnnnnnnnnnnnnnnnnnnnnnnnnnnnnnnnnnnnatgggatgccttgttatacagaaatcacatgggtggagacaatcaggtaaccgatacatttcagagttgctgtccagatttcttttggaccttttgttgttgtactaaacggcaaaccggttcggcttttttgcaggttgaggccatgctcgacaagacgatctgtgcgctgtcgaacgttttcataggtgcatcaggctcaaccttcacagaggacatcctgcgtctacggagaggctggggttctgcgtcccactgcgacgaatacctctgccagggtgagctacccaacttcatagcggagctagactgagaaaatgacatcctagaagaagaattgacagctacatccccctttttttccccactacgatctggtggcatgatacacattctgtaaaatggcgtgtacatcctagtgtaaaagagcgatgatatttgttgtaccggtacccccattgatttgttcggtgttgtacacggttaggcaatagaaagagtttggtttttgcgcttgctcagggttcatactctgttatactgtgagacagcttcatagattcatagctcgcaactttgttgcctagcaacgtgcctgacagacacta

SEQ ID NO: 14732 - DNA, 557 bp, Oryza sativa
gggcgaattcgagctcggtaccccactcgtgcgaactcctctttgtagaagctgaagaaaatcaaggggagcgagttagccatatggagaagaacgaagaacaccggagatgccaaaatttccggtggtttccaagcgcatacctgaccgagccttcctcggaaccggcacgccgatcatttcgtcggcggccttccatacgatggggctcttcggattggagccccctttccgctgcatctgcggctggcctccatggtggtgatggttgtggtagcctccgccgccgccgccgctgctgctactgctatggtgatggccgccgccgccgctgggctggggcggcgagggcggtggcgcggtgctcggcgaccgccgctgcaccggcgggtaccgcggcgcggacgcggcgagctcctcgtcggcgtcctcgtcgtcgtcgccgaggctctcgtcggaggtgtcgtcgtcgtcgtcccggccgccgccgccgtcgccgtcgttgagcatcaacctctcaccccgccgcctcttggagcgaggcgagtccctcggcc

SEQ ID NO: 14733 - DNA, 1853 bp, Oryza sativa
  unsure (1)..(1853): unsure at all n locations
nnnnnnnnnnnnnnnnnnnnnnnnnnnnnnnnnnnnnnnnnnnnnnnnnnnnnnnncatgtggtggggaatgagtgagcaggaaaaatggaatggccactgccaaattatggccattggattcatcacagttgactgctagaatggcaaatactgcctactactcctacatcaaggcatggatgaacatacattgaattttacaagtgtttgattgatgccaatcttgcaaccgtatcagcactgcatcctcttttttattccgaattatcaacaacgggtcgttgctttacattttacaactggtgcaccgcccttcttttttaaaaaataaatgcatgtagaatttgagacactgtcagtgcaaaagtaagacacccaaggagaaccacaccaggtaaaaaggtagaaaatccacttgtgagaacaaaaaaaaaaacaattttaactccaaaatactcctacctttgaatgcgatgcacttgaagcagcatcaggattaagctaagcacagaggaggagtactggagtacagtaccattttgcaggccgggtctccctgacatcaactttggagtacgccaaggaggatgaacaaaagaaaagaagcacagccttttgccgaagcatttgatcctgccctcacctcgaaatccgtgccgccccccgcttctcttttgcaattcgctgacacccaagtcagcaatggcggccaaatcgcgctccggcacggccgccgacgagtccgcatctcgaggcgccgagtatcccggcgatctagctttgctttggcttcgattcgagccggcggaaaagccaatcctccgtgccggccatcgccggcggccggtctctcgcctgaagcaggagggccgaagtgatggcgcacctcacctcgccgtggagcaacggaatcaccaccgcgcgcggcctcacggatcgatcgatcgatcgatctcatggcgccgcgcacccggagacctcttccctcgccatcgccggcggcggcgggtgacgcactacttccaccaccgtcaccgncaccaccttgncgtcgatctcgccgggaggccgcgcgccatggcggtagaggggggaggcgagagcgaaaaaaaatgtcacaaactctgaggcggaggaggaggagtggccacgtgatgcccgcgtggctttttataacgggctcacacttgtcgcgtgtcgctttgcaccccttgctttctatgctcatctttttttttttgttatttaaagcgaaagcggcgttgttgattgttgaacggccacatcgagcggtttcctgcgcggctttcttttcttttatttttctttctttctccggtgatgatctttgaacggtcccagaggtgcttgtacctttggaattggttgttttcagtatgtgattaaataagtaatcatgtcatcactatgacagtgtgtttggaaggttttagtgtgcatttcttagtggaaaatcttgccaatttgtgaatggcagcagtgaaagaaagcaagccactcgattttctggatgtatattactagtaagaaagaaggtagatcaaatatttataaaaaatatttataaaaatatttatatcatgactaaaaagttaatttaaagcatgtataagcttttcaagaacaatttcaagattttcgtgcaagataactcaatccttatggccttgaaattgttttatccattagtcctaaaatatagcaattttgtctagatgactagattcatagctcaaatgattaattttaaaacatgggaaatataatatataatagtacaactactccctccgtactcataaaggaagtcgttttggacagcgacacggt

SEQ ID NO: 14734 - DNA, 6686 bp, Oryza sativa
  unsure (1)..(6686): unsure at all n locations
tgacaatgatatacatactccatgtcttggaaaagaaaaaaatagcttatctttgtcgacatgttttcagtccattcactaacgccctaatcggttggtccaacctaataacatatcatttgggtaggggtgatgacctttgcactctatcacaggtagaggcctaacagcgaaaaaaaattgattataggcaagctaattaagccatacaatagtctattcagtactccttaattatttgaccacatggcctaagcaatgaccaaagatgatgatggcttgtattgtgtgctctagatggtttgtcccttctcaaatcagtcactagctagcctgcctgttttgttgtgattgtctgtggtgggccattttccttttcaatttctttattagaagctcaagcagccaagctaggagtagtatagatcatatagcatgcccaacttgagtttacaaaattacaactgacaaattatgtgtacattgttggagaaaatatctcccataattacacactgttgaagtagtatagattacaaaattacaattgacaaattgtgtgtaccctgttggagaaaatatctcccataatcacacattgttgaagtactatagattaattgtccatacttgtttatcatttttttaaaaaaaattaaatatgtatatcaatatgataaccgtagcaggggtctcaatttcgaattctggttgatgcaattaaataagcatgcttctgttttacatttctgagattgaaaagcgttcatgggatagagggcacattagcataaataaataaataacttaattttcttgtcagtctaaatatattagatgaactgaagattttgagaagtagctgttgagagagcatggactgtttgggacatcagctgaggattgtatgtacgagacttgcagctgttaaaagtttcctgaatatggcttaataaacctttaaaacaacattttaaaaagtactgatttgatactctaaaatattcattttgaaagtgccataaataaaaatagccgggtgtccgttgcataatactccatcttgtacgtattctagaaccgtctttgtctgtctcagcaacagtaattactacttcagtcaatataagatgctagggtggtgattatttaattattggatcgatggggatgtattagttaataatttccttgtacgattactaggtaaaggtcacgtacgcgcctgattctctatcttaatccttattatactgcctcgccgtttgtttattggaaccctaatggtacaatgattcccctaaaatattcataccaattccactaagcctctactctctttgtttggcctcttctatttgttccaaaataagggtcctttaatttatttattatatgattgataaaaggttttcatagaatttaaatttctatgaaaatttccctctatgtccctttaattcataagaaaagaaataaattttcccatagaattgtatttcttcatatttcatagaaaaaataccgagaggtatgagctatttataatactccatccgtttcatattataagtcgtttgacctttttatagccaaactttgttgagtttgaccaagttgacagaaaaatctagcaacatttaaaatataaaattagtttcattaactctaacatttcatatattttgatactatatttgttttgtattcaaaattattggtgatatggacccgagggtatcatgtctagagggaggagacggcccccaaacccacgtggcacttccccgaggggggttgggcccggggtggagtggcggctgctccctcccagttggaggctaggccaccctaaccccctccacgcacttaccagcatgcgcgggttaggtgggcgcacccaacgcccaactaaccgtatttaaggcgggtgttgcggccgtgccacgccgtatttaatgcggcgtgcaggtgtggctgacaggctgggtgacgctgaattgaccgacgtagcagggtgagtgcgtttgctaaaaaaatgactaggaaaataagtcaaactatttatataaaatgaaatggagggagtattttctttgtttttcccgtagcactattgaaagttctcatcttcttctttcctatgttttttattccttcagaattggagaatcttctattttttttctattcctatgtttttcctatcctagaatcaaagggggcctaaatatcttttttagcaattattatatcaatgtttataaagtgctacattcgtcccaaaataagtgcaacccatggatatccgtgtccaacgtttgaccgtccgtcttatttgaaaaatttatgattttttttaaaaaattagtcacatataaaatactatttatgttttatattctaataacaaaaaaaatactaatcataaaaaatttaaataagataaccggtcaaacattggacgtaaatagtgcaaaacattacttattttaggacagatggaatacgtggtaaatgtattaggagtggataaaaagagaaataattttattggaatatgataaattaggggtattctagtttttttttgtgtatatgtacgtgcaagatgagtgaaaaataaatatgacggagggagtagtttcaatgcatgcaggtcgactctagatgctatcccatattgcccgacccagatatgtcggccggttgataaagtgtcaacgttcccaattgtaaaaaaaaaaaaaaggaaaaaatattccatttcagctttgttggcctattttgcattgattattcaatttagatcaggtagtggcactcgcattacaagaaacgatggcacatttacgctttcaaacatgagatgcagtggatgcaaaatccagatctgaatactgcatcatcaggtactaccggaatagctttcagttgttaatttattactatctggcagagattataaaatgttgacctgggcatggagattgattcataccgctttgatattcgttgccagctgctactacctttcaaaaaatagattaatttccagttaagtgcatattttattcccaaataggactacatccatcccattataagtgcagtcgtggttttccgcgtccaattttgaccgtccgtcttatttgaaaattttttaaaaaagtttaaaaacataaatcacgagtaaagtactattcatgttttatcatctcataacaacgaaaatactaattataaaatttttttaaataagacgaacgatcaaagttggacgcggaaacttatggttgcacttataatgggacggagggagtaccacttactaagttcccttgtttgtatcctcgctaatgttattcgatctcataactcttagacaaactttagtctctgttagcaagtgaatgctaaaaaaaaatagattgtttgggtataaagagttatgaaaaccacgatgagaaaatggattagatttcatgtttaaaaaacatttttggcatggttggatagttaaaaagagagtaaaatgttcggtttcatagttgatggttcatcctacactcaatgatagttatggtgtgtttgatactttccttttccatcgcctgttctctcatttttttttcgtgagcatgtttttcaacagttaaacgatgtattttttcgtaaaaaagaaaaatatataggaaagttgtttatttttagctaatatttattaatcatgtgttaatgagttattttgttttacgtgtgtgagggagaagtactctttatttagagtatgcaataagccaatatcgttattattagaaagaggatagcatatcagaaagcatagttcctccttatttgccatctagtaggtgtctcatagacatatatgtgacaaataagaaaagaaataaaataatttccacccgtgtataattgatccccatataaacagatcagcctaggggcctaaatttggaaccatagttactgacaaaaaaaaatgagaacacaatacattgcattcaactagctagtcttgcactattaaatattacatttttattgaccaacatcttactactacaatagtagggttagagaactgaaataccacgtgaaacaaatgtagaaagtgggagtagtacgtgcatttgttctttctttttttcaggtaattgcaaaagtatttctgtaaacacaaaagtaacctgctgtaaaacacgcagctcatcgtgcaaaagaggagcacagataatgcaaaacaaatggatgtccacgagatgactaatagagtaatgatggtgatgatgcttgttacttcgaacatgggaaatgaaattggggaaattagtcttcatgattatctaacagaatctacttttaaaagctggaccagcctaattgtctctcctctactaccactttactccaatttaaaatgcctgtttctggatgcaaattcaacccatgatcttctgcatccaagatatagctcatctttagtcaacactgtatttctaaaacaccactacttagggttagtgtctaagcttgaacaagtttgggtataactaaatttatagtcccattatttcgccaatagctatccgtgccctaaatatgaaatacccaatacatgtatactaacttcggtggagtccaccatataccaagttttatacgaaatcaagccttaaacatatgggaaaagtcctggatagacaatataaacttatgtaagttgatgtggtttatgataatttaaatttaaataataatgattcaaatgtaaaagttgttgtggttttatgtaaaagtttggatcatagattaatcatctaagggctaaaacaattgaggtgatatgacttaataagagaagaaattaagggagataatttgaaccatgaataatcatctaaggacaaaaataattgatgtgatatggattaatgagagaagagagagagagagagcacattaacttagttaggagttaggatgaactatataagtatataaaatattataaaaaataatgatacatattgaaatattatgtgaattatgtgagatgataatttaacatgcttacatttgaaaagctataaaaattaataaattataaaattatagataatataacatgcttacatgtttaaatgtaataattgttattggatgatgatgtgatatctttgtatgttaagtttttcgatttagtaggctctaactttataataaaagagaaaatgtccatatattgcaatgggttagtaccaatggtaatgagctgggtgtgaacctaacctaaaccatgtgaatttttaaccaacctttggtttatgtttttatccaaaggattttttattttttatttttatgtgtgagagcgtgttgtgcacgagggaaagggtggacgaacgtcactgcaaaattatgttgtttcgagacggccggataaatattacaaaaaaatcagtaggatagtatttgaacaaagtgctctttctttttaacttaaaataattttgacattacaaactttttaattgtgtaatgaacaaaagtagccctaaatgaacgtagctcaactggctatgtttcttatagtataacttgttcatttgagtttaagttttggacttaacgacagaagacatgtgctcacctttactgctaattatttttttcaatagtttaaaggtcggtttcttttcttcttttttgaataaacttttgcagagcaggttgccggttgtataagtcaaattaactcccagaaattattcgtagttggatgcgttccctggaaagcagagccaagttgttgatatttggtcaataaacactgcaaaatcatgtgtgtttaatttcccataacacactttccctatttttggcctattttatgcccacctagcccctaatcattttaattaatcacaaaaaatatgtttcgttaatgcattttttataacaaggcggctagtatatactacctccgttttttaatagatgacgccgttgactatttctcacatgtttgaccattcgtctgattcaaaaaatttacgtaattataatttattttgttatgagttgttttatcactcatagtactttaagtgtgatttatatcttacacatttgcacaaaatttttgaataagacgaatagtcaaacatgtgagaaaaagttaacagcgtcatctatttaaaaaatggaggtagtagtattaattttgagatctattgctgctacatcctactcctatagggcaagtgagttaagggactctaaagggactgaaaggctgaaattacgataatgaggtctaacaaaagagatgcccaatacttgaaagcctctttcttgtccagttttaattctttatattttatactgagctacttgcttaattaaactaatgccgtgggagacaactcgaggtaagttggttctaatctttttgtgttctttgtgtttactttattggccccaagataatattatatctgggatcatgtttctaggtttaaatttcttaagcctattaaaaaaaacatgggacatggacaagcaaccaggccaatgccgccatccactcgagagattgnnnnnnnnnnnnnnnnnnnnnnnnnnnnnnnnnnnnnnnnnnnnnnnnnnnnnnnnnnnnnnnn

SEQ ID NO: 14735 - DNA, 4414 bp, Oryza sativa
  unsure (1)..(4414): unsure at all n locations
tttgtcatacaagcctcacatgatacttccagatttttgatctcctgaaatttgcaaatacaaataataacaacagtaatttaataaaagatatcaaacagcataatatttcattgcacgaatccctgggaacacactgaaaaaaaaatgtggttctagccctactacatgggggctcctattttgcagatctgaagtgggtaggttcaaacttttacagcagcagtagtggtagtactatcatattctcttggcatgcactgtacacaagccttgtgcttccatacatttgtatagatgcagcatcaagttactgtagcatatcacacaaggggtgaaaaggacaattgcaccttgggctagcagcagtagagacagtgtaggaaaatagcattgtccgcaggataggcctgggccgtgcatttatcagttactcctaccacattttgcaacttcctttgctcattcaggtgatactcgatctcctacttgtagcattgcatggttgtacatgtggttaatttgaatttaaaccaatctaaagttagaaatccctgaaaaaaataatactctatccaaaatataattatttctggtgcatagtcataaatgtttatattttagaacggatggaattatatatagttataagttttcagcggaatatttgtggacatacttgtgcacttactaaagtgaagtactgaagatgatgtgtctgattcaattcatcatgccataatcacatttccttgctggaggagtatccatcaagcgttcagtagtaaaacctatgtttattattattttttacctaattgttaattttcaagataagatgaggatctttcctctaagaaagagtggaaaattcagagaaaaacacacctcgttgcaacctgcaagtaaactgacctacaaggactgaaagttcagttattagcctaatgtagaggttagcgttgggatgttccaatttacgagctgttgttattcctagaagcctaaaaagccactaatattgattttaaaacagacttgacttaggagtgcattagctaaaactgcaagtaagcgcaattctttctgtcaacttggaagagttaaaagcacgcttcaaatcatcagcacaacacttccgagttcatctggaactcttgcagtcatcatgcccatccttttcctcactttctttttaatgtgacaattaaattaatatcggcgacctgtatctgtcaaaccgaaattctacgggcaaagaacaccaattattttcctccactgaagttacgtcagaaaatggagtctttggtagcaaaagcagtacaaggcgatgcaaacttcacggaggaaaaggcacagtgcagctgataaagatgcaaccctttttttcgcctaaccatctgtcatgtgttgtgcatggacaggaacagagatctcatctcatctcatcaggtagccatcaccaaacaaaggacaaataatacctcgacagggaggaaatcattgccagtgcagggacaaaatcaactgagcaggatagtagataggagggcatcaggggcatgaatagctttgattccctgtgtaattgatactaccttggttttactatgtacaaatgggccccagaaattgtagctggggaggcattacattggagagctagtcatgcatttcctttttgtgcctttcaattaagtacagcaataagtagcgctccacaataatgcaggggccctaattctcctgtaatggcttgatgggacaggttatgtacaatgttttttttttctttttggaaagcgcaggactgtacaatgtgacaactatatcaatgtaaattcttgaagaataccggttttccagctcgttgtaacttctaaattaaccatatttggaattgccaagtcaattgtatcctcctcaggtgtgggaagaaattgatggcatgaatgtgaaatttgtatattagaaagaatgatctggctgaattaatttgataagccagtagtttcagaaacagtttgtatcgtcgctgacaacttcttccggatctctagctcttgttgtctcttgagataactttgtgctgtagaagtaattatctgaacgatgaagttcatgatcaaaagccacaccacggtattccagatcaaagagaatgatagattccacttcgtttcctacacatacataattaagatatttaggaaaaataacaaagaacaagaaagcaaatgatagcaggttaagaaaaaaaacagcagtaaatcagaagagagagatgctatcatgatcatttttgtaattatattactctgtaatttatgttaaaataattgtcaaccataaggataaattttacaaagtgtgatcttaagagtatgtaattttgttacaaaagttatggaagaatataaattattgttgctagaccatcagctgctttgtcattcagaagttggaagttagaacacatcctttcatgaaaaacagtgacatacattacaatgaaatcaacagaatcaataaattttgaaaacaacacataaccacataatgatgatcaaactaaaagttttgaaacaagtacgcctgatgtttgagatttgaagtgttcaaaacttccccaaaattaaaagaaatctgtaccttcacaacacttgatgctgatgcagcaacactggatgataaaaacttgctcttggctgtcttcaacttggcaactaaagagggaaggacggatgataccataggaacattgccaaatacccacataattcttttctccaccaaatcaagaagttggttattgcagagagtaattactaatgttgtctacagaagttatttgtgaagtatggttagataacttaacaaagatgttacaatgcatggaagatactgaaaagaaaatgctctgcaagagaatttttaagtagcaaacctggatataaaccttaataacagcctttccaattaaagttgctagaaagaacttccagaatgggatgttaaattgcccacacaaaatgccagcaagatcgaagagggggtttggcacctaatggaaggaaaagttaagtttcttcacatgtcatatctaacaagagaagaataatatgcaaaacataactgctctacattgtgacgaagcaaatctatttcttttgggaaatctcgtttgtgtgtgaatataatgagttcctcaagcatttcgagtggagttcacctaacaagttaaagtgtttaggagctacaacctacaaggcaactggaagtttggtaaataacaaattatgactgaaaacaaataaatgtacacaagaaaggaactaaccgaagcaagtaataagatggtagggaagttaagatactgtgagtgagacataagccatcttttagcccgatgcagagttgaggatagaaaaccttctcctgaaacggaagcatccaactcttccagctcatctagtttgcgtcctgacatgctagctggggttcatttatagtgagtcagttgcatcaagaatttcttctgacccaagattaaaaaataaactaggaaaaagtagtgaaaatactgcatcttagcattactgtattagaacttcaagatggaaccttatggtgcagaacttagcagaatattaagaaccatatatcactaatgtatcctacacggcatagtatttataatcagcattgcatcaaggtttttgcaggagtcacttctgcactggctggctagaaacaaagcctgaaaatgactcttggttctggctgagaagtgcaacacaaaaacttcccgctgtcttgataaaaacttcaattttatttaactctgtcagggagtcagagtttttgtattcctctcccctttcctttcctcggattgtaaataactaaagcttcatgtttattaatatgcagtagtcaacattccagaagtttcttgctcacaaaacaatatacataaattgctctgctgcataattcgacacatatcaatcttatcacatgttcatgtacgtttggaaaggttgaaagattataccaaattttaggttattcaaaactgtcatgttctctagtgattaatattgaagataaaaagggacatagtgtgaggctgtgagcatgtgaaaagcatataatcaagtggtgctatagcagcaaagcagtaagacgcaacctgctctcgagaggaaatatggaggaagttctccaagtgcagttccaatgccccagagaacagcttcaaggtgaacttcatgcagtattttgctaaatggaattgtttcctggtacattggcggtccaaattctagacagtctttctccaaccatgaaggtnnnnnnnnnnnnnnnnnnnnnnnnnnnnnnnnnnnnnnnnnnnnnnnnnnnnnnn

SEQ ID NO: 14736 - DNA, 5480 bp, Oryza sativa
catttgcctaatatggagctacgtgcaattaagcatctgccattctattagtatagacttgttgatacaaatgcactcataatgttttttctaaagagaagatgataccttttcatgtggaccgttagttaacaagagcggagtacaggcagaagcaaccaaaagaaccaagaacttcaaccgagcactatctttcagaacacataaacatgtgctttttatactctgtccaatggctaatgcaaataacgccaatgttctgagtggctgcgatgttagcgttaatctctccaggtcaaattgatgcttttcacgaaggtctgaaacatagagtaaaccagttacagaagaaatatacagtaatttgatatcaataatacgacaaacagacaaggcattcattggtatggagtatggagaatccaaagcatgagcccaatttgttgccttcttatgatgacactttgacctgtcggacttatccatgtttcggtggtgtacggaaaaaatgcagccacagcgcgcattggaaaccccaggtttagaaactacgcatcgtgggcactacggagtagaaattttgttgtgtacaatgccttgaaaattgaatttacatttgtaaatgctgaacagtaatacccaatcactccataggttggttattcccacaaaaacacacactaaagctcgattagaaaatagcatgaagctcgattagaaaatagcatgaaaaagtactagttttatttcaaattccataatctaaatgaacgaaatattgactaaaagcctcaattcgagcattactagtaaatctagtcaacaactccaacacctaattaaaaaaaatttagcaatgtctaacaaccatggagagagggatcctcttaagtccaacaaagtagatgaaatataccaaaatcaagcatgtaatataaccagcaaaggaggacagttcaatccttccttagtatcagcaggaaaggaaagcaggccacagatcattgaatcgtccctatgaatagagaaaaggaaacaaattccaaattttcgggaaaacctcaatgacacgcattcgcaggtccatgaaacatctaacgaaaatctttttattaattccacatattaaaccatggaatcttgaaaataacagcaacaaatccctgaacctctacgtggcttcaaaaaccaaaatttcagacagaccaaaaaaaaaaagccaagacaagccagcagcaggaggctcaccggacaaagcctggtcctcgccggcagcggcgtcgtcagcggcggcgggtcccatctcgcagccctcggggtcgacccccaccctgccgcctactagatcagatctccgatctctccgagtacgccgctatatacaccaattggaaaaatgatgagaacgagaagaaggcgcgagcagaaacgcgcgcccccacgcttctccggaggaggaggaaggaggaagatcacgaggatgacgagctcgacgaatcgcgaggcgcgcaaaggaatcgctcttttttttttctccgagcggaaagattggggtgctttttgggcgagcggaacggcagcgcaagggtgaagaaagaggaaaacaaaagaaaaaagaaaaggtttttatgaaagcctcttcttttcggttacgtacatactcaggattgattttcagttaattcacccgcgcctgatgcaaacgtgtcgccgtaactaagtacaacaggtatagcactctacaaggcgtgttcttaagctaattaaactactccatgctatttctttttcatactatattaataagatgcgtgttcatagcggggacaatcgatcattatcaggattttgccggtggtcggaatttagaaacagaattggattgcttctggttctattaatgtaaatttattttatgtacaattattaaaaaaagatatgtgcataaattaaactgatcaaactatggttcttgctggcacaattccagattaataaaaaaaaaactattttagttgggtacttctagttctacaaatccataagttcagatatgtattatgttgataatatttaaataaattattttattgttattttaaataaaatataaaatttgctttaaatccaacgtgaatttaagatctagagttgtgctaaacaaaatgtatcgccataacgcagacccatcgcaactaataaatggtacattttcttcttcttcttcttttttagaatggaagtggtgactcattttagtcttcttttcttttacattcatcacacaaaagatatatattgttctttgacagatgacgtcatttaaccttttaacatgtgtatcattcaaaaattcgtgcatatatatataaaagtaagtgatgtttatagtaactttatcgataaaccaagtcgcaacaaaataaataataattatgtgatttttcaaataagaacaatgatcaccagaatcaatgccgtcatctattaaaatcagaggtagtttatctgagataggtaaatagaagaataaattaatttctttgttagaaaactcaattagttttttttttttttgcgtttttctgccattgttggggcaccttcttctcaaattggccttccattatgtacccaactcgatcttattctgttcgacgacaccatcgagccgtagcgacaggtcgacgtagcatcaacaaaccttatcgatcaccttacgtggtcatcgggggtcgaaacttttgtttctctattgggagaaagccaccgagggacatttcgtgcacgacaccgcgcgacgatgatcacattggagaagctaaactcacctgtcatgtttcttcgccgccccgggttgccaaaacttgcaaagtaatctaagacctttgtctccaggaataaacacaacatgtgtcttttctgcttcagatatcacagcaaacctgtgatgaaatcaaagaaaccgtctttccagcaagaaaagaacaagaagtaatgtccatatatgtccatcagtgcagaacagcactaaggcagttcaggctgtgtttagtaatttagttccacgccaaaattggaagtttgaagaaatcggaacgatgtgacgaaaaagtttgaaagtttgtgtttgtaggaaagttcgatgtgacagaaaaattgaaagtttgaagaaaaaagttggaatctaaacagggcctcagtatcagtagcctcaatgtctgttcaagagcactcgggctggtctgatgttaaaggtggcgcctcagcatcactgcatctgtagttctgtaccaaacaatgatggatctaactattgtacagatctatggggcatttgcataacccaccagtttgtcacttttttctccctctgaatatgtttacttgggtcaatttccattcgttgaaatgccttgcaagacgaaaaattcaaggttactccgttcattccgtttcaagagagagttcaaggctagaagagtaaaattagtacgcagataagaaaggctgcgaagaatatacttgagcagacataagagtgctctcataagtcagaactaccagaaataaaacggcgagctcttcaaaacatgatatctgccatttaacccgcctccctttcagttcttaagaatagaagccatgttttcttggacgctttcttttgcatttttgtcaaatggatcgtctccaatgtaaagatctaaaatagacttgcacaaaagcttgctctgtatgctccccaattcttctccttcaactacacaaaaacacagaagatagcttattaatgaagaatgttaggtacttaggtgtgtctgtttaatttttactgggaactcatatgaaaaggaaataaacaggaataaaacatgacagggatttattatggcattgaaatgctacctcacagatgctacatgattgcactgtttctttcttctttcttatctttttggtgtgataggacgaaaacaggataaaaagttattcctttaattatgaaaggtcatggattttctatagtattatctgtgctgacttattcgcttcatgcactcaacactacgaccaaatgcatgaatagaatgagaaaatggccccaggtcactgtatcagatgcatgtccattcattgtaacaatatttctttttgactctcaaaatccttcgttccatcaaagtaaatactatctacaatgtctcaaatcaactagaaagctgtctaaaaaagaactactacaaagaaagggaagaaaaagtgaaaattgaacttactacttattttaagcacatggctcgactcccttgagagctcaatcacggacccctttggtaatttgtattcatccttgaaaagtgaaacgaaactgtggaaatcaaggtgtcaaagagagaagaaacttgtatagtaatcatttagcatgatgaactaagattggaacatacccgtcaacacaataaatagagcaacattatttaattaaactgacactgacagacttgaaactataatatgagtaactcaacagctcaacagcctcctgtccagattcgtagtactaagtaatgtcacatcccgtactaggtagctacattttaggacgaaggaagtagtacaaaataattgctatcaactaactattgttgcatgtgagaattaaagctctctagatccaggaatcctttctttcttgtttatctgatgaaaagcacaacagcattacatcaagaatcattcaatgtgcattctgacttctttctagctccaagatgaaactacatacattttgcacaatgaacttggagttctcttaacaactagccgaattgtaatttggtaccaccctttcaaaaggactgcagaaaggctcatgcattcggccgccaaacctcacttaaactgacactaaattgaacctaaggtaactggtaagaaatatagcaagtcaaatgtggaacaaaggaagcattgttgtgagcttgtctgcaacaatgaatcagtggcaaggaagctttcattgtttgtctgatggaaagataaacagcagaaaccactgccagaatcacaattacctctgaagcaactcatgagtgtctgatcccccaaacttcagcagcctgcttcccacgctcttctcgaacgcgcttcgcacggatcgaatgctcaacctcccatacacaatctggagcctgaccgtcatccgtatgtcacgctccaacgcatcgttgatcagctcggcgttctccttcagttgagagacagggagcttctggtacttctccctcagctgtctcagatcgtggtcatccgcatacacacctgcaacacaacacatcagcattttccagatttcgtccggtttcgagttcttctttcgaatggagggatcgaagatgaggtgttctttagtggatggttaccaaacgcgtagacgtcgatggacttgaggggatcctctagagtcgacctgcagg

SEQ ID NO: 14737 - DNA, 1658 bp, Oryza sativa
ctagtgttttttcagtagttcctctgaattctctctttgtacagcttaaaaaaatagtaggggtaaatcttttgaacgatgctttcaaaagatttttcttttaaaactaaaggtttatgttatccaagacgtagcagaatataaggaatggttaaatattaaaccaacgtggcaagataaattttgatatgtatccaatctaaactgcttgaaagattctaaaagaaattgcataaaatatctaaaaaaaaaaggccaaaatgtctttcttttatgatgattttctcgggttttccacttaatattgatattagggggcctcattatccattaacaagataaagaaacaaaccttagtttttatttgcctacatgatccatagagagagtaactagaagcattaattcatgctcgtagcagtcatcacggttgttgtcctcccatctcgtcatggcaccggagacgaagccatcagcaggcacaccttggggttgcatcgtaggcaagtattgcagtccacaaacctccaccgaggtttatggggtcctatcaagcagtagcagcattgtggcgacgggttgctcctgttcggtggacaacctgcttccacgcacaagatcgagaaattttcatccgacgtcatgtgctgcgggtgccagagtcggtgaccacggcggcggctacatcagaaaactacactgttggtgtggccattttgcagagttgtttcctgtgctgaactgatgagaatgacttgctgctatacttttagtgacataaataatccattcatgacgcattcattgatcactatgtaaccctaaatttttaacttagatctagagtgagaaaaatattctaaatttcaatcgaaagctgggttcccatacgacagtaatttagatggtaaaatgtgtgtgtttgtttacatagtgcaggcgttgcaagggatccaaagagcacagccaagaagatggtcatcatgtacacccgcatgctgctcctcgatcatgttggagcttcatttcttgttcgatctaacgagtgatctgttctgtcagactgtgactatgagggatagatgatgaaatcccgatctggacaagtactatgttatgtttgtcgaaagccaggaagttatcaggtattatgaatactattgtcattccattccttaccaaacgagagctatatgttgactaatttggacggcgtatatatatactccctccttccctaaatatttgacgtcgttgacttttttaaatatgtttgaccgttcgtcttatttaaaaacttttatcaaatgtgtaaaaactatatgtatgtataaaattatatttaacaataaatcaaatgatagaaaaagaattaataattacttaaatcttttgaataagacgaacggtcaaacatttttaaaaaagtcagtggtgtcaaacattttgggatggagggagtatatatgtagtcccttaatcaattataatgttgatctgggtagggggccaatggagtcctggttgatctgcttatttcttcccgtgtgcattttgcaaaccttaatgtacccacctgcaactgcttaatactagtaacatatctgcaaatgcagatgttgtagttgcttctttttccaagaacatgcatgggcaat

SEQ ID NO: 14738 - DNA, 1007 bp, Oryza sativa
  unsure (1)..(1007): unsure at all n locations
nnnnnnnnnnnnnnnnnnnnnnnnnnnnnnnnnnnnnnnnnnnnnnnnnnnnnnnaaaagagtgatgcttcaacgcacaagcttggatcacaaatagaatatttgtaatctgtgtaatgtgtaaaccaaattttcctgctcttattttcatttttgtactcttgcaagaatctgagaatattgcctgctaatcaaattactgaagaaagcaatatactgtctgcttctctcctagaagagttcactggctaaggttccatgtgtaagtttggttgaataaaaccattctaatgtctttgctgtgcaacaaaggtgtatgctggcaaacttattagattcatcaggttggttaagaaccgagtagtcgaaaaaaaaacttgctgtatttatcacatgaaagagaagaattcaggaagcacgtgcttgagatgtgcaacaagattatctggacagctacaacttggatttttcctgaacctgcctagtagctcactgctgcctggtactcgtgcccattaatttcgtttgccttgttttgcaggtgtagttcagcagctatccctgcctcgcttctgctggattctgggtaagtgagcccactgcatcagcaacaaatgatattttgcttatcatatgaagggatttttggcgcgaatggattgttttgcctaattcttacgtttttagcagctgtgctgaatgcttgtttgtgggtgatgttaggctccatgcttttgatcctctttatctcttccctgacaacaaaaaggaatgttaatacttccatcacctctcaagtctcacctgaatatcgaggggggacatttatataagaatattcagagccatgtatgctctaggtgatgctctgcaattggccctcagtctatctatgatcacagtatatactcattttgtttttctgggctattacttgaccaaacagttgtaggcagacggcgcccgctgtttcttccctggcgctgcagaaatgtttcaagaacatg

SEQ ID NO: 14739 - DNA, 648 bp, Oryza sativa
caaatccaattgcagcgtgagtttctttggagcaacctcatccgctggcatcctctgcaccatcttatcatcctccaaattgatctccagccctctccgtggcctctctgcgtctttcttttcggaatttcctctcgcagcctaaaatcaaaccaaaacacaaataaaatggtcaatcagtgtccaaaaatccaatgctctagcaggtgaactaaaaaaaattggtgaaactgaagttcacaccatgtccatctcagaatccaatcccttcttatccacatcagggtcggaagcaccatctctatcaggagacttcccaggaggaggagcctggaaccaaaaaaaattaaaaacaaaagaagtcagaaaaggagcaaaaaaagataagaaaaggggagaaaaaaccaagcaacaattgcggcaaaaattgtcgctttcaatcattgcccaacaaattccgcaagaccaattcaaccacacacacaaggaagcatatacccaccatgagatcaatgcaaaacttttcttgccgagctccatcagatgccagctcactgaaaaaaaaatatcgttcacacaaattgtgaatatactaatcacttaatcagatcggcacaatccaaaaacaataatggttatcgcaacacc

SEQ ID NO: 14740 - DNA, 1060 bp, Oryza sativa
  unsure (1)..(1060): unsure at all n locations
nnnnnnnnnnnnnnnnnnnnnnnnnnnnnnnnnnnnnnnnnnatgtatgtataaaattatatttaacaataaatcaaatgatagaaaaagaattaataattacttaaatcttttgaataagacgaacggtcaaacatttttaaaaaagtcagtggtgtcaaacattttgggatggagggagtatatatgtagtcccttaatcaattataatgttgatctgggtagggggccaatggagtcctggttgatctgcttatttcttcccgtgtgcattttgcaaaccttaatgtacccacctgcaactgcttaatactagtaacatatctgcaaatgcagatgttgtagttgcttctttttccaagaacatgcatgggcaatcgcattacaacgagagggagaatttactatttgccattctcccaaaatgtgcacccgatcccatatctcatttgtccgaatggaggatgaggctgacatgtgagttcagtggcaaatgtgcatgaaaatttgagagagcggtatttgtgcatatgcattttgggaggatgataaatagtaaattctcctacaagaagccgaaacaaccgattctacaatgcagtttcatttggaagttcatcttttggacaatttgtcctgtgaatactgtgccatactgccattgaatgtgtctacacttgtagaaaatgccattttgccatggtcattgacaaaactgttgagatcttgtagtttacagacttttttttttaaaaaaaactctgcatatgtggtctctttcctatcttaaagcagagagctctcttttttcacacggcagttttcttagttcagattcatgacgtttccctctaaatatcttcccaatttttcttacaggatgtgttgaacaaaggcctccatccaagcgtaggcaaggtgtacacttaggtggtgtttgaatcttctgaagatgaagatgaaaattaagtgtttcacgcaaaacgagatggtaataacgtgtgattaattgagttttaattattacaaacttgaaaaatggattaatctgatattttag

SEQ ID NO: 14741 - DNA, 2080 bp, Oryza sativa
actcatcattgtactgcagcatgtatgatagcctctaagttatgtcacatacacttttgtcagacggaagtacttaagacttacttttaggatgaaaaatggattattcacaggtaatggaaaaggtaaatctagtagcatgcaccagggtgggatagttggcagttggcactgacctcaggggtatacacgtatagaacagcaaagcctcccatgatgcaagtccgggcacagaatagaagagtagttactgaaccttgtcccaaatgtacagcaagtggtgcaaggaaagcacaggacaacaaaagcatgatccccagtgacactttccgaccaattctgtcaaccaatagagccgccaaaaccagacctggaaattctgtcaattcaaacatgtatttttagcagtcggaacattgaagtgattatgaaattaacctcagcgttgttataagctttttgactgtaagagcttggtgctatttccgatattagaaaaaatgggagagggttacctctctttctaaaaaaaactattataacctctttttttggagatttagtctaagcattttagttcagcaagttctttctctaatgtttatatatgctatgtttcacttctactactgatggttaagtgtatgaactaaatctttatacttttactaatctagtttcttaaaattcaaatcctaacactagatgagtaaggactaagcagcaattactaggataacaattttattgaacaacttgttaaaagaaaactttttttaattgcctgctaccatttagtttctccttcaggaaccttaaatactgatttagggtcagaaatttttcaacaaaaaataactttgatgatttctagttttttgcccaaatatggtgaatcaacagatgaaactctggaacggtagaagcccatcgaacctaaagagtgaaggaaaagatcgtgatggagcacaattgcacagtcgtacctgccaaactggtcactagcacatctctgtaaaggttggcatcctttggttgcataaaatttatcccaactgatgcacaccttctctgaccattgctcagttcagaggtcaacaatattaccccatagtaagcaaaataatttgcaagatagacaaaccaaagaagaaaggttgatcttattagatcatatgaccaagattctcgaagtgcagtaattccaccaggcttggaacttgtatgctcatcaattccagaaccaccatcttctgtaattagaagtgctgtctcagaatcatcgagcactttgtcgattctccttgtggaggcataagtcagtatgccaggagggagagagctattgttcattcttgctattttttccaagatgaccctagcgtccattgttcttcctactgagcatagataccttggtgattcaggtgttacggggaagaaaatgaacaggataaaacatggggccgaagacaatgcaagcagccacctccacccaagtactggcatgacagcctgcattaagcatatacataaaatgtgcagttagcgatttatgtaaattgattaatgtaaaggttgtgatttccctaaaaaaagtgtaaaaagcctttaagcatttgaatattacaacttggtctacatgttttcttaggttgtaatcatacagatatccgcccagtgagaattaaagagtgaagaaataagtagcaaaatacccaggcaagcagagcttccaagattgttcccacagtccaagagcaatggaaaacgaccatccaggtacctctctttgcagcaggaacaaactctatgaaccaagtggacagcacatggccagcacccaatcccaaaccaacaacaaagcggaggacgagcaaggatgcgtagttgggggagaaggcactgagcgaaccaaatataccagtgacaactgccgtggaaagaaaaccgatcctggaaatggagaacagcatatacatatcagatgtagtatagcttttgcataggcaagtacatttaagataaacttgattgcttgttgaatggagagaattcagtcaaaatggtatgttcattt

SEQ ID NO: 14742 - DNA, 3659 bp, Oryza sativa
  unsure (1)..(3659): unsure at all n locations
nnnnnnnnnnnnnnnnnnnnnnnnnnnnnnnnnnnnnnnnnnnnnnnnnnnnnnnnnagtgtaaaaagcctttaagcatttgaatattacaacttggtctacatgttttcttaggttgtaatcatacagatatccgcccagtgagaattaaagagtgaagaaataagtagcaaaatacccaggcaagcagagcttccaagattgttcccacagtccaagagcaatggaaaacgaccatccaggtacctctctttgcagcaggaacaaactctatgaaccaagtggacagcacatggccagcacccaatcccaaaccaacaacaaagcggaggacgagcaaggatgcgtagttgggggagaaggcactgagcaaaccaaatataccagtgacaactgccgtggaaagaaaaccgatcctggaaatggagaacagcatatacatatcagatgtagtatagcttttgcataggcaagtacatttaagataaacttgattgctgtttgaatggagagaattcagtcaaaatggtatgttcatttttgcaccgtgtttagttccaatttttttttttcaaacttccaacttttccatcatatcaaaactttcctacacacataaacttccaacttttccgtcacatcgttccaatttcaaccaaacttccaattttggcgtgaactaaacacaccccaagggcattacttccatataattctcaaactacctaaacaattttgcataacctcaccaagtgttcaatcatttttctttttttgaacgaaatcggcaagacgccaattttcattgaaatgaggaggaataaaccaagtgttcaatcatgaatacttggatccagcacactcagaaagaaaagaagagattgaattgcgcatgctgttggtcagcacaatttgcacgaaatagaaatctcttgacaaattttcctgatcactcacccgaaattgaaatatatgtacttggactgaagcgtggcaatcaggaaactgcagggaaagaagaaaataaaaggataccttctgccgtatctgtccgagatgaggcctccgaggcaggcgccgatgagcatcccggcgaagacgacgctgctgacgagcccctccgccgcgccggacaccccccattcagccttcacggacgggcccacgaacgacagcagcatcaccttcatggcctccgcgacccaccccacgcaggcgtaggcgagcaccagggcctggaacctgccgaagccggcgcgcgtgagcgcgtcgtccgtcgtgtaggtctcctcctcctcctcctcctcctcctcggcgtctccgcccgccatggccgcgcacgctacactcagggggaaggtggatggctggatggtgttgaactgttgactgccaagatcagaggagctcatgtgattttttttttctgcttccctgcactgcacgtgtttgtgattaatactctctcactccaaacggagccatcatttcgctgaataagcaaaacagtttatttgtaaatgaaaagtaatctgtaaataaaatttttatatacgtgttcttagctatctaaaagcaaaggctgaaaaataaacttcgatgaaaaaaacctcaaaatcatctccaaatttaaggttaaaagttcaaaatttggctgataagtataagcataaacgaaaagataagatctaaaatatagcagtgctgctactacctccaatttagtataggatacgatattttctaaaactacgaatatcatgtcctatactagatagtactttcttcataccaaaataagtgtagctctctagttcaaattacaattagatgttcgtacttttttggatgaaggaattaacattttgggacagatatattttaggatgaaagagaatagagacaaaccaaaaatgttatggccgataaagcatgaaaaaataaactaagcaactaaaaatggatgaaagtttttatatctgtcttcctagtgatctaaaagccaacccaaaagccagtactaagatgtaaattacgatcctcaaaatcaactataaataaaatgaagttacaaaattcaaattttgggtgagtttcaaattgcataaatctgaaaagtttagcccaaactatgaactgaacatgttaaaactggagaaattagtagagagtaatactaacaaagccaatatttttcaggcattcttccatgtgtgctgtgtgcatctgaagttctgaacttcagaagtgggtaagtggtaactagtaactagcccctttgtcgaagaatctacagtccagtccctgcccgaaatgtaggaatctttgcagttacaaggttctgaaactacccagccgaggaatccctggtcggcaatctgaattgctgagctatcatcttctgatcgatgatatatatgcagatgcaggagtaactgtatttccaaatctgcagactgcaagaagccctcgttttcacatgctctgcttcttcttgggttcttgttctggttctggttcgccttcatggtgttggcctgataagatttttccattactctctcagctgcactgagaaacaagggccctgtcccaagatgctgccatggctgcctgttcgagtcacttgcatcagaattcagaaactgggtcgagttccattgattgcgagatagctctgtctgccatgcacatgctccaactccaattgcaagataatgttcggatctttatccagtaatgatagttaagccggttcttgcaagtggccacttcctataaactgtgagcctggcagctctggatgttacgttgctcgtcgtcgtcgtcgttgtcggagtcgccatgtcgtcggcggcgcgccaccattgctccggtctccgggagcggctaggctgcgtgcagtgcagcttctgcgccaccgtgttgctggtaaggaagagcgaaaccgatcagtttacctatctggctggctccccatggccatgcataagctggatgctgtccatgcgtgcaggtgagcgtgccgtgcagcagcgtgctcagggtggtggccgtgcagtgcggccactgctccggcatcctctccgccgtcaacctgccgccgtcgccggtgtcggcgtccatcgagctgactccacaggtatgattcttttcagcttcagttgatgaaaatgattggatgatgtgcagaatctgtactaacctgacgagatgaaacaggagctggacgctggtccgccgccgggggagtactcggatgagagcagcggagacgatagggagggaagagatgcagaggacgatgcacctgcacctgctgctgctgctgttgcaaacaagcgtacttgtcctgctgttttctcttgatcagtttgtctgaagatgataatgacgatcatgatgggctaattaagcatgttcttgaaacatttctgcagcgccagggaggaagcagcggacgccgtctgcctacaactgtttcgtcaagtaatagcccagaaaaacaaaatgagtatatactgtgatcatagctagactgagggccaattgcagagcatcacctagagcatacatggctctgaatattcttatataannnnnnnnnnnnnnnnnnnnnnnnnnnnnnnnnnnnnnnnnnnnnnnnnnnnnnnnnnnnn

SEQ ID NO: 14743 - DNA, 3657 bp, Oryza sativa
gccatggtgcattgccaatggccagcttgatgtattggtccattgctgctaaataatcacgcttcatgcagcattcaacaataacgagcaatgcttgacggatgtcatcaggaagaacctaaacataaatcaaaacaataattggtatcagagttgccaaacaatatgtagtcaaggaagtcataggtagccttaaaatgcataaaaatatcccccatatgagcaatatgatttagctcaacaaggtatagtaagaaactggatccactgcaaggaaatccaaaattacattgaggctgaatccatgacagaaggcataattttgtagaaatttaatttcaatgccagtactaaatctggacagctaagtatctatataacagtgaattcaggatcagaatataatgctagtagagaacaaaggcaaatcccaataaacaacaaaagttttaaacatgcaagaaataattgttggagttagggcttcaaatctggatgttgccaaaaacatgagcccctgctcccaaaacatccaaagaatttcacttcatcatgtatttgagagcactaatgatgcatcggtattgtgtgcatgtgagttggtactcctcatgcataggttatcaaacttacaaataattccgtgagcgcaaaaagtagtcagcatacatgttatatgatgacattgttatcttgctctacctgcctaccactacatattcatcataagttcataaccatcactgtatctcatactatcctctaaataaccacaaaaccttactgaaacagagcaatcgaaatgataattgaaaaattatgcaaacacagatagaattttatttatatagttgatattgactcattccgttcaagtaaccaagtgtaaggccagtttctatattggaacggatagatcattttgcaaaatttataattccaatggtcattgtgtttctcgacactaaagcttcttgatatgctagtaagctgttctttaagaacccaaataccttgcatagaggtcaacacaattaccacaaaatataaaaactccgaacagtgaagcacaaacagttagacagtttctacaaaaaacatagatgccgagctttgccatctcttctttctgatatggtcataaaattgcattcatcatggtaaccagttacccaggtcccaggatcataacttcgacgtaagccattcagctacaagcttcatttcaaatcctaatccacaccattgttttattagttaaagttttttctaacaattactgaagttatagacacaaccaaattaacatttaacaatgcattgtttatgtaacttattgatgcagtacaaaaggattctcacctgcttcctgcaaaactcaaacagggggctgagataccgcgcacattgcttgaaggttgcgaccatcgacttgccctttgctgtcctcttctccagctccggcatctcatcaagctcctggttccactcaatgagtagcttcttgaagaacaccaagatcttgtcctcatcacacagctcctcaaacttggtcttcatccgtttcgagtccttgtccgcatcagcatcatccccactcctccggccgtccccatccccatcatcagcattatccccgccagcgccaccctcgccgccatcaccgccgcccgctcgtttgcccttgcccttgacataggtgtcccggccagccctctgccgcttgcggagctcgaccatgtcacggaggaagtcgttcgtctgcccctctgtcatgtcaaggtcgtcgatgtcgtcaatcacgccggacttgagcacgaacttgaggcgggcgagccggtcggcgtcgtcctccccgaacagcgtgacgggctcgcgcaggatgcggaggcgccgcaccacctcatgccgcgggaggtcgagctcgtcgatccggcgctcctcggagaggagcgcctcatcctgcgcggtcttcttccccgcgaggcccggcgggacggacgcggcggcggcggacgaggaggagttagggttagggtttgcggcggaggactgggccgggtcggcgttggggttgctggggtcggagcccgcggcggaagcggaggaggtcgccggcggggccttggagaggagctggcggtgctcctcgtggcgccgcttctggagctgcttctgctccagctccgaccgccgcacgaagctcttcccgccgaagtcggccgtcgccgccttccgcttcttctccagctccctcttcagaagatccatcgctccggcgacgcgacgggccaaccccgaactctctctctcctccgcgttctcgccgccgcttcccggagagaggcggcgccggcgaggctaagcggctcacttttttttttacacgaaccgattcgctatttgggacgccgccgatagggaaaggggaaacgtgaagtcgcgaatccgcaaccgtaaaatttgaccaaatattttggattggtacagtaactgtgatttacccctcctatccggactgagatgctctctgcagtcaaatgcacgatatttttatcacttacatgtgaatctagggattatcaaacccacatatcagtgataaagttaagtgacttcggctacagaggatcctggtccctcttgtccacgtttgtgttagagctatagccacgttttagtgttagagatatagccaattattagttatctataaacatataaccactattaatagatggtctcacctgtcataatatacatcgtgtcttggagtccgtgttacacctagctataaatagcttgttgttcatctctcttttcttttatcttctcgacatatgtttatagctggtttatactttgctatgctacctgctcttaaccaaatacgagtaaattctcgagaagtgaacaattttcttccttgtagtgaaacctattcacttgcatttaaattctaaacttcacacagatatttctatttatgtttaattattttgacaatgtttctgtcgaggcatccgaggtcaccataagttatacttcctccgtctcataatataagggattctgagtttttacttatactatttgaccattcgtcttattaaaaaaatagaattatttttttttgacttactttattatccaaagtactttaagcataattttttattttttatatttgcaaaaaaaattaaataagacgagtggttaaatattacaagtaaaaactcaaaatcccttatattatgagttggagggagcagggtttttttagatgtttacagggaaagagtgtacgctgaggtctactctctcctagattcgtcgtattacaagggctggagaggtcacatcctctcttagtagtatgtattttattttattttattgacagtgggagtagttttggatgcactgtttttactgtgtttaaaaaagtaaatcctgcgtcaaagaaaataaatcctcaaatttcaattttaatggaaggtacttttgatcaaatctcgggtccgtgtcgaagagaggagaacacgcgtctcacacttttccccaccttttcaccgtcggcgagggcgcgccgccgctgatgtcgcagcagcagcaggcgccggcgccgccgtaccggccgtaccggcaggtgagggc

SEQ ID NO: 14744 - DNA, 2399 bp, Oryza sativa
atcctgcgtcaaagaaaataaatcctcaaatttcaattttaatggaaggtacttttgatcaaatctcgggtccgtgtcgaagagaggagaacacgcgtctcacacttttccccaccttttcaccgtcggcgagggcgcgccgccgctgatgtcgcagcagcagcaggcgccggcgccgccgtaccggccgtaccggcaggtgagggcggcgaccccgcacagccgcgccgtctcgtgcgtgaggttctccccatgcgggcgcctcctcgcgacggcgtccctcgacggcacggtcgcgctgctctccccgtcgtcgctcgccgccatcgccaccctgcgggggcacgccgacggcgtgtccgacatctcctggtccacggactcgttctacctctgctccgcctccgacgaccgcaccctccgcatctgggacgtccgccccgtcctcgccggcctcaaccccggcagcggcggcggcggcggcggcgcccagcccgccgaccccaacgccgaccgctgcatccgcgtgctcaagggccacaccaacttcgtctttagcgccaacttcaacccgcagacgaacagcacggtcgcgtccggggggttcgactgcaccgtgcgcatctgggacgtcaagagcggccgctgcgtccgcgccatcgacgcgcactccgagcccgtcacctccgtccacttcatccgcgacggctccatcatcgtgtcggggagccatgatgggacctgcaagatttgggatgcggggactgggtcttgcctcaagacggtcatcgacgagaagaagcccgcggtgtcattctccatgttctcgcccaatggcaagtttatcctcgtcgccgcgctcgacgacacactggtatgatcaatttttactgctattccatgcatttagtgatcaatcagttaaagcagtgaaatttttttgttcagctatcatcgtcttattttaactgaactgcgattgaagctcataaataggccctttggtgctctgagaaaatgttgttatagttgttgaggattggaaacccctgtctgttcatgtataatgtggaaaccacaatttggaggcaacatttttcttccaaattgtagccaaatattatctgtgtacatggagtacaacattgcagattctatctggcttcgggcctaattctctgcttttgttgaagtacacctgacaatgagtaaaaaatccttcttggttctcattaaaatgaaatagcagtggtacactccacattgaatagaagcctatcgtagctttatttctggtattcgccgtggtctttttcataggcagattgttcttccaactgctaattatttaatctagtattactggcggccatatagcacatcttgtttcagtttcacacagaaaagaaattatagttaccaatacaatcaaagatccttcactctgaggatcatttcgttaaagccgttgcccaagatttaaggtaaccaatatgttacatgttgaactaagtatgtctatacttacccagtttcacaccaaacctcatgttcttgatctgtgtggtcttagtactgtgaaaagtttatcttcagatagttatgttgttaaatggttttaaaaaactgcttctgaagtttatttgggcacatcagttcacacgataacagatcactgtttcatgcataattcaagtaattggaggcatatgaaagaaatatgaaacttgcagtgcaaatgttgttatcagtgctttatattagtattagactattaggttgatccatggtattcattgtgcatacatacaccttcactccttcagcccttgtactgtttacatctgtaaaactttatgggcatttaggtcaataatgcttcacatcaagcaacattgtaagaaattttggcattgtgttattctatcatgggcttcctcatgtagtgattttacttcatttttcacggaatgtttttataaattagttatttatttcatttggaaaatatatggttattgcaacctttgcttcataagtatgtccttaccaaatttcagaaactatgcaactttgcaagtggcaagttcttgaagatgtacagtggacatgttaacagaaagtattgcctccagtccgcgttttccgttacaaatgggaagtatattgttagtggatcagaagacaactgtgtgtacatatgggatctccaagggaagaacattcttcagaaacttgaaggccatactgacactgtcatctcggtgtcctgccatccaacggagaacaaaattgcgtcgggcggcctcgacaatgataggactgtgagactatggcttcaagatggctgatgaatttgcagaaggaatgtgcctgatacaactcttgtgtgaacctgg

SEQ ID NO: 14745 - DNA, 3317 bp, Oryza sativa
  unsure (1)..(3317): unsure at all n locations
cagaaggaatgtgcctgatacaactcttgtgtgaacctggacagcaatagctatctaaaagagaaatatgcttctacttttatggagcactcttgtatgtatctatccctggagggataagaaaagagctgttaatttcacccggcactgctttgtttcaatgtaaacaatccttttgacctctggatatcggtagttcatctaatctcatgatgttgaagtatccatatctacgtagtactacttaaaatgttagcagtgatcgtattcgttctacgatatcaccctatctcaatatttggatcccacaatttatactactacatatttacatcatcctccaacaagttcttttccgtttcagtgttggttatcacctaaatttcaaaatcacctacttgttcaatataaaaataataattacatgtgattgacttaatatgttagaaactcaattagctttccgctgcaacatatgggctctcggctagtgtagcagtagtgtttatttgatgccagaccgccagtgtttatttgtggttgaggtataggattcaaccaaggacaagagccgagggaggcaaaatagacttatccttctttctataaagtgaagaccaaaagctcaaacctcgtgcttccactcatcatcaaattgtgaaccgtttgatgaatgcattagatcgtttctcagacgttggatggaatgcagcatagagcccaactcattagttaccgagtgagtctcttcgcctcctcagtgccaaatatagcccacatgaacacattggcccatctccatacacatctacatgtatttagcctgtcaatccgtataaaagagctttatggctaaacgccccttcagttaacatgtgctacctaaattatctacaaattttagatagggctgctaaaaagaatttctccaagaaatctatttgttttttcttgagattgtacctcctatctaacaaatcgatgttaaccaaatccagcagcaacacgcggggcatcctctagttactagaacaattttgctatatatttgttgataaattttctcccaaaaatttgatagatgtaattacagtacaatcgtagtgtaattacactgtaactataatgtaactttcaaaaatttctccgtaacatattatttcggtaaaatggaggtcatggaaataaattctttgacatatgtgtgtgttgtgtttttttcttcctcaccagaacaaatcttgtaatagatctcacgattcagaattacgtgaaacttacatactccctccatactcacaaaggaagtcgtttaggacatcgacacggtctccaaaatacaactttgacttcttgtttctataaaaatattcattgaaaagtgatatatgtatacttttatgaaagtatttttcaagacaaatctattcatataatttttacattttcaaactcaacaactttagagttattcatgatttatattctcaagatttgacttaaacattgtcctaaacgacttcttttacgagtatggagagaatacaagttacactgtagttatatgcaagttacaatataattacattacgattgtactataattacatctgtcaaatttttaggacaaaatttatcgataaatatataggtggtacagtaccgttacggcccaactaattacatgggcttcactaactacagtagattattatttaattcaatttagtccagtataagttgtcactgtcgctgctaatccgatcgcccgaatgccactccgcgcgatgcttcctctccctctcctcctcgccgcgctcgccgtcgccgctgccgccgcgggcgcaccccgcccccacccgctcgaccccctttccgccgccgagcttaccgccgtccgcgccgcggtgctcgcctccccgctcgtcccggcccgcccgctcaccttccactacgtcggcctcgacgagcccgacaaacccgatgtgctctcctacgcctacggcggtggcggcggcgcctcgcgccacgccctcccgcgccgggcgttcgtcatcgcccgcgccggcggcgagtcccacgagctccgcgtcgacgtcgccaacgcctcctccccgtccgtcctctcgcacgccgtccaccgcggcgccggcttcccgacgctgacgctggaggagcagttcgcggcggtggcgctgccgccgaagcacccgccgttcgtggagtcggtgcggcggcgcggggtggacatggacgacgtgctctgcgcggtgttccccgtcggttggttcggcggcgacggcgagccccgccgcagcagggtggcgaaggtgctctgcttcgtcgccggcgcgacggccaacttctacgcgcggccgctggagggcgtgacgctggtggtggacctcgaccggatggccatcgtcgggtacagggacagggtggcgtacccggtgcccaaggcggaggggacggactaccgcgccggcaaggccgggccgccgtacgccgggccggcgccggcgcccggcgtggtggtgcagccggagggcaggggcttccacatcgacggccacgtcgtcaggtaatcgctttgaccattactagcagcttgttcaagcttgtacttgtgccgtgtgatgcatccacgtatcgttgtgatattttcaatttgaactattagaagctcgtgcaccacgcgtgagaaatcccaaggatagtcgccgtcaggggacggcgatggcctctattatttttcctctttttgaacttgacgacaagccatataagagtcgatccgttcatgataattccatatgatgattgatagcgagagcattgttatggagatggattttcaatcactccaggaaatatctccttattttttatatcatttaaatagtcactaaaaatttgaataactttgacaacatgagatatatcattccacaaacatacaaaatcaaattcaacttctacaagttgtaacaaaataacaaagtaaaatgaaaatgattaatgtatatttgcagctatatttgttacagcttgtagaagtcgagaatttgaaattacatgtttatgtagtgatatatttcatattaatctatcttatatttttttcaacttttttatggttgtttagatgatatgtaagaaacgaggaatattcatttgagggatgaaaatacttttccattgacatgtacaatgcattaggatagatattgatatgtacagcgcaccagcatannnnnnnnnnnnnnnnnnnnnnnnnnnnnnnnnnnnnnnnnnnnnnnnnnnnnnnnnnnnnn

SEQ ID NO: 14746 - DNA, 4553 bp, Oryza sativa
tttgattgatgactcatgagagaaagagagggtttacctttccaatggactgacggatcccaacttctagctgtacagtgattttcgtcattctttaatcaattttggttgaatttaatatttaaaatttgaatttcttgaaaaccacttgaaatttcatcgagaactgctttcgtcccacgtcaagacattggcttgacaattttgtgttgttttcaaccggtttcggtgggaaaacgtgaccaaaacattggtaagcgattttatttggcttgacaaaattttggtaaaatatggttgtttggtttgtttaaagggagtacatatacatctttcgaaagatttttatgattatattacatatatttttaatctttgaattaaaattcaatggacacagtaaaaagcaaaaaagcaattaagaaacaccataatagacactaaatgaccatatcttcaagaaaaagaccaaatccaatataaattttaaaacttacatgcgaagatttaaaaattacactgtaacttacaagaaaatacattgtaaatttgagtgagaaaatcgaatgagagataaaaaaaaatctttcgagtgaaatatagcaaaatcgttgtttaaactacaaaatctctatttacattcctgccacctgtttgagcctctcatgcaaattaaagctgactagagtacttagtttggtacttggatttaggatagtattaagtagagtgagaggttttctgagagtcagattgcgatgtgaattgtgaagaatacttattcctgcttttcggtggaagcagtttcttcagtctttgctcctaatttgtaagattttttctttttcttttcctgctactcatcaagttaccaatgattgaattggaaaaactttagattctaaaaagcagtttatgtgaatcagaatctgaaattttagtttctgattgttttttagtatttcactttattttgtagctacaactttatcatagtttgagaaaaagctagacagtttcgtagctctccaaacaggccctaagcccctctctctaatgatcaactcatctactgctagttttgttaaacccatacgagaattgaacctttttcacgcagaggactgaagaacaggtccatatttcaccaattcattcatcagctgacaatctgacgcgcacatgcatcatgcacggatgctgcatatggctgtgctgcggcaactgcaggtgggccaactgggagttccacgtgggcttcgacatgcgggccggcacggtcatctcgctggcctccgtccacgacgccgacgccgacgccggcggcgcgcggcggcggcggcaggtgctctaccgcggcttcgtgtcggagatcttcgtcccgtacatggacccggtcgaggagtggtactaccgcacgttcctcgacgccggcgagtacggcctcggcctctgggccttcccgctccagcccggcggcgactgccccgccaacgccgcctacctcgacggccactactccggccaggacggccgccccgtcgaggccaggaacatgatctgcgtcttcgagcgctactccggcgacgtcgcgtggcgccacaccgaggccggcttccccaaccagctggtgatatttgatcatgaacagaaagcccttcgtcttcgtggccgtcgtcgtgtctcaaactctcaatctttggctgattcggtgtgtgattcttgatgcagatcacggaggtgcgccccgacgtgagcttggtggcgaggatggtggtgtccgccggcaactacgactacatcttggactgggagttcaagacgagcggctccatcaagctcgtggtaatcgacgcagaatcgaatcaacgagagcttaattagcttgtgtagattcattgcgtcatgtcgtggcaggtgtctctcaccggtctcctcgaagtgaaggcgacggcgtacgcgcacgccgacgaggtggcgcaggacgcgcacggcacgctggtggcggagaacaccatcgccgtgtaccacgaccactacgtgacctaccacctcgacctcgacgtcgacggcaccaacaactccttcgtcaagaacatcgtcaccgccgtcgtgcgcgacgccgacgccgacgcggcggcagacacgccgaggcggagctactggacggtgcggcgggaggtggcggagagggaggcggacgggcaggtggacctcggcggcggcgccccggccgacctggtgttcgtcaacccggggaagaagacgaggatggggaacgaggtcgggtaccgcgtcgtccccggcggcgcgatggcggcgtcggtgctggccgacgacgacttcccgcagaggcgcgccgcctactgcaagaagcaggtgcgggtgacgccgtacagcaggtcggagaagtgggcgtcggggctgtacgccgaccagagcaccggcggcgacggcctcgctgcgtggagcgagcgggacagggcgatccgcggcgaggacatcgtgctgtggtacacggtggggctgcaccacgtgccgtaccaggaggacttcccggtgatgccgacgctgagcggcgggctcgagctccggccgtccaacttcttcgagaggaacccgctgttgacgacgatgccgatcggccatggccggcctctcgtcaactgctcgtgcgccggcggcgactccatttccagatgactatagctgcttgcacgtgcaacggacaacgggtgcaagtcggattgacacgcgctgtggcaagtgagtaagtggccaattatttattgggaacatctttttgcagttccattggacttggtagaccttgatttcctttgaacttgagaaatttcaattgaattcgactcgcagttgggtacttgggtcggcaatgagatttctcgccgcccatgctttactcaaatactctggtaacttactctctccgtcccaaaatataagcattttcagactctaacatggtctacaagatgctaatttgaccaataattaatatatatataaataatattttaaataaaaagagttacatattatgatagtttgtttcgtgataaatctagtaactttaattttacatgattgattttttttttctattaatagtcaaagttaaaaatgtttgacttgttactgtgctaaaaatgcttatattttgagacggggggagtagtcatttggatatgcctcaatcgtggcacatccaccgtaagatctgtgtggatggttccctaacattgtcgcgcatgcatgccgagccaaactagatgtaatgaaacaaaaaatagagtcgtaaagtacggcaaactttaaaaaagcttagtactgagccaaacatcacagtccacgtgtgtagaccttcgtctggaagaccacttccatttatgcaacacgcgacgtttcacaatctcaaatgattcttcagatcttgtataatttacgggctggatttcaaccaatgcaaataagaccttgacataatgatctaagataggagaagaagaggagaccaacagaggatgatgaattaggtctatagcagaatcaagttagagaggtcaagtgatgatatggtgttgagggaaatagggacgataatgcttttcctcaggcatccaaagcccaaaactcattcactctctccatccttgcatgtcaataagcaacccaattagcaatctcctccaaacccatccccacatcattgacgttgttaagatcgatgccctcccttgcctctatgttcccgttcaagttcttcctcaccgttgccatctccttgttggacctggccatatagtgctcggggggaaccggtcgtgagcaaaggtggctaagcaaagggttgtcgcagggaagtagccgggaggcagcaacctcagatgaaacttgaccttcaaggtggagtgacatactgacatgtgcaaatgtgtggtgttgggcgtcgggtttgcttcgtcatgccacaaagtagagttgacgcacgactgcataaggatgatgaagctaacgacagctacaatggagatgtcaagacgctgtaactggcgaatgagatctctacaacctggtgtggaagcgggaggaagaaagccatattggtatgctttgcaaatcttgatgtttcaacaaatggactacaatttttcacgggcaatagtgaaatgttatatcttgaaattgactgtgtttcatgtttttagatttgttatttttgatgcttcgatagttggcacttaatgttccagaaaatgtttcaccttgaatttaacagggtttcgcctttttctacttattattgatgttgcactctacttatcaacatattttttacatgtttttctaatgttggttcattgcacactagtttttgtctgtgtatttttcaaatgtttcaatgacataatgtatctttttcaagatatttgtcaagcttattcataatgtattacagttagagaagatacaatagcaggctataagctagctgcaaacatattttaagaagataaatgatgagagagaga

SEQ ID NO: 14747 - DNA, 5840 bp, Oryza sativa
cacatgcccctcccctttccaaattggactgttcttctcttcataaatgaacggagatcggtacggttgctgtccgagtgcccttctgacgggacggcccatacctactcccacttccgccggaaacaggtgcgacgtgggattatggctgtctgtggatgacgcgaccagtgtcagaccggtcacagatcagtcatccttgtccaccacgcgtcagtttagcaacgtgcatgttcgcccttcttcatgtaacatttttcctgtaatggttgggatgaagcctggtatatatctgaccggaggtaacgtgccatctctgagaggcaacacgctagctccggctagagacgagtgcctagaggctctcgtcttgacgggatggggcgaggcgtgcgtcagaccgccagtcgccacctaacccgtgatctgaccggtctgtgactggtcacagaccggataaaggaacgcgctgcaatgcgctgcatgcagcgtgacacgcttgaccagaccgcaataaatgcggttagatgagccctgccgtgttcacctaacccatatatgtgacgcaaaaaccctcaaggggtcggggcgcctcggccctcggggccgggacaggagtcacccgacccccctcggggaaatcaagaggagggcggacacctcacccttgggcccgacgtccccgagggtgccaggccacgtgggcgattgtgtctgcctcaagcctctggtctcgatacccccggtcccatatcaccgacagctgctcttctctctcgtcctttatctcattaaaatatgtttatagctggctaatagtttgctattgtacccgctcttagattgactatagataaactagagctagtagttttttttttgacaggaaacgtgctctttattaataccttggttcagtgtaatcacgaaccacaaaacactgtacaaaatccgggagggggtctgcccatatggacatatgacacgggtcccaactagcccctttccgggccagttcatgagcacaactattacatgaatgattagcaaaagacaccttgatcatacctaagtccatacggagcagagttctaatttgtttaaaagtcacgcccgccgtagactggtcgtagcaagcggagtccagtgcgctcaccaggatggagctatctgtttcaacagagaaatacgaaaaaccatgatttagaacagcacgcaaggcatgcagacaagcgacggcttccgcgctaagcgcatcatgcaccagttcgattcgtcctgctctagccagtaccccattcccctcatggtcccggaggataaagccccaaccaccacttagattagccgcctggaaagcaccatcaatgttcagctttagaacacactggggaggcggacaccatgtactttgactgctaggatttccccgagctttgtcccgaaagagcaaggagttttctgacaccatccttatgactctgctatatacctcttcatgcgttctcctatcctccccagcattcactttgtttcttgcatcccaccaattccagagcagtatgacagtcgttaacataatgtcttctctcaaattcagaatgtgcttacatacatccaacgtagaagtctgaagagaaagctcctgcctaatgtgctcaaagttcagcatgcgccaacaaggtttgacaaatttgcacttgaagaaacagtggccaccattctcatctaaccggaggcagactgggcaccttgtatcgatctccatacctcttttactgatattctgacggagtggcaaactgttgtgcgctaagcgccacaggaaatgcttcaccttaggaaggtgattcagtctccatagcttctcccactgaagggctgcactgctcgttttccccgatgaagattcacctgtttgtcgtattgcctgacgatcacgctgatattccagagtgtggtatgccgacttcaccgaaaaaatgccccttgggtcaaaatgccatgctgcaacatcgctatagccattatgaactgggatggctagaatgtttttcacatcctcctcccagaatatatcctggatcaactctctatcccattctccggtaattggattaattaagtcagcaactttgttcagaacgatccctctccttggggtaattggcctcttggttgtacccaaggggatccatgggtcgttccacatatctatgtcggtaccatcaccaacacgccagattaggccaaccttcaacacctgcaccccccgaacaatacttctccaagaatatgagatgcccggactttctctaacctccataagcttcccatctgggaaatatttggcctttaacactcttgcgcacaatgagtctagattggaaaggagccgccacgcttgatgggctaacatcgctagattgaaaaggtggaggtctctgtatcccaggccccctttttccgttcgactgcatagtttgtcccaggcaatccaatgcattttgttttcccgatcatgctgtgcccaaaagaaacgggagatcaaactgcttatttcatcgtaaagggtttttgtcaggtcaaaacatgacattgcaaaagctggaatagcttgtgccacagctttgatcaaaatatccttcccggcacgcgacaacaacttctccttccagccttgtatcttcttccagaccctctccttcaaataattgaaggtctttttctttgatctccccatatacactggcaaccccagatatttttcattccatgcttcaaccccgatatctaaggcatatctaaaagactccctcttagattccctcgtgtttctgctaaatataacttaacttttctccttgttgatagtctggccagagcatttttcatacagagacaacacattctgcagataccccgcgctccgttcatcagcctttaggagcagcaatgagtcatccgcaaacaagagatgattaatacttggcgcattttgacatactctcacccccgtcaggtcgcctccaggtcgcctcgttcttcagcagcattcaacagggacgaaaatccttctgcacatatcaaaaacaggtacggcgaaatcggatccccttgacgcaatcctctggttggcatgatctgctcagtaaaatcaccgttaaccttgctcagtaaaattagagctagtagttggctatactattaaacttgctcttacggcatagagttcctatccaaagttccaaaccgacatgatatgctaagaaaagaacgaggactacctatgtcgatcgaagttcctggcatacactgtatacaacgtgacactgtattgtgatcggcacctctcatctccctctctacacaacacattttccatacgagaagaccaaagtttcccgtataatacggggttttaggccgtgcctgcgaagtgcgaacaggtggagctcacatgtccgcgaggaaggcgacctctcgctgcgactggacagtgcagccgcgccctccacctcccgacacccaagagcctgccctgtctgcctcggccgcttgctgcctgcctgtctgcctccgcgtcttttctgctgcccacattccccaacgccacgctgctgctggtggcggtcgccctcgcagtcgcacccctccccttgtcttcttcctcccgccctcttctgcttttggttgagcctcctacgctacaaacagaagtactcctactcctgtactgctgtgaagtgcgaagcttaacggaccaagcgagagcgagagcgagagagatgatggtgctgttgttgctgatggcgctggtttactgctcctgaggggtagggagggaggggaaggagcacgttcgcttgtggagcggttgggtgggtggtgattcttcttggcgcagccggccaggtgaaaacggccgcccaccggctttgctctgtagtgtccgctgctgattgctgaggctcccgctgctccgttcttcgccggtggtgttcttgatttcgtcggggggaaaggtatggctgctccttctctggttgatctctgggagttcctaaatgatgttccgttcttcgggttcttgatttgtttgcggtgctgctgttgtttcagattccaggttaacaggcgtggatttgattggggggaaatcttgggatatcgagcgcaaagatgcggatttgatgcatcgttttttcctcacttcttttcagccgtcagtcggagcaagcagatgttttgaatccagattccaaccgaggggaacagcctgctcggagtgtgcgtgtgacggtgtgagtgataagtagggcggttgcgcacgaggtgttcgtcagaaagccgcaaaggagaaggtgggcgtgcaacttgcaaccgtcgccatcgtcacgatgagagactttgcatcttgcttaagtcaaagcggcgtccaggtcgcccattcctcttctccaggtggccagaacatggtgcagtgcacctacctagcccgcctccgtggcaaatcttgcagcgtgaccgtcacctggagcaagatgaccatggggcaggctctgtccgtcgcagtcgacgactcctcgaatcgttgcctttgcaaggcagagataaagccatggctgttctccaagaggaaaggttccaaggccatggaggtcgatggtggagcactggatatcgtctgggacctgtcctctgcgaagtttgcggccgggccagaacccgtcgaaggcttctatgttgccctggtctgtgatcttgaagctgttcttgtgctcggcgacatgcgcaaggatggggatcacagggtttcgtcagatgtattggcctccaatgctgtcatgatagccaggaaggaacatgtttatgggaagaaggtgtattcagcgaaggcccggtttttggacattggtcagctccaccatatcaccatagagtgtgacacatcggggttgaaggatccaagcctagaaatcaggattggcaagaagagagtcatgcaggtgaagagacttgcatggaagttcagaggaaaccagacagtctatgttgatggacttccagtagaggtcctatgggatgttcatgactggctatttggttcatcgaataaatgtgccgtgttcttgtttcagtcaggccaatccatggaaaaattgctgtcaaggtcatgctctcagaatgaaaaggagcttcaagcgcatcgttttggcttcactttgatacttaatgcatggaagaccgaataggcagaaacatgatgacaagtttcttcggccattctaccgtaaattaatgaatcctaacagtaagaatatgcaagcctgacaaaaccttgtgcaaggatttcatgcttcttaactattgtgttctagtgatgattagcaagttgagaatttgagtacccatataattttttctagataggtagttagacagaatgtcagattctagtgccccatttgtattatcatgtctttgacatatacattctgatcacaaatccaagaagcaaagcaaaaaaatgatgcttttctgaaaacttttccattcttgtgctctacatgttcagtgtgaggcttagtagaaatatattactgaatcaagaaaatctggtgctgtgttctgtgccaactcccaagttaattgtcttagcaaaggtaattgtaataatcaactaattgtaaaatcaaggagttgatttagattttgtgatgaaaatattggtggtttgataatgttattttcgacgtctacttcattttgagggtaatctttaattccgcaaaagatttttggatttttggttttccctatcattcacctcccctatg

SEQ ID NO: 14748 - DNA, 2100 bp, Oryza sativa
  unsure (1)..(2100): unsure at all n locations
nnnnnnnnnnnnnnnnnnnnnnnnnnnnnnnnnnnnnnncttagtagaaatatattactgaatcaagaaaatctggtgctgtgttctgtgccaactcccaagttaattgtcttagcaaaggtaattgtaataatcaactaattgtaaaatcaaggagttgatttagattttgtgatgaaaatattggtggtttgataatgttattttcgacgtctacttcattttgagggtaatctttaattccgcaaaagatttttggatttttggttttccctatcattcacctcccctatgataggtttgtttgatcttttatgatcctacactaatttcacaagtgcaactctgaacatgctgtgagctgcattttgacgatccttgatgactagaggattggtaaagattgaaggcataagttaaaattatccaaaccaataatatagattactgatgggaaattcagttgctggtaaaattattaaatttaccctgtatttgttaatctccatattttttctctactactataatttacagagaatggataacaagaacttatccaagtactgactttcgtagtcaattttgtttcccttttgttgatggcccgctgagctccaccactttgtgatattggtccatgaactccttaatttagtaaattttcatattggtggtttctttaactggatgtgcactgggggaaaaaaggcaaaagcaaagttgcatcatacacctactactacaaggataatgttaatttttttatcctgaactacaatagttccagtcagtacaacagtcaacgttcttcatatctaccatgtttgattcagctaatacagtatttgtgacaattttgtcagtaactgtcacactaaagtatgtccacattaacaataaatgctgctgcagtttacatgactttcttgagtgtgtcatagtacaaattttaaacctaacagatgataggtgcaagaaaacaaacatgattacaagaaacacttgcttcagtgctatcccacataagataccactcaatttctagaagcagtgttggctagcattgaggagctcatttgcacaagcaaagaatatcccatatatattgccacattatgagaccagaggtggggccagaataaaaactttgacttggcattccactgattcccttccatttccatggggtccatgagatctccagaattgctgatggagcaaaagcttctctccacgggagaaagtgaagaggcaactactggaacaacaggtcagtttctcttctcgatttccttctcataatctcttaagatacttaaaccatcctattcagggcgcacatcgtttcatcatctttattttatatttctttgttttgttttctgtccatttggctcgcgtggtacaatggtgatgctctaacagacgccctgttaaatctcagcattttggatgtgacctgctgcagcaccagaccatgtaggcacaaagttcatttctcaccagtgctacataccgttcaccgacggaattgatgtttacatttcagccaagactctggaactactctgaaaacagctgaaatctcggccgttcgatcgtattcgaacggtcggatcggggcagattttcctacatcgcgtgccgacggaaatggcttgataatagttcctcaacctcccctttgccagtacaattctcaatatataaaagaaagccatcggcgaatacgctcgtggctcgcattgttgacacggtggtaggccatggcgatcgatcgaccagaaagcttaaataagacctaacagagccagtgttctccctctcgtctctcttcgattgcaagaaacttttttcttttttgcgatcgatccagcagcatttacattggcctctctcttcccgttgtttattcatgggaagatatggatggacagtgacgcggtaccaagaatgttaaagcctgtgattaagatgcaagggagggaggagggcaacgtgattgcgagaaaggaatagtaaagcagaggattaagaggcagaaaggcttagcttcacccagcctcgaagcaacactgcaactctcctcctctcttc

SEQ ID NO: 14749 - DNA, 732 bp, Oryza sativa
aaggcaaactaaccaggggatggcaatgtccttaatcgctcgattttctagcataagcagtgtacgtagaggatgagttttttttccgccaataaaaagtacccaggctctaaacagaaaagaattgtctccaacttctatattaatctcactcttgcatatgtcctttctaaaatgaattatatgtgttagactattgtatcaagagaagttgggaatacattgtaactgtttatgaaactatgccataagaatcataaaaaaattaagacatctctgtattactgcataccataatcatttaaataatccattagcaaccttgtgaacatatcagtaagaactattgattctggagagctacgggacagtggacagtggaaatacatcttgatgtaggctttgggtgtgaagaacatcgtatcaggcttataccacactatggaaaacagtgttttccgcagcatacaaggaaaacttccctggataaaacaaaagatatcaataaaaagtttcccaaaataaaattatcaatacgttttaagaaaaaataccttctcctcaacattcttcaatgaaagatcacttggaatgaagatgttaggttttggtatgtgcaaatcttccatgggagctctatttacccagttctgtacaaattatgttaggaacgtgtccacctccaaacacatagattggaaaatatgataggaagagtaacatccaaattac

SEQ ID NO: 14750 - DNA, 366 bp, Oryza sativa
atctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagataacgcattactctttccagagcctgccaatgatcatctcccggatttgagacaaaccggctcagcttgcttacagcaaatgagatgtcaggcctcgttgcgctagccaagtatatcaatgagccaatgatttgagagtatctcagttgatc

SEQ ID NO: 14751 - DNA, 1141 bp, Oryza sativa
aggttgagatatttctcgcttaaatcctgagatggtattattatccttaacatttattatgggcctttgagatttaatagaataaattgggcctagccaaattattctaacaatcccccccaaatttcaaggctcataagaaatgttctcaatgttgtgcctgtttcatataccagggttttggtgaagactgttaagttgaacttccacatagaaaatgagctacaccagaccacaacttaacaatggactatgccttgaattgtaagttttgtgtgatcaggtttcactcagaaccttgactggtactgggctgccgttcgcatcccctctgtttggagcatataagttaagctccaggcctttcatgagtatctagagattgcccaaatctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagcccttttcaggggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggat

SEQ ID NO: 14752 - DNA, 784 bp, Oryza sativa
  unsure (1)..(784): unsure at all n locations
acgccccccgtacgaagatccgaaaagcttgtacgcccgcgggcacgcccccccacccccccggagaagccgaagaaaaaaaattaaaccagccgcgactgcgacgtctcgatcgtgtgcgcgtgggaagaaaaagcacgcaaaaaaataaaaaaaaaggcggccccgcgacgcgacgtgtccggtgccctcccggcgtttgacgcggcaacctcccgcatcgggccccggccgggcacccaccgggagcctttcgccgagccaacgagccaacgcagcgtacgcacggcacgcgcacgcgcggcgcgttgcaggatttctcggttgatgacggggaaaaaggtgcggtggtgtggtgcctttgcttggtgaaagatgggttggttatctggagctacaagtgataagggggtactgtagcagatgatgttaaacaccggcgtatggtgttcggaagtagcggagttctgcatcagcaaaagctaaagccttgccagttttaatttgccaccacgatctgttttcttgagctgttggtgattgaaaggttgggagtccttattacaaacgtaaatgctcaaaacacacgtacatttatccttataaacatatttaaaaaacggatcattatattttgagattaacaaaatcatcacaaatatctcgatatcaatacgtatatcgcatattaccgaagaaataattagccgtaaatatgagcattcgtaccaattctaatatttaannnnnnnnnnnnnnnnnnnnnnnnnnnnnnnnnnnnnnn

SEQ ID NO: 14753 - DNA, 509 bp, Oryza sativa
acgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttacctacgcagtggacggcgtgggacttgcggaggatggcggcaaggccaaggtcaccgatcttgacctccccctgg

SEQ ID NO: 14754 - DNA, 1896 bp, Oryza sativa
  unsure (1)..(1896): unsure at all n locations
gaccactggctaacggatggtcgcgtcctggcgatatcccactactctgacgatatggcacagtcacaggacactgtcccgccgcagttacacgtaccgatctgctctacacggagtactgatctgcagtccagccggactgtgggcgcgttaaagtaggccgagtttagttcccaaactttaaaatccaaaaacgtcacatcaattttttttatccacacaaactttcaatttttacgtcccatcgtttcaatttcaatcaaacttctatttttagcgtgtaattaaacacatccgtagtgtatagagaacacagtaccccgttacaggatcgggatctgtcctgcagttcgtactctgtagagattagagaacctactagcatcacatgagcagagcactggctacacacaccaaattagaggatcccgccaagaaatctattgccgggcagtgaatgagactttcgccgcaccgcacgcaccgctcgtgtagtcgtgtgtgacagtgtgagcacgggtatcacaccagccggctatgccggctatacgcagtgctgtatagtggacgtcactgcgtcaaccatattcgaggcatttagcggagggcgacgtcgagacaggtggatgacccaacatgaccaacactccagcgccttttacgccgcacaagactttggagttgaatggcgctaattgctgcgaagtggagctcgggacctctttcagtttctagacaggtcacaagtactcatgatatagcggtggaatactcccgtgtacagttacttgtgtggctttcactcgcaggggatcgagcaagaactccgtgaagagttactgttagccagccgggtgcccgggcagcgggcaggcaccatgtggacgctacagtacgtaacatggttacagcgacccggtttttactgaagcttttcttttcccttcttctctgtgactgattcgtctgataaaaggctactacttactagattttgtctcaacaacgaacttgcacttgcagtcttgcacatggcaagattcatgttcaagcaacaaaactacaaacgtgtgtcgttcgcaccaatgtttctgaggagataaaacgccggaatgcagcagaaggagcggagaacgcgtgagcgagagggataaactcgccacgaaacgtacgtaccgacggtgtcgccgagatggaacttcttggagccggcccaggctgtgtagttggggctgcccatgatggtccacccggtcttgtcgcccacctcgtacacggccgccgccgctgtcgccgtccccgcccacatcaccaccaacgccgccgccgccgccaccgccacggccatggccgacgacaccctgctcgccgccgcaccaccacccatgaccgagagcgagaggagtagagagcgaagtgcaggttaggacagtggcgagagtggcacaaaccggccggttaaataaaagctccgcaacttttcgatcccctcgtggggtcgtggtcgtgtctcctcccgaaaatgcccccgcgccgcggccaagctttcctttcggcgtgtgtcatcgccacggtgtgtcagtcaccgcgcgagcgactcgtgggtaaatttctctcgccttttatcatcgcggcgccgactgcgtgtggtgtggcggtgtgggggcgtcggctgtttgttgccgcttgcaagcgttgaatcggttgtgcgaatgccgagattgccctcgggcctcggttgtgaacttgtgatgttggcgcagtatggcctgtagctgaggcgtgatccttactccgttgacaacgtacagcatacgggatctctcgctctttgttccagcaaagatttttgtactctactacctccgtcccaaaataagtgcagntttacactat

SEQ ID NO: 14755 - DNA, 1321 bp, Oryza sativa
cgatcctagaactaaacaatattattaatcaaggccgtgaacccacacgaacctgccttaacccaagggctatgatgattcagaccgaactggcaacccgaccctgggtcccagctcgtgctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacagacgaaagacgtgacatagtttccaacccatcctagccatagacaagagtaccgacccaatcccacctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagaaggagcggtgtgaagccaattccacaataaaccaacaattccaaagtgtccaggtgatatgaatatttcccaaagtctagagttgaaaaaccacctaatgttacctaattaaattgcgaagcatctacctaaaattaaactagtggtgccatgagtagagtgtccactagttgaggttttgtttattctagggtgaacaaggtaatattaataacaataacaataatcataaggtcataacaaaggtaaataggcatggctaaataaaacagtgataacgcgagaatttaaataaagcgataatgcaataatttaaatcaacataattttataaacggggattcaatatgatcaagatgatgtgtcttgccttgctcgctttcccaaacgtcggcttcaactttcacgaagagcggatcttccgaagctgcagcgtctacacgaccaacggaaaagaaaaggcttttactctaaataactccatataacagcagaaacaaagcacaaaaatgggttcttgacttcttaaggaaaaattagagacttgaacggtccaattccgagttcaaatggccaagatatgg

SEQ ID NO: 14756 - DNA, 1427 bp, Oryza sativa
  unsure (1)..(1427): unsure at all n locations
nnnnnnnnnnnnnnnnnnnnnnnnnnnnnnnnnnnnttagggatttttttctttttataaaacccttttaactttgtttatttcttttcacttattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgagttttagagtcgttttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgagacacatgaaacacatcatgcacgttgcccaaggaggcgggcagctccaactggtaagcgacttctccgcgtcgagcaatgatacggaaaggacccacataccgaggtgcgagctntcctttcgtctgaacctgtgtacacctcgcaatggtgtgacccgaaggtacacaaagtcatccactgcgaattccaggtcacggcgacggttatctgcataacttttctccggggactgtgccacctttagattatcccgaatgattctgactttagcttcagcttctctcaggatatcagtcccgaacacttggctttctccaacttggtccacaaaagcggtgtccggcatttgcgcccgtacaacgcttcataaggggccatttgtatgctggcttgatagctgttattgtaggagaactcggcataggggagactcttatcccaggtcttcccgaaatctagtacacatgcgcgaagcatatcttctaggatctggtttagacgctcggtctgtccatctgtctgcgggtgataggcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccgg

SEQ ID NO: 14757 - DNA, 3281 bp, Oryza sativa
  unsure (1)..(3281): unsure at all n locations
actttcgtgagcttcctgaagtatcagctgtttaagttctctgttatcgggaacacatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccacgaccaactatgcttaggttcagggcttccatctgttggttaagctcgggcggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtacttcaaactcttatggtcggtatatatttcacagcgattcccaatgagatagtgccgccagatttttagagcatgaaccaccgcggctaactccaagtcatgggtagggtagttgccttcatgaggtcgtagctgacgtgaggcataggctaccacatgaccgtcctgcatgagcacgcaccccaatccttggcgcgaagcatcacaataaaccatgaaatccttgcgagtatccggcaagattaacaccggcgaggaaaccagcttttccttgagagtttgaaacgccttctcgcattgcgggctccacacaaatctctcttccttcttcaacaactgtgtcatgggtcgagcgattttggagaagttctcgatgaatctccggtaatatcctgccaaacctaagaaactgcggacttgagtaactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgactgtgagtatatcagaatgtcatcaatgaaaaccacaacaaacttatccaagtattccatgaacactttgttcattaagttcatgaagaaagcaggtgcattggttaaaccgaatgacatcaccgtgaattcatacagcccgtatcgcgtggtgaatgcggtcttcggaatatcttcttcacgaatacgtaattggtgatatccgaaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctccacaaaaatcacaggagcaccccatggggaagtactcggacgtatataccccttttctttcaactcttccaactgtttttttacttcggccagttcatttgctgccatacgatagggtcgcttgtgcagaagagtggttcctggagcaagatctatccggaactcaatctctcgcttgggcggcataccgggtagttcttccggaaacacatctccgaactccctgacgatggggatttctgacagtcctatctgatgcagttctgaacttctgacagaggttgggggtgcaaagaaaacaaccggttgttccggccctcggtacagagtgaccgtgcgtctcgcgcaatccactactccttggaattgagtcaaccaattcatcccaaggatcacatccaagttcttggtgtctagcagaatcagatccgagggaaaaggaatcccctgaatttctataggaacggcagggctatattactttgctgtcataacccctccaggggtggtgatgagcagagggttcctaagcctttctacccccaactgatttctccccacgaatgtcacagatataaacgagtgggaagctccagagtcgaacaaaatggtagcagggatggaatgaatgaggaacgtaccaacgatgacgtctggggttgtcagcacgtcctcggccgtcacgtgattcacacgaccccgaatgacatcctttccaccgttgttggagcggggaggcgcttggccttgctgacgccttggctttgggcatttatccgcaaagtgcccgggctcgaagcagttgaagcacagacgctgctgaccttgagcgtccctgcggccttgaccaggctgcacagttggcgtatgaggacggggcgcacgagtcccttgctgattctgctgctgctgcggctgtgggacgcgcaccacgaattgaggtctaggcgccgagcgaggttgttgctggtgctgctgctgcgaggaggatccccctggatagggattggtgtagcggaccctttggttagcaccctgttgattgccgaaattcgccaagcggcgcttgtgcgactccagctccttgtgcttggcttccaagcggatgctcttgtccaccagtcgttgaaaatccggatagtccccagagactagacgaacggacagctcagggtccattcctgccaagaacttctcttgcttctcctcatcttcccgcacatcctccggggcataacgggccagactgttgaactcatgcaaatactccatcacggagcggttgccttgcttcaactctcggaattcccttttcttaagagccacgactccagcgggcacatgggttctccggaaagcggcggtgaagcgggcccaagtaataggctgtccctctggctgcgtagcctggaagtggtcccaccatagagatgcgggcccctgcagttggtgggcggcgaagatgactttctcctcatcgctacactgcaccgtgtctagctttttccccacggcatgcaaccaatccaacgcatccacggggttgttggagctagagaaggtgggtgggcggatgcggaggaactcggcgagtttagagtgttggggaggtggtggtggagcattctgttgtggcggattttggaggtggtggaggaaagcagtcatcatgttggcttgctgagcgaggatttgggtgagaatggcgttggtgtctggtggtggtggcggaggcgcaggagcaggtggaggtgggttgccctggtggttgtggttgctgccttcaggttgattgccatcaccggtgacagnnnnnnnnnnnnnnnnnnnnnnnnnnnnnnnnnnnnnnnnnnnnnnnnnnnnnnnnn

SEQ ID NO: 14758 - DNA, 907 bp, Oryza sativa
gagagcggcgttcttgcaagcggcggggaaggaatctccacccgcggtgactgccagcgaagtccgctcgggggagccagagaggatcactgcagtgacctcccaaccagcgtggggctccgcgtgtcaccctcctgatccggaagcggcctggcctggtagtccactccatgtggataccccaagaccacgcacatgccttgcagctccaagacgaagccagtcatgtccaaaccacgacgggtgacgctgccggccatctacaaacaaaaaaagaaagaaaaacaccattttaaagatcagattttggcgataaatgaagcagcaagacagagagagactagaggattttcacaaatacaagagatttttatttcgaaaaatactgctaaggcttgggatctacggctcgtcctagggtcaagggtagctctgataccaacttgtcacgaccggaaataacccaacgggctttcctgacgtgcgtgcattaatccttgtcccaggaggcaaggtacaccaaaagttgatacaattcagagtttaacaagcggaagcgtaaatagttaacttattacatgggcagcgaaggcccaacacacacaaagacaaacgagaaacagcggaagactagggcgacgaccacaggcgcttgacggcaggcacgagctagacaccaaagccttcatcttcaaggagctcctcttctggacttgggaaaaattgagcaagactgagtacaaccaccgtactcaacaagacacacccacaaatgcagaataaatgcaagggagtacaaggaattataccataaaggggttagggttgcagtaaacagcatttaaagacatttagttgctcagggctattttgtaaacgcgatcctagaactaaacaatattattaa

SEQ ID NO: 14759 - DNA, 1223 bp, Oryza sativa
  unsure (1)..(1223): unsure at all n locations
nnnnnnnnnnnnnnnnnnnnnnnnnnnnnnnnnnnnnnttacaatgtattttcttgtaagttacagtgtaatttttaaatcttcgcatgtaagttttaaaatttatattggatttggtctttttcttgaagatatggtcatttagtgtctattatggtgtttcttaattgcttttttgctttttactgtgtccattgaattttaattcaaagattaaaaatatatgtaatataatcataaaaatctttcgaaagatgtatatgtactccctttaaacaaaccaaacaaccatattttaccaaaattttgtcaagccaaataaaatcgcttaccaatgttttggtcacgttttcccaccgaaaccggttgaaaacaacacaaaattgtcaagccaatgtcttgacgtgggacgaaagcagttctcgatgaaatttcaagtggttttcaagaaattcaaattttaaatattaaattcaaccaaaattgattaaagaatgacgaaaatcactgtacagctagaagttgggatccgtcagtccattggaaaggtaaaccctctctttctctcatgagtcatcaatcaaaacacaccaaaatatctatgctggtgcgctgtacatatcaatatctatcctaatgcattgtacatgtcaatggaaaagtattttcatccctcaaatgaatattcctcgtttcttacatatcatctaaacaaccataaaaaagttgaaaaaaatataagatagattaatatgaaatatatcactacataaacatgtaatttcaaattctcgacttctacaagctgtaacaaatatagctgcaaatatacattaatcattttcattttactttgttattttgctacaacttgtagaagttgaatttgattttgtatgtttgtggaatgatatatctcatgttgtcaaagttattcaaatttttagtgactatttaaatgatataaaaaataaggagatatttcctggagtgattgaaaatccatctccataacaatgctctcgctatcaatcatcatatggaattatcatgaacggatcgactcttatatggcttgtcgtcaagttcaaaaagaggaaaaataatagaggccatcgccgtcccctgacggcgactatccttgggatttctcacgcgtggtgcacgagcttctaatagttcaaattgaaaatatcacaacgatacgtggatgcatcacacgg

SEQ ID NO: 14760 - DNA, 1106 bp, Oryza sativa
ggtggaacacctttgcacttccagaagccggtgggctgccaccagtacttttggagactgaattggatggtgaaccagaagcaacgggagcatttgaagatcttgacaaatcccctcctccagtagacatattagtgacaggacccatctttgatgaactctggggttggtggtttgaggtagagagagactgcataggagccttagcttgttgctgatggagaccactcttcatcacaatcaaattagagggtgaagcaccaggggaagccacaccagcaggtgcacctgttgctctggctgacgaaggcttcaattgaggagattgactaggaacacccacttgggcagcacttgatgggtacatcataccctgaaaacttggcatgttcaagcggtctgaatatccacctgtattgcttggtgcagcagatctggggcgagagttcatatggtgatgctgaatcaattgttgctgctgcttatgaagttgaaggaaatgttgttgctgctgctgctgctgctgctgctgaggaatgctggatggggatggtgctgccgctgatgtagctgccggggccgatgtatttgctgatttgcctcctagactgaaggcatttgaaggttctgacccaataaggctcaaggtgcgggatgagctatcattagtgcttccactaaggaaaggaggcacataagacttgttatcttgcctggagaaggaaagtgaatgctgctgtgaatcacctggatactttgcagctgctgatttctttctctcactgtcaacagtgttatgcgttgaagaatcaccagccacagattttgtttctccactgacctgacgctggggcttgtgttgaccagcttgaacagattgcgctgtggcaaaattgagctgaggataaccatgcctgcctgcttcttgatggctctggaatagttgatggttcggccccaatgaagaaaagtcaaggccacctggggcagatccaggagcacccacagaaccaaaaggaaccacaaaagagggagaggaagcaagatcaattctcacaccctgccctcgactcgccggtggtagctgatgcggggtaccgagctcg

SEQ ID NO: 14761 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnntgtgggaagaaattgatggcatgaatgtgaaatttgtatattagaaagaatgatctggctgaattaatttgataagccagtagtttcagaaacagtttgtatcgtcgctgacaacttcttccggatctctagctcttgttgtctcttgagataactttgtgctgtagaagtaattatctgaacgatgaagttcatgatcaaaagccacaccacggtattccagatcaaagagaatgatagattccacttcgtttcctacacatacataattaagatatttaggaaaaataacaaagaacaagaaagcaaatgatagcaggttaagaaaaaaaacagcagtaaatcagaagagagagatgctatcatgatcatttttgtaattatattactctgtaatttatgttaaaataattgtcaaccataaggataaattttacaaagtgtgatcttaagagtatgtaattttgttacaaaagttatggaagaatataaattattggtgctagaccatcagctgctttgtcattcagaagttggaagttagaacacatcctttcatgaaaaacagtgacatacattacaatgaaatcaacagaatcaataaatttttgaaacaacacataaccacataatgatgatcaaactaaaagttttgaaacaagtacgcc

SEQ ID NO: 14762 - DNA, 928 bp, Oryza sativa
aattaagtgtttcacgcaaaacgagatggtaataacgtgtgattaattgagttttaattattacaaacttgaaaaatggattaatctgatattttagaacaactttcatatagaaaattttcatacgaaacgtaccatttaacagtttgaaaagcatgccactttaatccaaaatttaatccaaccctttcatgagtttcaaaatttaatacagttgttgctgctacctttttcagtcttcacccttgtatggaattgagagctagctggtgcatttcagttgttgcaacactgcaattgcacatgaaaggtgaacacatctttgttgaatccaaaatgtcagtgaattttggcaggtgtaaatatgtgctggataagaaagaatgccctagtctccaattgaccaaaatgtaatgtgattctgtacatcaaactgaagaaagcatcactgcctcactggatttgccggcccttggtctctagagggatgagggcgcatgccactgctgctagaaagagcatcaggtccatgaaaaacactgcttctttctgacggcagttttctgacaaactaacagtcaccacaggtgaaactaaactgccaatccggccaaaggaagatgtgattcctacccccgtgttgcgagatgatgcaggatagatctgcacagaaatggcatgaatgggattagagagactgtttatgagcattatataatgcagcttttggtaccacaataatttgtgcaacaaagtttgatacatcaggcatggtttttcagtaatgtgcgatagaccatcacgctgcatgattgcctgattggaaatcgatttccattagaagtgaattatcaatacattaaaagcaacagaatctttatgtacacatgctgcagcaagttagcaatcttgtgggatttgatttggg

SEQ ID NO: 14763 - DNA, 845 bp, Oryza sativa
ctacacacatgtttttctgcaatacatgtgccatgaagcttttcacatgcaatactacaacccaaccaagatttaaaaaaaaaacaataaggtttgaagagtggttctttatgaattaatactctttaaagggacacactagaaattataaagagagcaatatacaacagccaaattaaacatagactaagcacagtgatagcatgacacgcaagaaagttgtgcttactttacctgaccgagaaaaaaatagttacaatgactagtaagtaaattaattttctgattggataacagtggaacattatatttctattgttcaccttaagtatccaaataagatgcttgaaacaatacttggcctgcccgagaaaaaaagttagaatgactggtaagtaaattaattttctaatcggatggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatggcatgtgaatttcacataagtcattttaaggcccaactgttttttttctcttaatgccctttcacatatggactttgacatctttgcagatttatcaagtaaatggttagttccaaacgttattatgcaactcataaacttttcaaggaatgggccgcttattagctagatattgtgacagcacctatcaggagatagtagtgttgaattg

SEQ ID NO: 14764 - DNA, 6000 bp, Oryza sativa
  unsure (1)..(6000): unsure at all n locations
nnnnnnnnnnnnnnnnnnnnnnnnnnnnnnnnnnnnnnnnnnnnnnnnnnnnnnnnnattcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttctcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaactagtccaagctttctcatccttatccacccatattctcatccacccgatcgctccgccttcgtcgccattcttcttttcgcgggcgccgggtaagcgccttacgcttcgaccatgccggcgtgacgccagcctgtctctttgacgtcgtcgtcgtccccaccatcggcgcttccttctccaccaccgacgcccacgccgtcagcagtggtgatgacgacgcgcgcaggcgctcgtgccgcttcactcacctttgtctccctctcccctccactcactctctctctctccctccctctctctttctctctcgggagaaggctgagaaggtggagatgaagccggccgagaggaaggggtcgtcatcgtcgtcgtctccggcggccgaggaggatgacgacggcgcggcctgattggcaagatcaccctcaagctccccaagccaggggtgatcggcgtctctctggcttgccgtcttcgtcggtattctcatcggctgggcatggcgcccacgctgggctatcgccgttgtcggggacaacgaacagccgccgccggtcacccctgctctgcctccatcgcacgtcgccgaggacttttggccggacatcaccaccttctgcgtccgcgccacaaccttctccatcaggtatcagtcgtgatacctcagtatctggcctagtatccacaagtattaggcatggtacccaggtaccaaagtttgtgatacctaggtaccagtcggttctaaggtactaggtaccaggtacccaggtaccaaagtctatgatacctaggtaccagccggtaccaagataccaggtaccatctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgatttcccacccataaaaagacatctttaaatcttaactattcattctccctctttcatttaattctaacccttcattcatttcctaattccaatctcatcctccatttttcgttatccaaacacaccctatgtattgatacttttcgatgatgcacaattcctatctttttttttcgtttgcatagacatataatctcgtatgtattatgaattaatttattcggtgtattacgttattattattttttgaacatgctaaatgtttagacacgggcagataaacctgcaaaatggcataaatcttatggtgtacatcatgctatataccgcaatcatggaacaaagacaaaatgtctatattgtactccctccgtttcacaatgtaagtcattctagcacatttctcatatttatattgatgttgatgtatctagacatatatatctatttagattcatcaacatcaatatgaatgtggaaaatgataaaatgatttacattgtgaaacggatgaagtactggttgtcacactataccatcacaccaatcaagcgaagcttgcatcaacgatgatttaaattttacaaaaaaagagagagaataatttgtattcattagccatttcatctaaaagtttaagctgaccgagaaagtctggtaaatatccactcgtatttcaacaaattatttaaacaaagtctctatttgaaaaacatcaacattcaaaaaggggaaaaataattattgaagtctctacgcgctaggtcgctgtcttgttaatcgatcgaattgaataacgtatcaacaaatttcttcgactcaggcaagcaccaagcagatatcaacccaaatcgatcgcatgtcgtcacacacaatctcctttcaccatcttcacgtcattcaggacaggataccacaccgtgcgtatcacgcatttgatatgcgagtgcgctaatatacactcccagtccgatcgatttggcagaggaaatttcatactttcacatacgtgagtctgcctaattgctctccgaatgatctaattgaccaaacgacgagacgagtagtccccggagcgccgctcacgctacaggacgggaaggcggcagccggaagccgcaacgaagccggaaaccgttgagggccctttgaatcaaagatttatatagaaatttaataggatttaaatcctatagaaaattttcctatttgaccctttgattcaaaggattgaagctttctaaatcctacgaaattnnnnnnnnnnnnnnnnnnnnnnnnnnnnnnnnnnnnnnnnngaagaaatataccaagagctctaacctcttgaaaaatttcctttgagtctatctctctcatccaatttctgtatttttcctgcgctccaataaaacgattatttccgtgtttttcctgtgttttacaatcctctgttttacacttcaattcctattagaattctgtgtttttcctattccttcattttttcaaccctgcgattcaaatgggccctgaagctagcaacttccaagctccaaccgatagacaactctgtccatggtttcgctctcacgggcgactcttgctgcaccctgcatgcagaacttgtagaatcgcgctataggtttctccaatctccaatatacgaactcgcaaaatcatttcaaccttgtcgacttgtcttacgttgttcttgtgtacgtagagcaaagtacagagaagtacattgctcttcaagtcttcgtccagatggggggtgagagatagagagagcgcatcactttttagccttttgttgcgcggacaaggctaatgtttggaacgctgtctgtctttttcctggccatgccgggctcgtgagattcctggggaactgcccaatgtttcagacgaagaccgtggtgcacagcactggtgccgctggaagtaaaactgtactacgctcgggactctgaaagtctgaactctgaaacctgaccgtgaccggctagagacgaacgcgagtatacgcgacaagtatgcagactttgattcacgattcacgtgcccgggctcagcgggtgtccgcaaccatgcaaacggcggcgtttccggtgcggcaaagctttggcttcttggcgcgcggaacggcggcgtctcacgcgcgcggcacgcccgtgtgagtgggatgggccggtgggcgagcggtagaggggaggggagcacgcggcgggttgggtttcgctggcagcagcgcctcgccttcttgggctctcagcctctcaaccaaaatgggctcctgcgctagctgcagcctaccgcagcacagtgcgctcggttgggtggtgcctgccgccgacgacccccgcggttgcggcgtgcgccgtgcgcggatgcgcccatgccacgagctgtgaactcttaattttagctcaaagaattgggtctagattctatagtgaaattgtgaagcaaaacccagctccatctctcattttaaattatgctgaaactgtttgactgagcttcggctttaagagaggtgaaactaaagctgtgctaaacatgttcttaataaacatataaaaaaacaggtccctttcgca

SEQ ID NO: 14765 - DNA, 5829 bp, Oryza sativa
  unsure (1)..(5829): unsure at all n locations
acactgagcaagcgcaaaaaccaaactctttctattgcctaaccgtgtaacaacaccgaacaaatcaatgggggtaccggtacaacaaatatcatcgctcttttacactaggatgtacacgccaatttacagaatgtgtatcatgccaccagatcgtagtggggaaaaaaagggggatgtagctgtcaattcttcttctaggatgtcattttctcagtctagctccgctatgaagttgggtagctcaccctggcagaggtattcgtcgcagtgggacgcagaaccccagcctctccgtagacgcaggatgtcctctgtgaaggttgagcctgatgcacctatgaaaacgttcgacagcgcacagatcgtcttgtcgagcatggcctcaacctgcaaaaaagccgaaccggtttgccgtttagtacaacaacaaaaggtccaaaagaaatctggacagcaactctgaaatgtatcggttacctgattgtctccacccatgtgatttctgtataacaaggcatcccatttctcagagttgtggtgctctggccttttcacaagagggacttgcctgtcattgaacacaaccaaggattgcaggagacttgtctcactctcggcagcatcagtagacagatatatgactggggcgttagctttctcaacgattcgaagaatgcattctgctgcctgagggatagggaagaagcagctctctttcttcacattactgcaggaagatgagaacatatcagtaaatgcctcattattcaaaaaaaaacatagccaacttgttgcatacatcactcaaaataaccacaagcacatagtattgcaaggaaagacttgagcagttgcgctagcattagtaacatttaaactactcttagtgcatggcacaactgcacaagtcatatatcatgctcaatcaactcctatacatgtatcaatcagattcctttgtagtattgaagtaacacctagtagttttttttacagttacaagcttaaaaacaagttatcttctgtaaccctttttgttgatggaacacaaaatacttgttatttatttgttatactccctccgggctgataatattagtcattttggacaagggtaaagttaaactttaaaatctttgactacaaataatttctaaaatatttatcttaaaaatatgaaaaccatatgcgtagattagtcttaaaaagtacttcagtaaaaccatatatttgttgatattcctatatatattataatagaaaatagttatcaaagttactttttggagaccttgcctttgtccaaaacgacaagtattatcaacccggaggaagtacttgttatgacatagttctgacccaacttattatgcttaattaaaactagtcaccttcaacgaattttgttcctcagtaacctgtaaggcgctgagtgctaattagtgaataccaagtgctctagtagaaagtgtattaggctcaaatagtgagaaaacttaccatgacacttaaggacactgcctcacaatgtgagaaccaagtgcagcaaccagctccaaaatgggcaacaaagatgaatgaatttcccttctatacaagtatgcagctaattattttcaaaccatgacttgggagttaaagtgttctgctggtcacatgttaacagcaactgatgtataacttaactgaatgtccatgaattctcaaatactgttattaagtcattgaagataacattatttatagcttggtatgaattagttgaaaatcttgaaccaccaatcattttagtcttgtaagcaccaaaattctaagaaggtatttagatacaaacattccaggtaaaattctcaaaactattgccgtaagatataaaattaatacgggggactgatttacatcagctgaacaaagaaattaatacagtactatgtagtacttactcccttcgtcccaaaatataagaacctcgtactggattagacattatctaggaccacgaatctggacaggtccagtactaggttcttatacttgggatggaggaagtacaagatagcatttaatcgatttgaagtagcaagaacaacattatttcagtatgctagtcaatgttagcaaatagccaaacattgtagctcaatattatggacaatggctacattgcgtcctagaagatactagtaaatttgttgttaaccaggctcttcattggctgcatcagaacttttacgaaggcccaagtcaatctgatcaaggccagaacatacaagttgacttctataacattttatatgcttagatctaagtgaagcatctaggaccagctccaagcgctccctatgaaatcaagcgcctggtttctaactttcaatgcaaggagctcaacatgaaatcaagtgcacatctctatgtgagttatttaatggaataaaacctatgcttaattgaatgtccatgagaactgagcactaaaaagatgataggattttctctaagccaacacccagcaactattagaggctaattggcacgatcttcttgtaaaatgtactgcagccctctcaataattaaacatatctgtattgctaaaacatggaggtgactaaaaacgaaaaaggtatcttaccagaacttcaggaagccatgtcgccgaaaatgcaaagcaatgtagttgccccccaagaaggtctgaacaaagcgttgcgcagtgagcataataagcctacttggctggatcaaagtattgcacttgtgagccaatgggccaccaggctgcatcacccactcttcctcaacatcagcatagaacatgtcaccgatcgcgagcacctcagcatccgtggtaaactttggcatgatatcctccacaaatctcttctttggctccttcagcttcgcatcctctggccaagctgcctggatctttcccagtgaaatccccaatcccttcaacttcttaacatgatcctcatcaatgaaacaagggggtgatgccgcgtaacatatgaactgatcaatgctcactttcttcctcttctctgtgaattcctcataggtaattacaaccttccttccaatgcaatcattaatgtggttgatatcaagcacccggtcgtactgataatccagcttctggctaggcaccaccaagatccggccaagcagcgccgcgaagaacatgtgcttctccaagcaaatcaagtggttggacatttgcccggagacgcagatggcgaacaggaatcgatctttcttggggttccactctatggtccgccggttggacggcaattccctcctcctgcacccgtcagccggcagatcaagatccaacccatcctccgtcgcattgcccgcagcgccagtgcggtgcgcggagaggagcgccgcctggatctcgcggttgatcttgatctggccgaggagcgcgtcgtggagatcggcgtacgagacagcgttcgagcccgagctgctgccgttggtgggtgctgccgtacggttgaagagggcgaggaggcccgagcgctgcgagcggaggaggtagagcgcgcggagctcggcgtcgcgcatccgggacgccgcggggtcggcggcgggagcggcggcggaggggaggcggatggaggcgggcaggcgaagggaggacgcgccgccaagggatacgaagagcacgaggaagaggacggggagggcgacgaagaggaggaggtagcggcgggaccagaggacgcggccgagcgaggcggcggagggagggaccgcggcgcggaggccggcgacgtggaaggaggaggagggcggcttgacgtggttctgcgggacgagggtctcgaggtcgtcgtcctcgtcggagacggaggggtcgcgatccatggcggaggagagtgtcggtgcggcggggtggacggagtggggaggcgggaggggagggggagagtgcggagtgtggttagagggaagaagcgatggagattggagggtggacgatggcgactgtcgaacggtggtctgctgctgcagaaaatgtagaaaaatgttttcctgaatgctaatactactatatctgtcttatttattactagttcttttaattaattgtactagtattgtgcatcaataaagtagagagcatgaagtcatgaccatcatagtgatttttgcagtgaacacaaactatgccaaaaaaaaatgtggaagtgtttcaataaaatatttgaagaaagactttaacacatagcttgcaacaaatgttctaaataataaagtagaaatactgaactcaatacttctgaatggctgctaaaaggctaaaaaagcatggccaaattagttagagtgttagagcatctccaacagactccaaatcagactctccaaatacctatataagcatatctttaattggtttggcaagctaaactcgttgctaacttcaataatctctccatctatcatttctactctaagtctatactactggtatacatatgttatcatctactacctcttcttcttccttctctttattcccctttccctcttctcctactgggggcatccctaagctcctccttggccctctccatctctgtggtggtgacgtccgtgcaaaggcgaacagcgacggtgacagcggacaacgatggaagatccatgagtgcgtggagcgaggtaaccaacgcgggagaaagggaggttgttggcgggcacggtgaacagggcgaggtggctctagagactgcacattgtggcggtgcccatgctacaacggagctcgagctcgccatccactcccaaccccattgtcgctgtaggcatccccacaccgtctccagtaaagtagatggaggagacggcgacgaatcctgagtcgaatccatacgggggaggaggcggtggaggtcgtgcgaggtcagaggcgacggcgagcgggaggccacggtagcgaggaggcgcgttgaggcggagtcgagggagaggcgctcccgtcaacgccaaccgctcccaaatgaaggaagaaagagaatagaatgtagtgggacacgaatagcaagttgagtaggctagttaagtttggcaagtgagagaaggagtttgttagcggatgacttggagagtgggatggatggactgttggtgtgcgatttttatccataattactaaattttgatttaaacagtgggatgaaaaggttgctagagatgcttagcatgctgcaaagtactacataaaactctgaaaccacttctgatttctaaatagctgctacggttgctttgtgcttgccataagaatatttgggaaaggaataacataggaaatccatagaatttgtatcttatagaaaataattatacgaagtcctttaaaacaaagtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatnnnnnnnnnnnnnnnnnnnnnnnnnnnnnnnnnnnnnnnnnnnnnnnnnnnnnnnnn

SEQ ID NO: 14766 - DNA, 669 bp, Oryza sativa
agtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagccacaaaattccatctgtttcaaatgccaggatttgaaggatcgagggtctcaagggaatagagatgtcgtgatcaagtggtcagctcaggactcaaccaagttgcttgccgttgctcttgatgcaccaggagaggcagtccacgagagtagacggcttaaaccacgacgcatgcttgatcaactgggaatgtt

SEQ ID NO: 14767 - DNA, 657 bp, Oryza sativa
tagtgggatcagggacgagaagggagaaccagagaagtaactgaggaaaaaggtgatcctggcagtgacgatgcagtggtgcatggttcttgggtaatgagaaggctctaggtctaggcttctgtgtagcttatgattccttcatgattcttgttatggtgtgacaaaaaaaaatctgagctttggaagacccccaaagtttaaatttgcatatgccctcaaaaaagtttgaaaatatatgtgaactgaaagagagatggtcctggggagagtgagcaggtgggagggaagaaggtaggggcatttttgaaaaatgtgacaaccgtcttgagtgatctttggaggatacttttattcgttgcacaaaatgaaattaacaagaaggttagacatcaaattttattgaacaatgaaatggccagttccacctaataaattctgccagaatgttcattcataaattacaaaatgagttctgctcagtatcatcgtctcatgacttttcctaatctccctctattacagatctttccgccggaagattggctgattgcatcgtctgtgccatcaaagttttcaccagatgctattcagagtatattaaatgacttgactccagataaagttaggtaggttttaagtaagtatggcccatat

SEQ ID NO: 14768 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnnaaattctaaagcattacctttctgcggtcagaagtcaatggtggaacagtgactcgaatcacttctccatcattgcttggtgtaacccccagatttgcagcaactattgttttctcaatgagcttgaggctgcaccgcatgagtgtcattgtgtcaacactattgatggaaaactcaataccaacactgaagtgggaataataaacagcttacgaggatttgtcatatggctgaataaggagagaagttgcatctggagtgtttatctgtgcgatgctcttcaagttcactggagttccataatactcaacctgtaacaaaattctcacacataaggcataataggatgttcaattttcacaattttctgtcctaaagaaaatcctttgctctagttttagttacagaaggcgatcaaattatccaaacagtctgcatatggtatttgagcaatagcttcattccttgtttgtgtttgttattagccagccacaataaataccagcccagacataggttcagttaagaaaagcacacaacagtagcatgtgtatggaatgataaagtatgcattgagtgtaatgataaaagatgtgatcatgccagagttacttacaaacagaaaaaggaacacggcttaggtctcacacctcaa

SEQ ID NO: 14769 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnnnnnncgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaaaccttgatggcagcgacgaaacaaactttggcaaaacagctccaacaaggaagatcttcagctctggtgtgggggaaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctgggggatcgcccataaccgcgggcacggctattcgaatagtgttactcttggcagaggtgtacaactgtacccacaagacacgaattcacacatgt

SEQ ID NO: 14770 - DNA, 8736 bp, Oryza sativa
  unsure (1)..(8736): unsure at all n locations
accctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgcgggatgatagtgtatccccatatcataatctttaattagctccaaccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaattgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataaggtcgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaagttaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatactactgccggtgtcgagttgacggggaatgtgcccaatataacctctggtgctgactgcgcctcctctgcagatgcatgattgacacgggcctgaacggacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgttatgtcccatcgtgaaaccaggcttctgactcttcccctggggagtcctaaactaagctgccttcctcttacggtttattttgttaccgtactcctcctgacggatagccttatccaccagcttctcaaagtcctcataatctctagagatcaactggttagtcaattcatcatcaagaccagacaaaaacttctcctgcctctcggcatcagtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgccgctgcacctgttgcaacacctgatggtactggtgttgcatctgttgcatcattattgccatcatctgagtctgattgtccaacacctgagcgatcgttgggttctcgggcgggggggacggactgctattaggtgcattgctggcacgtggtccattgatctgctcttcgctgccactggcgttgttcgagtcgcgtgaaccattccttatctccatctgaaggggataggtagaaatatgagaaaaggaagaaaaacagggggctcaaaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaacacgaaacctagcaagcaaacagactaagaagccgataaagctaagggcggcgactttgaagctcggggcggcgcttgcaaacgagggataggactgacatctaaagtagacaagggataggaaccaattcatgctcaaatccaagttaaacaaagcaaaagaagactcaaataaatacccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataccccaataaattcccgactgactgtcgaataaactccaactaaaatttttctaaagccctagactgagctaattttttttaaaaaaaaatccgatccgaataaatgaccaagatttttcccgcaaaccaaagaggcaaaactccaaattttcccaaaacaaatccaagtgaaaaagggcatatgcatatgaaaaggggttcagaaggctgttaggtgttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcaccgggaaagataaaagcgagctaaaccgggaagcttgacttcagcagcgagcgactccactccacaggcaaaccttgacggcagcgacgaaacaaactttggcaaaacagctccaacaaggaagatcttcagctctggtgtgggggaaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactgacacccatgcggtggcaccaatctaaagctatgctcatagtcaaagtctatgtaataatgtgatccccatttgtgtgctagttgaactaagcatggctaagcatttcctaggccaacatctagtcattttgatacccaagttatcaatggcatatggtaaacaataaatggctgagtaataggacccatcccacattacattgtaaaaggatgcaacatttaatagaaatgcgggatatttgtaaattgggtacaatatgatcaaacgtattgaatgacttgccttgctctcgcactgatgagacctcagcaacgtcttcgagaaaccgcggaacgacgaaacggccgaaacctacgcgacaaacagagcacacaagcaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcactttattgcgcaataaagcccagggctgacgtcatccaaggggggggcggcgccgacaggtggggcccgcatgtcagcggttcaagagagaggaagggggcgccggcacgtgggccccattggcagcggcacaagggagggaggtggcggcggcatgctcggcatggctcaagccggccggccagccatggggcggcggccgaagacgacggcgcacgcgcggagggcggcggcgctcatgggagagagaggaaaggaaggaggagaggggattcctcaccttcgagcacggcggccggcgcgaaggaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggtgggttggcgcggcggcgaccctagcggcagtgacgcgcggccgaaggcgacggcaagcggcggcgctagcaacaagcggcgcgagcgcgataggaggcacgggagagcgcggcgaatgagggaaaacgaaagagggggctcgggagagtgcttttatgggcaagggaggggaggacgtggccgggaaccctcccgatttggccggcgacgtggggaggagagagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggagaaggcggcggcgtggcgtattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaagaaaaaggattttcctgggattaaaattgcaccttggtgatttttaattggtaaaaattatttccaaggctctgaaaattccactaaaaatcctgttaatatattgtgacatgtggaacccaagaaaaaaatcccacaatgccaattccaattattaattgcatttattaattatggaattagctctaggttaattaagataatttcttcggacaaattatttaaccaatttttttaaagcaagaaaaaggggaaacttccgagcgtgacaaacctaccccccttaaacggaatctcgaccccgagattcggaagagctggcgaagaggtgcgggtgggtggccttcaactcatcttctctttcccaagtggcctctttctctgagtggtggctccactgaaccttgcagaatcttattactttgtttctggtccttctctcgctggtttcgaggatacgagtcggcttctccacatacgtcagatcttcctgaatttcgatgtgatcccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacattttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactatccaaatagaatcatgccccgatgacgtcctgggcaaaccggtgatgaaatccattccgatttcttcccactttcattctggaatctgaagtggctgtagcaaacctgctggcctttggtgttctgcctttactcgttaacagacgtcacagagtgctacgaactcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgccgggatgatagtgtatccccatatcataatctttaattagctccaaccatcttcgctgtcggagattcagatcaggttgggtgaagnnnnnnnnnnnnnnnnnnnnnnnnnnnnnnnnnnnnnnnnnnnnnnnnnnnnnnnnnnnnnnnn

SEQ ID NO: 14771 - DNA, 2721 bp, Oryza sativa
  unsure (1)..(2721): unsure at all n locations
ttttttaaagcaagaaaaaggggaaacttccgggcgtgacatcccttccccgcttttgatctcttgcgcgcacgagagattggaagaacaagtgcctccgaaaccacaccttcgcctgagatctgcaccgggtagccgggtgatcaggtttttggggagtgcctcctgcacgactgctcatcgccatgtctggagttgctggcggaggtggtgcgccgccgccgacaggagctggatccggagctggtgcgccaggaggaggtgccgtgaacgactacaacaacggaggcaattctgcctcaccatccagcggagggccattctcggggtataatcttctcctcctactactgttgttagcgctatactgtgtgagctatgttcttgttcctgttctacatgatgcctctagcatgttatcgcattactggtatgttcctgtttctgacattcatgatgcgcatagtatgctactggttatgttaagatcaccctacactgcttatgccatgatcattgtttcaatttcttggattaaaatatgccgaataatgactatatttccaacagaggtagcggacggaaagcagtggccgtcactatcctcccttcctcgtgccgacattgccccgccgccgtcgccgaccttggttccggcgccgtcgtgcgcggctctagccccctcgcggccaaattgggatggagcgcgccggccgcgccgcatcgaggaggaggccgcaacgccgggggaggaggtcgcgcaggttgtcaccagcatcgtctcggccgctcgtctccatctacctcttgccgccgacgctcacctctctccctctcccttgtcgccgccgttctccctctctctcccgttgacggcaaccgcgagggcgatgaggagggccaacgccgccgccggagccacgccgttgccggtggccgacaacgcgtgagcgcggtggtcaacggcgagaaggggaggtggaagggacgagggtggaagaggaaaaacaggggacggagcggtgtcgttgggctactcccctacccagctcgcctcctctatcgctcccctagccgaggcgctcgtagagctgcgtccctttgctaagggacgtgcgcttctgctggggcactgagcggcgtgaaaaagggacagggatggacggcgtgagctagggacgcggcgtggagagccgcattgtacatggccttatagaactactccagctagattgattatagtatctagtaacatgtttgattattttgtaacgaaaagagtactctatctagttctatgaatgcgttcgacacaagaagttcatttcaaccagtcctaagttttcaaaactgcaaaatggggtgttttttaataaaaatatcttaaaattgtttttaaaaattatattaatttatattttaaatttgcaatagttaatactttattaatcattcgttaaatgagatatctcgttttatgtaaacaaatttcagttccctctacacccactgcccacctagcttaaatagttgtaatactccaaaaacaagtttcttattttcctattataatgggaagttcaggcttcatgtcaacataaattagtattatcttcgtccttaaataactttatttcacactcctcccacacgtaacaatataaagacaaaatgattggaattacctccattttataaaattctaatataattgtttttcactttatcaaatcctaatataattgttttccactttcacaaaccctaatgaaatggttgtttgaaacatagagttacgttggaataaataagatggtggaaaagaaatatagattcactactactccatgttgtacgaggtagcgctagcgcttgcacccggtgaggcagcgcacaatgctgatactccatgctgcacgatgtcaagcgcaggccatctcgacagccatggtcagcaatcaagcatgtgctattgtttcctggatgccgagcaaggcgccgcacggcgaggtggacgaaggggagagggtgcggcacttttaggagaaggaagagaccgcgcggtcgcgatatgacttttagttttagtttccccgttctctgtgaagaacgtttctgatgaaattttgtgagggagatctgatgaaatgggccaaatggaaccgggagaagtgaagaaccattgcaaaagcagagcacctgtgttgcgacttgcgaaaccgctgaaaacaaagagaatccaagagcaaacacttcgatcgctcctaggcacggcacgtacgccggcgcaacgaaagaaaattcaacgaaaagaaaaaaaaaacagcaatatgttaaccgcggaagcggggcgatcttcgagccggcgacgagcggaggctggccgccggaggaggagcaaatgagttccccgatcaccaccggagaggacgagaagacgaagacgaagagtgcgtcgcgggggagtagatgatcaattgcttccaatccaaaaacctgccactatttataggctcacacattttccacattctgctgtgcttctccaagcgtgggtgggccgtgggctccacgtgggcccattcatcctcggcaaccggtggtgccgcgtcaacgtcacgcctgcctgatgtgcattgctttgtggtcgtttttggnnnnnnnnnnnnnnnnnnnnnnnnnnnnnnnnnnnnnnnnnnnnnnnnnnnnnnnnnnnnnnnn

SEQ ID NO: 14772 - DNA, 1377 bp, Oryza sativa
aagcggggcgatcttcgagccggcgacgagcggaggctggccgccggaggaggagcaaatgagttccccgatcaccaccggagaggacgagaagacgaagacgaagagtgcgtcgcgggggagtagatgatcaattgcttccaatccaaaaacctgccactatttataggctcacacattttccacattctgctgtgcttctccaagcgtgggtgggccgtgggctccacgtgggcccattcatcctcggcaaccggtggtgccgcgtcaacgtcacgcctgcctgatgtgcattgctttgtggtcgtttttggtttacacgtacggacaccgtgcgggccccacctagttagccaacagtgtagtacagttcagcttcgtctccagaagttgattttttatgagacggaaggtgtagtccacacgcagatcggcacagaagatccaggccggtacgtgtggggcccaccgtccgcactgacgggcgcacagagagatgctgctaaaaccagagaacacacgggcggaccccaccaagccacggggccccaccgtccgcgtaccgacacgtcggcctgatcctggagaaggaaacgcggccgtggggcccgtggccctgtggcgataaggtttgctgggtcgtagtagtagtagcagcgccggcgcgggggccacgtcggatgccgcgcgggccccacccgggtcgcgctccggcccccacgtgcgattgcctctcgccgcctcggtggcttcaaatagaacgtcatcgtggacgccggtgcaacggtggccgtccgttcgcgcgcgcgagagagagagaccaaccaagctctcgtacgtgcggctctcgatggaccgcatgcacgatgcgggtgcgatgcctcactctggaaagcacccaatttcgttctctttggatgaagacggttgcggtccatctgaagctgtcgattcataacatattaacatgtgtattgtttgaaaccagtttaatcaaacttacaaactctgaatgcaacgtggatttagaatctagatatactctctccgtattttaatggatgacgccgttgactttttaactaacgtttgaccattcattttatttaaaatttttaagcagatataaaaatatttatatcatacttaaagagtatttgatgataaatcaagtcacaataaaataaataacaattacataaattttttgagtaagacgaatggtcaaacgctgaataaaaaaatcaacggcgtcatacattgaaatataatatagaggtagtatattttatttcgtgtgggatataagagtgtcttaccacatcgacatcagccacaaaagaacaacactccctccgtcccataatataagggatt

SEQ ID NO: 14773 - DNA, 1863 bp, Oryza sativa
ccccccaagtcgtgcctttggctttgggttttttcttgcacgagtttcgttactgctgggttgttagattgcttggtttgcataccgcaatccgcaaatgttttgctccttgtcccgatgatctttttttttgtctaattggattgctgatgaaaaagctaatttcaagaatgggctcgaggcctaacttctcggcgctaatgatgctaacgctcacaccctaacagttgagatgtactagagaggttagagccaataaaactgacgttgagaacctatctataaaaaggaatttctaaaaaggatcatttttttttaaaaaggatgaaagttcatgtaatctgctcgatttcattgttgctttgatattttagatcctggataaacagtaatgcggccctctcgtttaaaagaaaaagacaatttggacagagacatcatgcattgttctcatgatactgtaataactgatggattagtactacagtagtgaccaagaacagaacagttgctaacctcacaccatcatcccctaatccatctagtgctgggtacagttacaatcactccgtggagtactgtaacctgctggggcccacttgctctgctcccaggcccacctggtggtgggccgtgggcccagtgacctgcccactctagcagggtatccagcggggtcagaggggcccccagcgtactgcaggagcggcatcggtgtccgtaattatcgcaggctggtcgttgtcggcgtgaaacgtgtcgactcgacaccggtgctgcagtgacacacgctgtgtagtggatcggactattggcctatgggaggccttgaccgggtatagccggttggttcctggtcgtgtcaaaacaaaacatcctttccaaccacatctgaggtttacaggcgcattaactcatctataatcttcgaataaactaaaaaaaactgatctaatctcactcaccgaggtttttcagaaataataataaaaaagtgtacgaccagttcctaaatttatttcatgcgttatataagttttttaactctcaatatatttttaggtttgtgattttaggtttgtgatttgttaaagaatgtcaatccaattccaaattgccacgacacctctaggatactatgtggtgacgatggcgctaacgtggcatattacctggatatttcaaccacattttttttatttttttccttctcctctaccttctcctttcttttgccatacaaacaggaaggaagaagagagaaaaaggaataataataataataataataataaatgtcatgtggcatgcgacgtcagcgctatgtaagatcccgaaggtgttgtggttattttggaccagaatgacacacttaacaagtttggtgatgtaaaaatacattttgggagtttaggtaactactctagttaaaagtaacacagatgaacaagtttaggtgctaaccatgcactttacttaaaaaaaagtttcttacgaatgattctacccctccagcttcaagttctagaccttaacacatgtgctcttatttataactgatcttattacgagaaatttctctatttcctttgattctaattggggcgcccttcatatttatgtggatgggtattaatttttagtgatatatttcttggctgttttggttagaggttgaaacaattttcaaaggtatccattgagaaaaccttgagttcaaaacttcccgatttttctaattatttttctcaatagtagatgatgtgaaacgtttatagtaataacttcatcaactcaacatatcggttcagttttcatactagtatgtgcttagagaaatatactgtgtgctgataggaatga

SEQ ID NO: 14774 - DNA, 6174 bp, Oryza sativa
  unsure (1)..(6174): unsure at all n locations
nnnnnnnnnnnnnnnnnnnnnnnnnnnnnnnnnnnnnnntttttgctattgtccgtcagtccgtgcgatgacatagagtaatgtgcgaaggtccagatgtcggtgactgctgacaaaactgagatccactgaacatggagataactggcaatatggcaccagtagttgatgcttcagagtgcgtggcgataaattcacaactgtagcattttaattcacgtgaggaatattgacaatgtagcggtagaacaaggataaggtcaagacctacttttacacggagtacacacaataattacaaaaatgaaaatgaaggacacggcaacattgtctgaaattgcactccagcccaaaaagatgcatccggcaaaatgccggccatcagaaagatggaaaaggctcaagaaatctgtgaccgcataattcaccgtgttagctgaggacattgttttcttcggcttcatctacttcgcaggaagatgaactcaccaatttcaagattaaaacctggtgtctaaattttcatgagttcctgaaaatgaaaatatcaaacaagcccgagtcaattcctatggttctggaggattaaaggattacaggatagcaatgctgatactagtttcagacaagccatttatccttggggcatgcaattgtgtccaacatgaaggaatatcttgtctgaggaaagaccaatgaaagggccaaattacctgttccttctgcttttggatagcttcgatctttttcatgtactcgtcagtaactttctgcataatttgtacacgatgtcagttcatgttgcatacctgtatctaatagatgagattccgaaaggacatgggaacctcactaaaccacgtgaaaggaaaggcaaggaatccttacttgtagatcagcggacaaatccttcacgttatcttcagaaagtttcttttcctatgtaagcatgtgaaagcagttaatttcactgcaaaaaagcgaggtacaatagcacccacaaaatagtattattaactgagangggtgaccttctcaagcttatcgtaagctttgatggcatctcttcttatgttccttatagcaacctgtaaaagaagttagtcatattaataatcgatattacatagaatccacaaggagatgaatatgttatcagtcagtgaaaatttgtgtgtataagctactcaacaatgagaaggcagcacataggcgtcaaaaaagaagcaagcatattttctataaagtaaaagcatcttctgaaaactatcaatgtgcttcagccttttgaagaaattggataaataaccaacaaagcaacaatcatatggtactcctgaaatttgtgcagcaccaagagcaaagggtgcatggcaaacaatttttgtgaaagcctcttccactacagctcatactatgctccaccttcctaactaatacacatagaagatgcagcagaaatggacttgaagaagtgctaagtatctggtcaactgatgcatcataaaaaaaattcagatatacattcattcagtattactaaactaatatggctgttatgtgcacagtaatagctaatgagggcaggccacccgccatcatcttgctgctggcgctggcagggcactttactcgccaaggaagaaatgaggctgttagattagtacaggggaaatatatggaactagctgtttatagattatatattgcttaatgaaaacgatcacaatgccattattacaaaaaagagggctttctgaactggcagatgcaagatagcaaatccttaaactaggaaggtaatttaatcaattagggaaatagatattcctgctgaagaagacgaagtcttcctcatgtcttccctggccagatgctacggtacatcgactattgttcgcactacattactccatacaagcagtaccagcaccatgccaaatgcaggttagcagagtcaatcagaccgctaaagtgctgtactaatcatactagtatgggtgcacaagaaaaataataggctggaaaattgaggcataaaaacattaaatcacaataaaaatgtaaaaagaatgtttcagtaaaaaacagtgaaaggtgaagcttaagagtaccttgccttcttcagctaatttagcaacagtttttgccaattcctgccaaaacagattgaatctaagatggataagaaagtggcaggaattttataatcaatggaaaacatctatgaatattattgaacctgtttgaaagctatagcagaccgcaattcaaccaactacatgtattatattagtactaagagaaggcaaaagggggctctcaagtcctagaaataaacacatttttcggggaaaatagaaaaatttatgctgtcgatcatggtaggtttagatttaatggtgtagattgatcgctacggttgtatactaaataacaattgtgtttatggaagatagaagaaagttgtacatcaattcatcaaatacaattcaataatatcacagcttactggataatccatcataaaggtcttttatgaaataccctagtcttttgtgcatggcatgtccaaagcaatttctacttttcttgtttgaggcaagacaaatactcccacatcagtaaaggtgatacctggtgatctcatacattttagagaccttattttgtatagaacatcggccttgtttatgttaacatacttgtaaacacaaattaggtgtctatgtgggtttgaatgcaaagttttgaagttcaaaatactgtaacttcaatgaacataaggcatttattttttgttctcaggaacaatacagctctgctcagctaatccttaatgttttggatggcaagaaaacgcaacgtacaaacttgccaaacaaaattttccatatggaattatggacccagaattaccaagtaaccacacataattcacacagatgaaattctaaagcattacctttctgcggtcagaagtcaatggtggaacagtgactcgaatcacttctccatcattgcttggtgtaacccccagatttgcagcaactattgttttctcaatgagcttgaggctgcaccgcatgagtgtcattgtgtcaacactattgatggaaaactcaataccaacactgaagtgggaataataaacagcttacgaggatttgtcatatggctgaataaggagagaagttgcatctggagtgtttatctgtgcgatgctcttcaagttcactggagttccataatactcaacctgtaacaaaattctcacacataaggcataataggatgttcaattttcacaattttctgtcctaaagaaaatcctttgctctagttttagttacagaaggcgatcaaattatccaaacagtctgcatatggtatttgagcaatagtttcattccttgtttgtgtttgttattagccagccacaataaataccagcccagacataggttcagttaagaaaagcacacaacagtagcatgtgtatggaatgataaagtatgcattgagtgtaatgataaaagatgtgatcatgcaagagttacttacaaacagaaaaaggaacaaggctaagtcctcacacctcaatcctgtcaagcatagctgggtttgcccgccctgtcctcacagtattgaagttattttggactgtttcaattgccttttccatcctttctctctgaagatgcatatctgcagctagtgagcccccaaggcacaaaaaaggaaggcaaaatacccattcagtgagaagatgcattgcacttacagcttggtcttcaatgacagatttttctgcctcaatttcttcaatagtggcatgcctcaatactgctctgataacatgataatcacaagttattaaagcttaatgtggagggtcgatcagtgggataaatatttaaatccaaagtagcttgcctcttgtccgagttttgaagaataagaggcctgctatagaagcgcattggtccagcacggagactcatgaagtttgtggaggagcttaaaatgtttgggcgttctggaacacaacctgtcaagcacaacatcctctggtgagaccatgcatataggaatacgcgaggagcgcatttttgtattaagaggaataaaagttatttacagtcaaatacaaagcagcatgggactgagacaggatacaagcaggaaatcaaaggtgtacgtctcgcggtctgttttggctacaaaattccctcctaaagatcagagctgggatggcttggtttgcttgacgccatagcgtggcctctgccgccattcccttcacgatgtccacccaggtctttgttgctgattgaatatccggccatttctttctttccaaattgtccatgccacgagcgtgactaccgtgtcaaagccccgccgaagatgctctcgaattcttattcgactgctgcagagccattggtagaatgatggttcattcaccggcagacactcagggtgcccaattgcccttaacacccaccaccaaagttgtctggattctgggcagccaacaagaatgctagacaatccccattagaacgagtcttttaaagaatgcgtcaaaatcattaggggctaacgagtggcaattattttctgacgtttaggagtatttactaagtgaaaatataagccccatcagctttggggggaacacactgtaaacccccaccaagtttaaagcataacgtcttgctgatatcgttaaacttaatctggccatgaaatcctgaaccaaaggcatatccaactaccaaaacgagattgttcggtaatgttagatgctatactattacagatacaatcaccgttgttcatagccacaaaaaccaccttattctgcgaaccggagaaacaacggaagcatcaagccggttacgagttacgaccgcagcgaaacgatcaacccaaaccacagcaaccaacgaggcgtcacgcattttccaggatggcgatatgcctcggcggcctccagtgggttccaaggccaaagcctcgcgcggagcagcagcaggagtgaggaaggggggcggcctacctgggcgctgcgggacgcgcgcggcggaggagagcgcgcgcggcggggcggccgccgccgcgggggagacggcgtggagcggcggcatgtacgcgcgcggcgtcggcgtcggcttctgtggcggagcgcgggggggttgccgcggaggggagtggcggattggtgtggataaggaagcgaggttgggaggagagggacgagaagaggggtttatgctgtcggggactcacgtgggcttgggcccaactgatcaataatgggccgtttcaagttagcccaagtaagttgggccgaatgttttagcaccgacaagcatcagactcggtttcaaacggattcacgaccgcacagatcaggtctctcgtactcgttagactcgagtgagttggtttggacgctggtcaaaaaaaaaaaaaagtaaactctcgaataaagaaaaggaaaaaaaatatagctctagtgacagtactcactctagttctatattaattgacgttttggataaggttgaggttaaacttttataattttgaccaccaataactttaaaaataaagaaactagaaaaacatatataattttgtctttcaaaacactataataaaagtaaacatacatttatttattgtatatattataatagaaaaataaggttaaagatatatcttgtagagcgtgtcattgtccaaagcgtcaattaaaatgaaacaaagggagtagtattagtatatctcgagcattaaggccctctttatttaggcttaggcttattggcctagacttttaagtcagcttattggcttatatgatttataagccggtggatttaatgtcctaagtttagtagttgagtcatatatctacctcacataaaccaaaaaaacttctctaacctaacttttggcttaatagtgttagagtggcttatggctttaaaaaagccaaacggaaaagctgcttgtttgtttaggtttagacttttcgacttataagttggcttataaccctaaacaaagagggcctaaatccaatccgacaaaccaaagtagtactccctctgtcccaaaataagtgcagttttgcactattcatgttcaacgtttgac

SEQ ID NO: 14775 - DNA, 3098 bp, Oryza sativa
gggacttcggtgcagcacgcacacggcacacggcaccagctggtggccctcaccgcctgcacgcgccgcgcgccgctggccgcagcgctagtcgccttctctccctcggtgcgcgcgtggggcgcggagcgccggcttgtggatggcgccgcgggatccgttggcctttaccggccttttcgccgggcgagccggatcggtgtttgcctggcctgcacggccgcaccacacccggtgcgtgtgcgtgttccacgcgcatctgtcgttctggcgtagcggcgcgccgacacgcaggcacgcggttggtgtggtaagcgagagtactccgtgttttggcatgaatccaaacaggtctatctggatacctgacgtcagatagcgctggccttctttgtgtttcttctccaccaaagaacatgctggtttcggaaagagcgcgcactaccagatgagtactttcccttctcaccaaggatctgtatgcctgcgtgtgagttggagcgtgaaggcacggccaaattagggcatgtttagatccatttggaatggcaaatgacaaatggcaaaagttttgatggcaaaagttttagcattgcaaaagtactagttggtgtttagatgcatgttaaagtttttccattctagcactaaagtgagagagagaaagagagagggagtggtcccaaagcactttttggcacaatttgctactatggactagcaaatgccaaatgccaaattgccaacttttgctactagtgtttaaattcaaaatggcaaaaagtgctataaaatggtaaaacttttgccattttggaggatctaaacagggccttaggctgtgtttagatccaaaatttggatccaaacttcagtccttttccatcacatcaacctgtcatacacacacaacttttcagtcacatcatcttcaatttcaaccaaaatccaaacttccccctcaactaaacacagccttagtcatttgtcactttgtcagccataacacttgtttttctttttaagctctagcgctccttgtgagttgtgagtactttgttgctcaattattcctgtaaggattagcttttcttgctttaaggaaaggcgttttattcttttgcacaattagacatgtgtgccgactattttgaaggcacttgttctttagctgagattaaaaaaagagggcaccaaaggcactttttttcagttgcctctgctgaagaaagttaatgtttgttctttgcattgaattaaatgatcaaatcctaatcaaccacaactttataggagtatatttcatgctctcagttgctatctgttccacagcttgtcaaaattatgttggaccctatggccaacacaccgatgcatgcgctctcattgaatcattgttttctgttgagcaatctcatggttggttggtaggcttccttggtgggccgaaaagatgacggcacggatgccatcttttggaacttggaagcatagagtaatcaaagaaccacaaatgcatatagctcgtccagaaagagggtctatgattatcgctgttctattatgatagggttgccaaactgccattttgcaatgtggacacctgattgggtttggcccatgagctggaaagttggcattgcgatcatatcatttgttgccctggagagatgccatccgatcagtcaaagtagctagctctaggattttcacatgtttagctctattttggtggttctagatttatagtatctttgagatagttacgcgtggtgccgtgggtttcttttgtcaaaccaatgctgttattgtttttatcgttatgtataacagcatatattcccaatcacatctaaccaagtatagtcgtcaccagtcagagtcattagtaaggatactagacactagagagtggatttttaggagtggaatagattaagaaatataactaactgaacatgatagagcttttagtagtgactctcaagcatgtcatatctggtgattgcgatcgagttagctggtaggatccttccagatatgaactgcactaggttcatcttgttccacaacaaccaaaagtagtacaaaaaataaaaacatcacttttttgcacaaatgaccatctgtttcatcatgctgatgcatgatactagtatgatctagctctgtttttacaaagcttcatgacgtaccccagtcttactcttggtcatatttctttttacagagaaatagaggaagccatacaaggatttagtcaggcctattcatacactatctaaacaaggaagttagattcgcccctttcgaggggcattccgatttcgctagtatcatcatttttgccgcacgaatccagattgagatttaggaaaggaagttaactaagttttcgaatcactgactcaggcccattgtcgaatcctactcaggaattgtcgaattatactcagccgaaaaagaggtacttatttatggcggaacgggccaatctggtctttcataataaagagatagatggaactgctatgaacgacttattagcagattaatatatcatttcggaatgggatatacatcccatatactggatcaaataaaaacgttaggcttccatcaagccactactaaatcgatttcattaggaatcgaggatcttttaacaataccctctaagggatggttagtccaagatgcggaacaacagagttttcatggtttttgtattgaactcaaaagaactttgatctctctcgtgttttgctgaattgactgactattttttgccttctcttgtctgaaaaaaaaaaagccgtgcagtcttcacgtacaacaagcagttccacaacgtgatggcggtgagcaagtcggactacaagaactgcgacacgagcaagccgatcgccacctggtcgacgggcaacgactcggtggtcctcaacgccacgggccaccactacttcctctgcggcttcccgggccactgcggcatcggtcagaaggtggacattcgagtcgccgcctccggtcactcctctgctgccccttccatggcgcccgccccggcctccggctccgaggcacccgtcgccccc

SEQ ID NO: 14776 - DNA, 4930 bp, Oryza sativa
  unsure (1)..(4930): unsure at all n locations
nnnnnnnnnnnnnnnnnnnnnnnnnnnnnnnnnnnnnnnnnnnnnnnnnnnnnnnnnnnnnntattaattataaatattaaacgtagactattaataaaacccatccataatcttgaactaattcgcgagacgaatctattgagcctaactaatccatgattagcctatgtgacgctacagtaaacattctctaattatggattaattaggcttaaaaaaattgtctcgtgaattagcttttatttatgtaattagttttgtaagtagtctatatttaatactctaaattagtgtctaaagacagggactaaagttaagtccctggatccaaacaccacctcagttgctcgatataacaaggactcatacaatgtactaacatgtgtacttacagtagccgagtagcctaacatctgaatgcaactttgccgaacacctgaacattttcttcagagtagctgggtgtcatggagctcttacttcttgcaccagtaaattgtactacagtatttactactaacaaattcagatggattagctcgaagtttcattcagaaggagcaacctgttaaacttgggcagtgacaagagtgattgtccatttgtccttaccttctctgacagaatccatgatgcagaagttatctcaagagagaacagtttacttgattcacgtcttcgccacttcagctccagagctcctagcctgatctcttcgagaaccgggcattttagtttcagaaaaggccgtcagatatcacgggcgtcgtgcgatgtgctcctggagtttatttggtccacatgataaaagacagtgttgtcatggagttaacaacgaaccggtgttattttgtctcgtttgctacaaacatgttagattgtttgctgtttgggagttccttgcggaagtgtctgcatttcagagtccccccatcatcaggacacctccccctttaccatttactcctccggcaaggattgcagagattttgcagctatatgtgtatcacacctcaacaactagaatgcgagattttttgctcaaaactagaagactaatacgtctgaagaaacatcttactacaaaagttacgtaaaactccgacgctctagacacgcctaacagcagcgagattcacctgcaccatagagatgcatttgataggataatggtaaaaagtgtacggtttcaactctggtgtctcgtgatcaatttccaatatatatgttcacaatgttttcttaaaaaaaaagtttggagggatgtctctttatcctaatcttgtttttttccccacctccacctacaccgtgataaggacctatctctttgtaaaatcatgaaatttggctagcttggtctttagccggtctagcaaaaataagaaccatttttttcacctgcaccatgataaggacctatctctttgtaaataatcctaatcttaatgaaatttggctagcttggtctttagccggtctagcaaaaataagaaccattgttaggatttgtgtataaaaattgatatattttaagatagatagtacatttaaaccaaaaatacaacccataattttaacgctatgtcatgtacttcctccgtttcacaatgtaagacattttagcattgctcatatacatatagatgttaatgaatttaaacacatagtctatatgtatatgagcaatgctataaagtattacattatgaaacggagggagtagaaaaaacttgatatatcaagtgagctaataagaagagaaggaagacttagatcacacgcaaatcctacctcgtgcgcttagtacaagacatgatgaaatagggatatcattaaattagcctaatcctcctttcatattataaaccgcttaacattttttctagtcaaactaccaaatttatagaaaaaattagaacattttgtaacaccaaattagtttcattaaatttaacattgaatatattttgatagtatgtttgttttgtgttgaaaatactactacattttttctataaacttgatcaaacttaaaaaagtttgattaggaaaaaagtcaaacaacttgtaatatgaaacggaaagagtattaattaggacaattgagtcttgtttatgtaaatacacacgtaccctacctatagatggttgaaattttacatttggccgtctttaaaacttatttgaagaatgaatctcgcaaaaaaaaattaaaaagatgccaaccttattgttgtcatctttggtactgaagtacaacttagcgttgtatacttggcgctgggaacattgctatatggtcacgcagttcatatcactaggggctcaggccttgttcttttctctaacaaaagttggatgaaaatttagatattcatggcacgctttttaaactgctaaacggtatgtttcgtacgaaaactttctatatgaaagttgctgtaaaatatcagataaatctatttttcaagtttgtaataattaaaactcaattaatcacacgctaatacaacctcgttttacgtaaaacactttatcttcatctacaacacaaaaaaacaccacctcagtgccatgtttaagtaaacaatagagttattgtggtgtggtagtgtggtgtccacccttctctgcttgagggtgccatgtttgactcgggaagcaataaagacttaatatattcattattctttactacattcgttctaaattagtggtcgctttgactttttacttacaatgtttgaccatttgtcttatttgaaaaattagtgcaaatacaaaaaatgataagtcatacttaaaatattttttaataaagcgagttacaaacaaaataaataatagtttcataatttttttgaataagacgaatgatcaaacattacaaacaaaaactcaaagcgacaagtattttgggatggagttagtacttttttttaacgcaagaaggtagagcgctctaccttatagtcatttcatttatagaaatgaggtttagggttacaagattattagttaagagagaggtagggagaagaaggaataaaaaagagtgaagtggaaaaagagttatagaggttaaggaagaaagaaaaaaacgggggaaaagaaagaatttacagaagcataaacattaggctgttgtttaggacagtctttcacaccatgatcgaattttgtgtctagtgtcttcattacttcgtacacaccagagatttagggaatcacagatctgttgcatgataccctggagattgtccatctgtctgtcaaaaatcatgttgttgcgtgatttccacagagagtaagcgcagactgcaaatcagattggtatcaccctttgtgttgtttcctgtcaatggctgcttggatgaaatcagagattgtttctgctttgtttgccagatgcaagagtcctagttttctccagagattgtcggtatttttgcatcttaggatgatgtgatcagctgtctcaagagcaaggcaaacagggcagtgggggtcatcattccactttttgctgaccatattggcttcagtatttaacctatccttgaaaaccagccataagaatgccagctgaggctgtgtttactgtttagttcagcgtaaaatttggattttggttgaaattggagatgatgtgactgaaaagttgtgtgtgtatgacaggttgatgtgatgaaaaatgactgaagtttggatccaaactttgggtctaaacacagcctgaatttatatgggtctacacgataccacagaattgcagagttagtactttttaagtagctttccctcttagagacgtggatgctccaacagttgaaccagcgacgctggtatggcatgaaggtcatctaaccactaggctacttgtcatattgcaggcaatgaagcacattagattgctcacactgaatcatgccgacctggattctgtgccagtacgttagagctgttagggccagagtacataatgctgaagtacactttagcgtgagggttcattttttttcgttgaagaatgtcaaaatttcacaccatgtttagttgtaaattttttttttcaaactttcaatttttccatcacatcaaaactttcctacacacataaatttccaactttttcatcagatcgttccaattttaacgtgaactaaacacacctagttaagacggtgtcttcgcactagaaccatagtagtaatttctctgtttcacaatgtaaaactttctaatattatccatatttatatatctagatgaatatactagaaagtcttgctatatatgaaaataaaatggagggagcggtacgtagctgttgacttgagtacacttgacttgggctttgaacaaaatgttgccccgatgtcgctgtggctcatccggcccaagcccatttccccacccctctccgccgcgaagacaccgtcgtgctcgtgccaagccaactcctcgtcttcggctcttcgcccgcctggtgcccgcgcggactcggtctcggtcagtccagtccacgcccgcggcggcgagtcggcgcccgcgatggactcgaggccccgggaagcccctgcccccgccgagccttccggcggcgcggccccggctgcggcgaacggcgaggtggagatcacgaagccccgcaacgacaagcgcgggtaccgccgcgtcgtgctccccaacgccctcgagtgcctcgtcatcagcgaccccgacaccgataaggtcttcctgcttcgctcgctccttcgatcgggatgggccgccggggtttggtatctctctggttttttggcttgaaccccgacttgtttgtttgcttgcaggcggcggcgtcgatgaacgtctcggtaggctacttctgcgaccccgaggggctccctgggcttgcacacttccttggtgagcttcctgttt

SEQ ID NO: 14777 - DNA, 9753 bp, Oryza sativa
tctcggtaggctacttctgcgaccccgaggggctccctgggcttgcacacttccttggtgagcttcctgttttgacttgttgcataaaacgtgagaaattggtaatcgtggatgtgtgattttagttgtagttagctgcttcccttaaatggttatgaatatacaggatgttggtgacgataatcttagtgcagtcaggccttggtgcttaatacccttgatctctctatcatctctatgcacttatgttgcgtcaggcctgcttaggctaccactacattctgcggtttttacaagaaggttgttttaggctgtgcactgtggctggcactgttctaatacgtgtatgcgcttttagttgtttaattgctgaattggtcatgtaaagaggaagaaggtcgaaatttggatatctatatttttctcagagcccatcaagtaaaaaatgtgcaagtaaaaaatacttctaagtccacagacagcagcatgcttctttttcatttttgggtaacatcaatagctgtaaaaatacatgcaacacatctcaaaataaattttccaaatcatactgagtatctctggatgagaagattaaaacaaatatagcatggccaggaaaacacacgaatggctgaatcacatgtacaacatcaattcaacactactatctcctgataggtgctgtcacaatatctagctaataagcggcccattccttgaaaagtttatgagttgcataataacgtttggaactaaccatttacttgataaatctgcaaagatgtcaaagtccatatgtgaaagggcattaagagaaaaaaaacagttgggccttaaaatgacttatgtgaaattcacatgccattaaaggatcaaaggtaccagcaatgccatttgtgactgaaaactgttatactaatactgtaatacattataaatgctaatgtgggttcattatattgcctctgtactgaaatggatgacgtatattattagaaagttcatttcagcaccagagtgctttggacatcttatttgtatactgagggtgatataaaaatatagtgtggcaatgccatccgattaaaaaattaatttcttaaccagtcattctaactttttttctcgggcaggccaagtattgtttcaagcatgttatttggatacttaaggtgaccaatagaaatataatgttccactgttatccaatcagaaaattaatttacttactagtcattgtaactatttttttctcggtcaggtaaagtaagcacaactttcttgcgtgtcatgctatcactgtgcttagtctatgtttaatttggctgttgtatattgctctctttataatttctagtgtgtccctttaaagagtattaattcataaagaaccactcttcaaacctcattgttttttttttaaatcttggttgggttgtagtattgcatgtgaaaagcttcatggcacatgtattgcagtaataacatgtgtgtagctctgtattgtttgattcccttatgcctggatcctcttttacagagcatatgcttttctatgctagcgagaaatatcctatagaagacagttactcaaagtatattgcagaggtatgtattttgccaggcagatctacttacctattctgttaatttaaaaagtatctttctaactgatcttgatattactgtggtcaataatttgtttgatcgaacttaaattgatctcaaaacttagtgaaaatgcttgagaacaatttgttcaggagagtgtcaactgaacttcagcatactgtaggctttgcaaaatgtctagtccacgcccaatttactttggcaatgtctagagacttgcaccacattttggaggtacttggctagtgccgttagagtgtttcagtatttgtaaagctaatctagtttatgtttgatcatgggttgctgcccttttttccctagattaccagttggtcgcaatataatagacacgtgtacttgttagtgaactcatatatttgatgttgcaagtctgttgcggcgcaccagtgctttcggtggcagagtgagtggtcgaacactaatgtgcacgagtggcttaatccagatgggaccaatttgaagcttaataagtaaaatgccttaaatacaattacttatcatatagactgtacaatcattgggtgggccaacgttggccgcaatgaagctttgtcccttgcagtgcttgaagccttgaaccatgatttccctcccacatgttatgctgctactggaattctgcaagcagagattgatccctttaattattaactgtgctaattagaaaaccatctgtctagcctctgatgcagttggtaggagccataattattcataaatttgtataaataatatcatggtctttatgtttttcctctatgtttgaatcatcaattgtgtgatatgggttttcttttagcatggtggttcaaggaacgccttcacatctcgtgaacacacaaactttttttttgatgtgaacaatgattgcctggatgatgctttggataggtaacttctacttctttctttccttacacctttgttttttactttgcaactctgtttcatttccttcacatttgtcgttttaggtttgcacaatttttcataaatccactgatgtcacctgatgcaattcttagggaagttaatgctgttgactctggtatacattgctttctctcttatctggaactgccatttttgctgagagaattaacttctaatctctttcttttctttctttgtctgcagaaaaccagaaaaacttactgacagatattttgcgaatgagtcaggtacctttatgtccaaaaaacatcattaatcttttctgttatagctgaatagtaatatggtatcatattcatatcatattttgatctattttattgttttcatttattttaccatgttctttcatgctataattccattgtctatattcttttggttcagctccagaaacatatttgcttggagagccatccatatcacaagtttagcactggtgtgtgttatagtcataatttcattttttttagtgtctgattctatataccacaattggatgttgcaactatacggcatgcttggtaccaaggtgtccaagtttctaccttcattttatagtcacaactcactactaacaaatactgcatgttgaagttatttcaagaatacgctttgtaatgctgcaaaaaatatccatgccatatgaacttatgattctaaatttttagctagttgaatcatggatggaaaaaaaaacatactgttcttccaagaaaaaaataagactgtgtgtgtaaactggacaagcccatttctgttatggtattctcaatctacatgatggattcacttcttttgtggtctattctatcacccaaggcttgcgcacaccttttcttgaagatctgttgtattgcatgtgggccatgaggatcatttgattaaaaaaatgctttcacaaatgaaacagtagcatatgaaggacacagaaacacatggaattgtgctcttgtgggacaaatgtttcattttcccccttcacatttgaattggcccatgcaaccaggctaatacaacttggcatctacctagcctgtcacaacaccttacatatcccttctttgatttggtggtgaggcgtggtgtttattggatttggtgaaaattgtggtagctagctcttaagatcaggggaatgcactgagtagtgcgttcacaaaaagttatttttgaggggaagcgcgttcttgggagtgcgctccggtgcataaccaacctcgacaaccttgtgtcaatgatattgtttcttgtacctttttgtcctcaatcttaataacaatggccatcccaacaacaatttgaacaccaagtactttggtatttcttatactttgaaaataatttatgcctgccctatgattttactttacttattgaccatatgaaaatgatttctgcagatttcccattgtaacttgaaaatacttcaataataatattttttttacaagaacttgtaagtttgtactaagaattttatgttatgtactagtatgaaaagccattggtcaaaggtgtaaattggagactatgttgaacagttgaagcataacaaacttattgagcctggacagggaatatttacaccttaaaaccattttagatgttttctctgaaatcaaaatctatggaagttttaacttgaatgaaatacgggacgataggcctgattggaactgctggatgcggctgcacagccgcaacaaagagctatgctggctactgtttctgtatagaagccgcagcggcagccggcaagcagttacgagcaggccctatgtttacatgcttcaaaggttgaacaattatttttttcactaatattctgatcatctattgttttaggaaatcggaacactttactggttaatccaaataaggaaggattggacatattggaagagcttattacattttatagttcacactattcagccaacttgatgcaacttgttgtgtatgggaaaggttttttctttatcaaactggttacaccattcttttcatttctgtacaaattcttcaatttttatatattttttccttatatctgttgtgtaacttgtgtatgcagagagtcttgacaaccttcaaacccttgttgaaaataagttctctgatgtcaggaatactggaaggaaacggttttccttttatggtcatccatgttcaagtgaacatctccaggttgatattttccatttgctaaagataggttcaaaagtcaagtgcaccactcggtgattttttctgaaatgtaaggttacttggacatgtttaattatggaaattgatgacttgcaggtcctagttaaagcagttcccataaaacaaggccacacgttgagaatactgtggccaatcaccccaaatatccagcattataaggaaggtccttgcaagtatgtgagtcatttagttggccatgaaggaaaggggtctctgttttatgtactaaaaaaattaggtaaattctatatgagaagtttaacttcttttctggtgggtcggtttggggctttttggctggcctgggctatttgacgtaacatgagtacacaatcctctatttctatgcaacttgcttcaaaatattatgttaatatggatatcggaccttattgtcagcttactataggattgtactggcagtctgacttttgtcacttttgtcgcttattactattgtttaggtcgatgaagttgaagtgtttaagcatgataacacaatttaattcaagaatgccactttcaattctgttatgtgattaactgattcagagtctacccatctttcggggtgatatgtgttgagctggttcttggcctgatccactatccaaatgcatctaattagtcttattttgcttttcccattgagatgccattttacagttgattactaatgtttttgtagtgcacatgtacagatgcctgtttttgttatgcatatgttttcatgtggtgtcattttcacctaatttatctctgtgcacttccttcttccctgctttcatatgctccctctgtccctaaatatttgacgccgttgacttttttaaacatgtttgactgttcgtcttattcaaaaaatttaagtgctccctctgatccataatataaggcacaactactttttatagatgtttcataatataaggcgtgcatgcatgtatgcaattagttagtatcttttctccattaaattatgatttttttaagtcctccaccatcaagatctctaattctattgggtgcatgcatgttatttattagggtgatacaaattaggaggtgataataattgtttcttggtctttggagtaagggtggttgtgccttatattttggaacggagggagtaattattaattcttttcctatcatttgattcattgttaaatatacctttatgtatacatatagttttacatatttcacaaaagtttttgaataatacgaacggtcaaacatgtttaaaaaagtcaacgacgtcaaatatttagggacggagggagtataagcaaaaaatctggagatgaaattcattttctttcagttaatgtttcattctaggatatttaggtactaccctcatcccaaaataagttcattttgcatccatcttacccataccaatacaaaactaagaagactagaatacccctactttatcaaatcccaatgcaactattccttactagttactttatctactcccaatactattatttttctactttcacaaattctgacgcattgattactctaaaaatgaacttatttttaggagaaatggaaggagctaaaaatgaacttattatgggacggagaaagtataacaacaatatcatctttaggtggtgtattgataattcataccaccttcaaatgggtgccttttatatgtacagccaaaccttaaaaacttttgtaactaatatacaaaatgctattaatatttattatgtaaaaatgtcattaggaaaagccaaactaatgttcccttggaacaagcaaacaatacacaataaagaaaaggaaaaattccccatttcatccgtcaactatgtccttggtctgattttggtcgctcaactctcaaaaccatccacatttcatccctgtgcctaaaccgggacaattttcagtgatgtggcacctatgtggagtctacataggcaaataatgaaaaatttcaccataataatcaaaagtaaacaatagaaaaagaaaatactagaacccatatatttgttttttaatttgccaactatgatgcatgtggtggcacatcaaactatagatagccataaggcccgcccgacctaggcatgggctaggcacggcccgaggcgatcgggctggcacggcacggtcgggtcgtgtcgtgcctgcccacgggctgcacctcaggcccaggcacggcccaccagcagtcgggccgtgccgtgccggcccgaaggcatgggcggcccatcgtgtcttctttgaaataagtctatttcccctccctcctttgggctgtgacatatatatagctaaaataagtttattttacgtccctactatttaggccgtgccatataatacgtctatttttcctccctattctttgtgccatgccttacatatggttgaaaatacgtctgtttcgcatccctgaactttgtgccgggccgtgccggcccagcgtgccgaggtagcagcccaggcacgacacgactgtccagccgggccggcacgggcacgacctgagtcgggctgggccaaatcaccgggccttgggccgggccgtcgggccatatggccatctatacatcaaaccctgttgggcccatggatgaaatgtggagggttttgagagttggggatgaaaatcagaccgatgccatagttaagggaccaaatatggacttttaactaaagtaaagctcaagaaaattcttttgaacaaaccatgaaagcactaataggaaatccaaatatttggttttactgctatataatttcctttgtttatgttagttttgaatgctttattattcttcaggaaagacaagatttggttttgctgctatatagtttcctgtatttatattatttttacatggtttacttgctcattcttcaccgagtaaaatctaatctataatcttttgtagtgcttgctgtgtttaactttgtattctataaattcctcaggatgggctatgagtttgagagcaggggaaggtgattggagttctgtgttttcgttcttcagtgttgttatacggctcacagatgtaggccatggtgagtttcattccagaagggcctttttatactcaagatttatgatgcatgtaatatttacctatttcatatcattgatggtagaacatatggaggacattattggactgttgttcagatatataacactgcttcagacctctggaactcctaaatggatttttgacgaggtgaactatggttttggattttttttttttttggaaatactgtcacaacgaccaaaattgattgtcacctcagtttgagccttgcaaattcttctggcgctgatagtgctactttgaaatttgaataatcaggctgttacacacgacagaatgaagtcgttagattggataattgttttggtcaggatacatgtatttttatgtccaattcgttgtaattgggtcagtacttttacttgagcttccgctatccctctgtgaatggcattttagggagctacctttttcttatttaattaaatagttctttacgttttgaagatgaatcatgaaacatgaatatgtgagcatatcgtcctaaattgctcgtatgttttttctgtgtgctgcatgtattaggttccacattaattggctgttagaagttaggacaaaatgtagatggttcaggagagaagtttactgtctaaaacaacttatataaaagaactggaggagtacttgtgcatgttctattgttgatcctactagcaaatttcttctgcttgcaatatacttgcactgcttcctttactatgcaaacaaagcattaatgcttccttaaaagggtttattttgtataactagtatattattattgcttggaatttgtataatttcccaactggtaaatgataaggactaagtcaatgtgtttttgagacattataatgatgcacataatgtccattttgcatagcacacagctaactacttcactctgttttgattgtcaagcttctaactatccgtgagacaggattccactaccgagacaagagtcctcctagccaatatgttgtcaatatttcctcaaacatgcaggtatatgttgtcaatatttcctgtacagtattccacctttatttctcttagaagtttgaattgagggcagagagaaggcatctctgtgcttatataagaaattgacttgttcaaaatcttactacctagatatttgacggatatgacttttgattagtcatgtgagtgctcatgcaaaaatcaagaatggacattgtctttcattctgccatcaatctgcaccttatattatattttgtcagtgacaagtttgtacgaggaagaatcttgtgcaaaactatcttcttgtgatactttaaggccctattgcttgatgactcctatgaattgttggataagacttggttgaatccctagggatgtttttttttttttgcggggagaattcctagggatgtgtgggtgggatttgagaatatgcactgtattccaccagataactcccttctctctacaatttgtcactgaataagtccatatcgcatgactgcagtatgtttcaaggtggttgatgtggcttctaagagtaagagaccaatgtggtgaatgcctgggccccagcttggcaatctctagtcatagcctttggatacttgtattctctagcattagtgggatcagggacgagaagggagaaccagagaagtaactgaggaaaaaggggatcctggcagtgacgatgcagtggtgcatggttcttgggtaatgagaaggctctaggtctaggcttctgtgtagcttatgattccttcatgattcttgttatggtgtgacaaaaaaaaatctgagctttggaagacccccaaag

SEQ ID NO: 14778 - DNA, 1385 bp, Oryza sativa
  unsure (1)..(1385): unsure at all n locations
nnnnnnnnnnnnnnnnnnnnnnnnnnnnnnnnnnnnnnnnnnnnnnnnnnnnnnaagaaggtaggggcatttttgaaaaatgtgacaaccgtcttgagtgatctttggaggatacttttattcgttgcacaaaatgaaattaacaagaaggttagacatcaaattttattgaacaatgaaatggccagttccacctaataaattctgccagaatgttcattcataaattacaaaatgagttctgctcagtatcatcgtctcatgacttttcctaatctccctctattacagatctttccgccggaagattggctgattgcatcgtctgtgccatcaaagttttcaccagatgctattcagagtatattaaatgacttgactccagataaagttaggtaggttttaagtaagtatggcccatataaggtttttttctgctatgtttacagtttgagataccagtcatgtttttttttatttgtttttagtgttcagcatatgttagttacacaggtatattatatgtattttagtaagttatactctgttttttgttttcatttcagatcagtatgaaaccatgaacatacttaaaatgtattctatttgacagtaatcttatgcatttaatgttatcaaacagaactggggactagctactgtgagttgattgttcatttcagcagtaacagtataatgcatgctattattgttgctcttcaattaccgcatgtagtgtctggaaaataattattcaggctttgcacttagctgttgcttcagattcttcgacttaacctattgtaagacactatataactcttctagaaggatgacacaacaaagagaactttcgctttacataaatttcaagttttttcctacgaaaaagtggaggaaatttcatcactagtccatttgcattttttactgttataattccaaaaaacagcaagaggctcctcacgaagttgatcctatcacaaccatctccttttttcctttcacgcacttgatgtatgtatttgtttagttttatttcattgtgcttttacttaaaggcattaatacttacgtagtatcgattgtcttctacatttactttcagaatattctgggagtcaaaaaagtttgaagggcagacgaacttaacagagccatggtatggtacatcgtattcagttgaagcagtccctccttccatcatacaggtgtacatgtaatttggatgttactcttcctatcatattttccaatctatgtgtttggaggtggacacgttcctaacataatttgtacagaactgggtaaatagagctnnnnnnnnnnnnnnnnnnnnnnnnnnnnnnnnnnnnnnnnnnnnnnnnnnnnnnnnnnnnnnnnnn

SEQ ID NO: 14779 - DNA, 483 bp, Oryza sativa
atgatgtacccatcaagtgctgcccaagtgggtgttcctaggcaatctcctcaattgaagccttcgtcagccagagcaacaggtgcacctgctggtgtggcttcccctggtgcttcaccctctaatttgattgtgatgaagagtggtctccatcagcaacaagctaaggctcctatgcagtctctctttacctcaaaccaccaaccccagagttcatcaaagatgggtcctgtcactaatatgtctactggaggaggggatttgtcaagatcttcaaatgctcccgttgcttctggttcaccatccaattcagtctccaaaagtactggtggcagcccaccggcttctggaagtgcaaagggtgttccaccagctgtccaattgccgtcacctcaacaacaatcagccaagaatccagcatcgacgtctggagccaagtcagctcccacaaatcactatagtagtatgcctatgccatcgatc

SEQ ID NO: 14780 - DNA, 7524 bp, Oryza sativa
  unsure (1)..(7524): unsure at all n locations
tgctctccctatgctctacttccatgtctatttccacaactgcaatgctaactgatccagtgaatgttcttgcagctgcagccagcaataacatgaagactcatcatcctcccgctggcagttttatgcatcttgccgcagcatctcagtctccgagcggtgtgcctcactctcatatgtcagcggcacaattgacttttggggccccaatgtcaatgtctgtaaaaccatcaagtgatcagaagcctgctgctggtaatggacttgctcttttcttcacatcttctatttcttccctgtataagctcaaatgtttcctccatgaaacaagcctgctgtgaattctttttcctaattgaaacatccgtcttatcaggcaagtaagatgtcgatgctcggacttcaagacgctactctggacttgcgagctaactgcttaatctgaatatgcgcgaacggagctacgcctcttggaccccagaagaaacagatcgcagcaccagccacaggcgcaagagcctgtttgctgctgttaatcgaagaggacggcgcgcccattcctttgctggatcatttgctaactgaagtattggnnnnnnnnnnnnnnnnnnnnnnnnnnnnnnnnnnnnnnnatcctctcatgatggaaagctggaggtgcatagaatctctttttagcagttttatgcatggatgtcaaaagctggtctctttctccctctcccaactgctttagctttgttctttttgttgttctcttaactgaagcaaaatttaattagaatgcaggacaaggtaacttttgtgatgtggtggtgttcctctttccctctatattcctcaccattctctgcttggattgttttagcaattgggagaagaaacatattatcccatagatgagccatgatttgattgggttggaggggggtggcatggcatggcatgacctgccttttcggttgtgttgtgttgtaattagctttgaaagagaagtgagaaatgaactgatgaaaagaaaaatcaaggttgaaaattcctggtctattatgtcatcagtctctgcaatgctaatccgaaagtgaggtgtggttgcttgcatttgttaacttctgtggatggacaatcttctactagtactatcttgatggatatcgcattttaaagctctagctgagcacacgtgtctggactgaacaccattcaacgtgcaggctgaaaagtataacaccagggggcttcactttcttggcacaagcatcggtgttgccaccttcactaaatttcagagagattgtggggctgtgtgttctcatatcatcctgaagcccttgtcttagatccattgatcccagttggtgacatgtcattaatttgccttgccggattttttgaatgcctaccacaagtagcttttgctccatgagctttccagcactcatcagcattggcaatggattctatcctactctagagaaaatcctatggatgcacacacattcacatacacaaacattgtggtccctatcaaacatgcaaattgtctttttgatggaggaggacaaagtttgttggttcgcctttgtttagaatgctctctctgtcattgacgtaacaagcgaagctgttccctgcaagttaccgattcccctgcaaatgctgattctgttactaatgttgacgtagatctaattatccgtagcatgtgttgagaaggtgtatctttttcgtgcccgagtcgtttacctgcccatatgacccatttggtcaggctcttgtttttcatacggcgactaatggcaaacaagttgagtagataagttagtcattgtaaacaatttgggttgttactttccaattttttcccctcgtggatgtgaggttgccggctattgccgtcatcactgacgctcaacggaccgaaatcggtacaccaagcttttgcttggtattacagtggattatataagtgatcctttggtctaactgtttttaagacaatgggatatcgtttggtgtaaccatctttagacattgtagtgtttgacggacatttttttttctttcaatctaagttacaatcaataaatattttgggaagaaggtgacgatgcattacaagttgttccgacaaaatttatttagagtgcttctaatgcatttgtaacctttgtttctacttcctccatttcagattacaagactttccacattcatataaatgttaattaatctagacacaaatagattcattaacatctatattaatgtgggcaatactaggaagtcttataatctgaaacgaaggtagtatcatttaaaacttatcctaaaatataacaacttgtatacatacttctacatctcaatctattacaatcatctcgattttagtttttctagttccttacttattgtttatgagaaattttagaaataattgtattttgagacggatggagagggagtaggtgatttctagatggccagagttggtgttcatttttttactaaaagactgaagatgaagttagggcccgaaaaaaaaatcattagtgcctgattagtgagttttaattattataaacttaaaatatatatatttgatattttaaagcaacttctatagaaaattttagcacggaatgtatcctttaacattttcaaacactctcgcatgctaactaaaactaataaaaaaaaagaatatagcctagactactttacccccggtttaccgcacacctggaacgccgagatcacgcaaccttgcgccagcgccgctactacaaaaaggccgcgccgcgtctgtaatccgatcgaccaacgcgcgcgagagacggacaaacaccagctgctgcaaccgcgcggagcatagcgagagctttagccgagtcgacgccgccgacgatccgcttccactccacctgccaccaccgcccgtcgaccgcgccccgcaagagacctcttcgccgtcgcctcgcgcccacgacgtgcgcgcgccgcgcggtccggtcatcgccgccgcctcttcaccgatcgatacggcgcagccgcgatcgattcccgcgcgagcgcgtactacaacgtggtacgttacgtcccgtccgcgctcctccccgcgtgtgctccgcgcggcaaaacgccgggacgcccgcttcgcccaaccaccacccacaaaatccccaagcatcggagagttttgacggacactggactggatccgaccaaacaacgggagcaaccaatccaatccagcaagtaataatccgtactagtttggtaggagtacttgagtactgacatgacgccacagattcacagctgcattcattgtccacagtgtcaatcaacccccaaatccttcacaactccaccggtaatggtaaagaagcagcacagctactggccgaggctgactctactgttccatcatttttcctactctctccgtcatcaaaaagaaaaaaaaaaaggacaaaccctgatttccgtgtccaacatttgaccgtccgtcttatttgaaaaaattataaaaaaaattaaaaagacaagtcacgcataaaatattaatcatgttttatcatctaacaacaatgaaaatgcgaattataaaaaaattttatataagaaggacagataaagttggacacgaaaaatcagattttactttttttttttttttgacggagtgagtactgcagagccagcgaaatgacaccactgccaccactaccaacacgagttgcacgaaacgagagcaaactcgctggggcccacccgtgcccaacctgggccccaccatcagtgacctgacatgaggctgacccgcccccatcgcttccagatggcgccaactccgaaagaacaaacaaccatagctgggccaccactgatcagagctgaccaccttttggccccacatcacgggggaagggccccaccctccagcataacgtacgcatcggatcctccaacggtgggggcccaccggcatggggcggtgtccccaccctgcagggacagattccagtgagatgagatcgacaaccgtggcctcactctgccggcgatgtccgagcgcactgaccactgttccttcccgccggcgagcggtcgcgagtcagctcagctcagtctcagtcgctgagagctgagcagagctgacccaaagagggcggcagcaatttcacctgtgctccggtcactgtagcattggccttttggcaccaggcagcagtgacttgcagtaggagtagctgggtaccattggtccggttgtggtgttgtcattgctggcctctggtttgagacaggatattcatgacaggggctaaagcgtactacggccccgtgatgtgtgttactcctactcctactactagtactagttggagtagcttctccttcaatactgtcaatgcatgacgagtacagtacggcatgtactattcatattaaaaatttatgaaaaagtttaaaaaaatagtcacacataaaatactattcatattttattatcaaatgacaacaaaaatattaattataaaaatttttcaaataagacgagtagtcaaacgttgaagatgaatatagcaaagctgcacttatttgggaatgaaggaagtacaaccaaagccatacttagagaactcatcttccaatgaagaatacctctgatgggttcttcaaaatctgaggccatttgataaagatactctagcccacaaagggtatcccggcccaaggtagcctcaagtgagaaaatacccctccccactgcccatcagcccaccaacgccaaggtttacattaccgtcggtaaccgcacggttatcgcggttaccagccttaccgagggagtacggtaatagaaaaaccatggtaacctccttaaattcaaatgaatttaaaaaataatttaaatttttgataaattttgcacgatttttcacggttaccgcgcggtaaccgtgcttaccgctggggcgcggtaaccccgggccttgcggtttgggaaaacctgaccgacgctgctcctatctcttcctctcctcttctcgtctcttccgcccaccatttcctgcgctgatttttctccctctctccgccggtgctccgtttcctcctcttctcgtcgccttatacctcgtcggtgccggatccactctccccacgccctctctctctctctggtcactgcctctctctctctcttgcaatgctcgatggcaagcggcgtcggcggggtcatctctctcgccaccgcccgtcgtcaccgcctctctttcccgtcgccgctgatggagagcggcgcgcgggtcgaggttgttagaataattgggctaggcccaatttattctattaaatctcaaaggcccataataaatgttaaggataataataccacctcaggatttaagcgagaaatatcttaacctaaatagggagttattagaggctccctgttgaccagttgaggtgggggtgggaatgccacacgcgctcgcgcgcgcgcaccggcccggggcgtgggcgtgggcgtgggctaggcgtggcgtggctggcggtgtgctggcggcgggcgtgcgtcacgtcgctcttttgcagccactaacccacgttcccacgattccctccgcaacagcgcgtccacgttctttctcctgatagaaaaggaggccgcgagtctgatccgatttcttagctgcttccccggtgttagtttctcccctgtgcctgagttgctctctcccttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctggcggaggtggtgcgccgccgccgacaggagctggatccggagctggtgcgccgccgccgacaggagctggatccggagctggtgcgccaggaggaggtgccgtgaacgactacaacaacggaggcaattctgcctcaccatccagcggagggccattctcggggtataatcttctcctcctactactgttgttagcgctatactgtgtgagctatgttcttgttcctgttctacatgatgcctctagcatgttatcgcattactggtatgttcctgtttctgacattcatgatgcgcatagtatgctactggttatgttaagatcaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattatggttgacagcgatgcagtgcttctatgtttcacggggcaaacgaagtgaaccacctctctctcctgaggaagaggctaagttcgaggcttcggattgcctgttccgtggagcattgatcagtgtactcgctgacaacatagtggacgtgtacatgcacatgccttctgggaaggacatgtgggatgcacttgaggctaagttcggagtttctgacgctggcagtgagctgtatgtcatggagcagttctatgactataagatggtcgatgaccgttctgtagtagaacaagctcatgagattcagatgctggctaaggaacttgagaacaacaactgtgagttgccagacaagtttgtggcgggtggcattattgccaaactgccaccttcttggtcggactttgccacttctctaaagcacaagagacaagagttcagtgttcctgatctcattggctctttgggtgttgaggagaaggcgagggcaaaggacgtgcggggcaaaaaggttgagggaggttctagtgccaatatggtacagaagaagaaccctcatgcatcccacaacaacaagaaagtcaagcctgatgtcaaacccaaagctgcaaccaattttaagaagaaaggcaagggaaaggcaaaaggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgt

SEQ ID NO: 14781 - DNA, 294 bp, Oryza sativa
aagaaggggtcggcccgttccgatgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttgcggagcggacgaggaagtgggaggaggaagataggcaggagcgccgtgaaggcaagaccccggggctcccgccggcaaccggcgaggtga

SEQ ID NO: 14782 - DNA, 460 bp, Oryza sativa
  unsure (1)..(460): unsure at all n locations
nnnnnnnnnnnnnnnnnnnnnnnnnnnnnnnnnnntttacgcttccgcttgttaaactctgaattgtatcaacttttggtgtaccttgcctcctgggacaaggattaatgcacgcacgtcaggaaagcccgttgggttatttccggtcgtgacacgtactctaactgagatggtgaatgccatgttagacactgcggggctttcgaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagtcaaaaagcggaaactttgaccaaaaannnnnnnnnnnnnnnnnnnnnnnnnnnnnnnnnnnnnnnnnnnnnnnnnnnnnnnnnnnnnnnnn

SEQ ID NO: 14783 - DNA, 704 bp, Oryza sativa
  unsure (1)..(704): unsure at all n locations
cagagctacacacatgttattactgcaatacatgtgccatgaagcttttcacatgcaatactacaacccaaccaagatttaaaaaaaaaacaatgaggtttgaagagtggttctttatgaattaatactctttaaagggacacactagaaattataaagagagcaatatacaacagccaaattaaacatagactaagcacagtgatagcatgacacgcaagaaagttgtgcttactttacctgaccgagaaaaaaatagttacaatgactagtaagtaaattaattttctgattggataacagtggaacattatatttctattgttcaccttaagtatccaaataagatgcttgaaacaatacttggcctgcccgagaaaaaaagttagaatgactggtaagtaaattaattttctaatcggatggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatgnnnnnnnnnnnnnnnnnnnnnnnnnnnnnnnnnnnnnnnnnnnnnnnnnnnnnnnnnnnnnnnn

SEQ ID NO: 14784 - DNA, 2701 bp, Oryza sativa
gacccactaggctcatgctatacgtaaatgaagtgcatttctcaaaccaaagattgacaatttgccctacaccttcatatgagtttcgaacgtatgagttttacaaaacttccatagaaattagatcaattatcataaatatcctctcaaaccaaagattgacaattttcctacacttctacccttgtgactcctttggaactatgaattttacagaacttggaatttctcaggctgtcaaatactagtattttcagtactgaaccacggccaatcttgtgtgatatttgtcttgtggcattatctgatggacaggtacactacagagaaacgtgtactgttttaatacaagcagtactatcaagtcttcagaattaggcaggtcagcaatatggcatgcatccatgagggcaggcaatagactgatagagggtgccccccttgtttctcctccaattcaatgaactttgggacaggagtacaggaccatgatccagaagatgaattattcaatggcaaaattaaaaggctactctgcatttaatctgctaccaccctaaccttaccaccttacccttctgcctttgatgcttatctgaatctccttttgcagcctgaatataaaacactcctacctttgcaaagatgtaggttaacttgttaagtcactttatcaggattgtgcgtgttccttaactgtctgtcacttttgactcatattcagacactcattttaatgccaactttcagtgaccacaaaaactgtctattctaaataatgtagcccacttatagaattatggataaacaattgttgtggatcatttgatttgataaggtatcatcaccactttctagtagtagtttagaccacagtttttttgcatgtgtctttgttcatttctacagaataccatatgccatgccaaaagtatcatgaaatgacacataaagggagaaaagaaatatcaccttagaaccccaaataatcagatatatgatgaccaaatcttctccacaagttatccatggatggagatggacccctttgtcctgctccagcaagacgagctggcagtagcaagtgagaatattagtatcaggtagcatgtggtgaccatcctttgctctacacaacacacacaaattgttgccggcaaaagaggtttcttaaattttctataaaggtggccgttcctgtgacgatcaaatcattttttgtgtgtcatttctgctttttttttctttacctcaaaaaacactacagttagcaacaagaaagtaggagacagaaacaacatctcatgtttgtatgcagtgtgaggctgccaaatgccaaccgagtaggatcaagtggtatgatgggaggatcaatcgacaataatagtgcgggatcaattgaattagtagttggcaaatacagttgctggcatgtctgtaccttcgatacaacctccaattattctactgccactagtagagatggatcatggatgtccacttcataggtgtcatgtgccagcaggctcttcaggacagagttccagctcctgatttgggtcatgtgattcacagcttaggcacaatgctttttgcagtcctgctttatgcctaattaactaacagtaagaacatagcaatctctaaagatatgaaaattcaatcctgctttggcttgttggatcatggtgtacaggaatatatctctttggcagatgccatggtgagtaaactaggccgcatcagggaagcaaatgtgtagcagattgcacctgatcatcctaacaagagaccctcttttatcatccaaaaaatgtaatcttttctttccaagacaaaaggcaaccctctaaattctcaagctaggaagttacacacagctctggcatatccacagatgacccagatgcatttcagtttcttgcctacatagctatacttcatattattgcatacaaaaagaaccaaagcaatgtacactctatactctatggaatttacacggcaagaaagcatttcaggcatcaacagcatttagggttacagattttgttcttgggagatttgttggcagctgagctcctgtgtagtaactcctagctgtaaacatgagatctggactgctctgtgcatcaacctcacaatgccgggccctttgggctcctggatcggggtgccggctatggtacgctagattaaaaatgtcagggtcctcctcagcgtctctagcgcctgggcttcgctcgcaggtcggtatgcggaaattgtgattcttaccaatatgaaaagactgtaacttgttcagtgaagacttcatcctcctttctccattcaagttgtcaaagtccagagatggatgaatagctctccttagatgtgccattttccgtgctttgtatttggccatctttacttcatgcttcatgtcgaacccttttgcttggaggctagtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacc

SEQ ID NO: 14785 - DNA, 1435 bp, Oryza sativa
agtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacctcgagcagcagatgacatgtaggcataaagtgaaccacatgacgatacatttgatccgcagttatggcagtatgtagtgtcttgagattcctctatgcctgggccaggcctccaatctggcaccagtgcactaacctcgccatcaatcatctcagcaattcgagtaacctcatggtcagttatatctagctcggctaccatctcagttgcaacactcaatgcggtatcggcctctatgtcaaaaggaaaatagatgttccgtacatgccctgcaaagtgagaaattagatatcaagaataatacaatttggcatttttttggtgcactgaatttaacccaagaatttaaggaattgaacatttgtgcataccatcattatctgcaatccgtaatctgaggaatatgcttccatcctcactttttctccctttgattgtgatatccacattgccaagaggctcatcttcatgcccattgaacaagtcaataccatcagctttaatgtcatcatcttcacaatcccatctatcttccgttggtgtatcctcgtcaatgctttcagataatccattactcatcatggagacattactataagcgtgttctaaataaggctgccgcagatagttcatcaggctgtaatctccatcacccggacaaaagaccaaatcgtcaacctgcaggaatgggtccttgagcagctctctcgctgagagcctccgggatgcagtggccaggcatttctcgacgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttac

SEQ ID NO: 14786 - DNA, 789 bp, Oryza sativa
  unsure (1)..(789): unsure at all n locations
agctcaagaaggacctcgacgcgggggaggcgcagctgcatcagctcaagatcgcccaggaagaggactgccgccccaagcgtcgccgcgtttgccgcaaccagaagatcaccgcccgcaagagcacctccaggcccggctggttcgtcagtccctggcgtggacctgctttgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggcttgcgcgtgtgtttttcctcgtttgtcttcttgagttgtgtggggcatagttatgccggtgtgtggcataactgtgtcggagcctgtcttattttatttgcctaagcaacttgaacattaatgaaccaatttaatagcagtaataaattcaagaattatagtagtcgtgggtggttagttttaatcgtcagctctctctctctgtttgctggttctgtgtggggttttcagatggtgacgaccaggagaaccgctgtcaccggtgatggcaatcaacctgaaggcagcaaccacaaccaccagggcaacccaccttcaccttcttcttcgncttcgncaccaccaccagacaccaacgccattctcacccaaatcctcgctcagcaagccaacatgatgactgctttcctccaccacctccaaaatccgccacaacagaatgcttcaccaccaccttcccaacactctaaactcgccgag

SEQ ID NO: 14787 - DNA, 1457 bp, Oryza sativa
  unsure (1)..(1457): unsure at all n locations
tttgacccccaagacgccggcggccgcttggagcagcaatccagcaggtgatcgccccttcgtttcgcgaagggggagcggatctgggcctggccgacggcgccggcgccggaacaggagcggagctgagcgtcgaggctcctaggccgcttcgcccgcctaggggcgtccgctgtctgcgctcgggtggccgtttttcgcttccccatcaaactgacccgccgccggcggcagaggggatcggccggagcccggaaagggaatgggttaatttggtgtgttgtttcgggcgacagcgacgcaacacggcgcagcgtgacgaatcagtacccgtacgcaaccaatttatgcccacaccttttagcctagtactccgattcgtcgtatagtactccgattcgggccttgatccagcgggctggctatctcggggagaggaagtcggacttagcgcctagcggggctatgaccaggccagcacgggccggtccgatgtaagccgtaccatcctgacacttgggccaaaatcaagattcgtttggttgggccggtatttcgacccatttcgctcagcccctgcgacgccgcgcgccccgtcctactgcaaaacgcgtccgctcctagctgcgatgcaagccaaccagcgagcgtagtacgcccgtatgcgaggagaggacggcgaaggttgcggcgaccaacaaggtccagtttagttcttaattttttcttcaaacttttaactttgtcatcacatcaaaacttttttacacacataaatttctaacatttttctttaaacttttaattttagttaaactttcaattttaacgtggaactaaacacagcccaactccccaaacctaaaaacccaaacccaacccaagtacccaaccaccccgaggttgacaaacaaaccattgcacgcgaccccgcccggaccgatggaaaaccacccgccacccgatcgaaccacggcatatcctcgcgcccgcggctcacgcacgcacgcacccacacacgtgtggccgatggtcaaccaaaccatccctggctgctctcgcacgcgaaccacacgagtcatccatccaannnnnnnnnnnnnnnnnnnnnnnnnnnnnnnnnnnnnnnaacactgatgatacattgatactgcttctacaatatgcacaactttactttttctcgtcgtcttcttttcttttcctttttttcttgatatgttcttgctttttgtatgtacaaagccactggcacgcgtggcccattgaccccggcgatcaccaaccgagcgttacatgtgccgttcctttttcgaaaagtaaaggagagtgacaaccaaaggaaaaaaaaaaaaactcgcttcctagctcgcagtgtcggtgagacacatccgagctaagcgagagagaggaggagctcatcggcttatgcacgccatttccgtggctcaaaacgt

SEQ ID NO: 14788 - DNA, 1066 bp, Oryza sativa
  unsure (1)..(1066): unsure at all n locations
aatgttcgttgctgttgctggcttgctgcatagtgccttgcttgttggttgctcgctaagttgctatttgccggttgaatgaaaatatgaaattggatgagccggctagcggcctggtgctcggagaagatgagacgtccagactcgagacgaattgagcaagtcaaagatacgaaaagatgagacgtccagactcggggctcggagtcgagaatatgaagcaccacgcacccgaagtcaccgcgcggagacacgcgctgactcaaacgggcttctgacactctagccccacgcgaatacacgagccttctttggttgggatgatttttttaggccctgaaaatttggaggtcctgcacggtcgcacgggccgcacgccgttgtgcacggctctgcatggtagtagtaactagtaagggcttgtttagataaaaaaaattagctaaaaacgttacatcaaatgtttggacacatgcatagagcattaaatatgggaaaagaaaaaaaaacaattacacagtttgcatgtaaattacgagacgaatcttttaagcctaattacgtcataatttgacaatgtgatgctacagtaaacatttactaatgatggattaattaggattaataaattcttatcgcggtttacaggtggaatctataatttgttttgttattagtctatatttaatactttaaatatgcacttaaaaataattttggccaaagaactaagcacggcctatgtcgtaaaataaatcaacgtaggtactattctgattcgctgtattgccagctagcattgttaccaccgttatggacttattatggtaaatttggttaggggcatttgcaaatttgccaccggttttttgaatattgcaaggataccactcgaatgacagttctagtggcatttttgcaattttctagtggcagttttgcaataataattcaaagtagtggtaaatttgcaattgcccctgttcggaagcatcacagccgcatgtcctaagattgattaggcatgnnnnnnnnnnnnnnnnnnnnnnnnnnnnnnnnnnnnnnn

SEQ ID NO: 14789 - DNA, 1829 bp, Oryza sativa
ccttctgaatgaaacttcgagctaatccatctgaatttgctagtagtaaatactgtagtacaatttactggtgcaagaagtaagagctccatgacacccagctactctgaagaaaatgttcaggtgttcggcaaagttgcattcagatgttaggctactcggctactgtaagtacacatgttagtacattgtatgagtccttgttatatcgagcaactgaggtggtgtttggatccagggacttaactttagtccctgtctttagacactaatttagagtattaaatatagactacttacaaaactaattacataaataaaagctaattcacgagacaatttttttaagcctaattaatccataattagagaatgtttactgtagcgtcacataggctaatcatggattagttaggctcaatagattcgtctcgcgaattagttcaagattatggatgggttttattaatagtctacgtttaatatttataattaatattcaaacatccgatgtgatagggacttaaaagttctagtcccatctaaacagggcctgagcataggggacaaacaaagggcctgttcactttgatgccatttccaaccttaccaaattttggtaaagttgccaaaaaaatggctatatttagtttgctgccaaattttggtaactatataagaaatcttgccaaaattttggtaagttgccaaaattttggtatagttgccaaaatttcggcaatgctaaaatttggtaagattttttttggcatcaaagtgaacaggtccaaacatagccagatcaggtcactgagcataggagtccttgttatatggtgcaggccggcctgacggacaggtcggggggcattacacctgtcagttcaagttcaagtaagggtctgctcactttgctgccaaaaaaaactttaccaaaattttggcaggatttcttatatagttattaaaatttggcagcaaactaaatgtagccacttttttggcaactttactaaaatttggtaaggttgaaaatggcaccaaagtgaacagcccctaagttgatcgctagtgacatactgacatggcagtcttggcagctttgcattgtggaccaaacgccgccccgcattttatctgcagctttttctctgaaaattgttgatcgtactgacgccttcaataattgtgtcccgcgatgattattttggagtactcctacatcatattcagactcgtacggcttgatctgccatacatgctgttatccaaatagattaataactcctcggagccatggtccaatggattaggataagtttagtttgagaccaaaagttaacaaaagcaaaatgagtttaatctcactggttaggtttcttggatgaaagtagctcgagttctagacttaacataagtttcttggatgaaagtagttcgagttctagacttaacataacatgtgcgtttatatttatgactgattattgttttgatgataaacaacgtatcgacaacaagacacttatgataatttcgtaaatcttagtaatgcatgaaaaatggagacacctataataactttgtgaatcttaaaatatactattcttgaaggtgtttatatgaatatggtaagcatgtgtattgagtgtggtgtactacgataaactgaaaactgttacaggcacgtgttgtagcagcatacgattgttcaatcgattgatctaatctgagatgaaacccacaattccaaagtccaaaacattaggtgacaaccggcagagatcctcaaattgcagcaattccacaggatcatactagtttaatta

SEQ ID NO: 14790 - DNA, 735 bp, Oryza sativa
  unsure (1)..(735): unsure at all n locations
gactgtggttcatgcactattgtaaatggatataacaaggtttttgtattcaatgcagcatgttcaggagctgctttggtatatcagatttggattatggtgggtcatactaggggtggcttcatccattgggttaggtaagctcgtacgtgcaagttgaatttagcttagtgaaatggtgtgaacaagcttcaattggttgagtaaaatattgaccaaacatctaaacatttagtattataacttatacaagaagtatggttctgaaggcattgtcatttgtttttcaggctctggtttgcacacatttgtattgtatttagggcctcatattgccctttttacaatcaaggcagttcattgcggtcggactgatttaaagagtgctccttatgatactattctccttaaaatgagaccttcatggttggagaaagactgtctagaatttggaccgccaatgtaccaggaaacaattccatttagcaaaatactgcatgaagttcaccttgaagctgttctctggggcattggaactgcacttggagaacttcctccatatttcctctcgagagcaggttgcgtcttactgctttgctgctatagcaccacttgatcatatgcttttcacatgctcacagcctcacaatatgtccctttttatcttcaatattaatcannnnnnnnnnnnnnnnnnnnnnnnnnnnnnnnnnnnnnnnnnnnnnnnnnnnnnnn

SEQ ID NO: 14791 - DNA, 357 bp, Oryza sativa
  unsure (1)..(357): unsure at all n locations
nnnnnnnnnnnnnnnnnnnnnnnnnnnnnnnnnnnnnnnnnnnnnnnnnnnnnnnnnnnnnnnnnnactgttaagttgaacttccacctaggaaatgagctacaccagaccacaacttaacaatggactatgccttgaattgtaagttttgtgtgatcaggtttcactcagaaccttgactggtactgggctgccgttcgcatcccctctgtttggagcatataagttaagctccaggcctttcatgagtatctagagattgcccaaatctcatagactgtgactagcagtcgaactcatataggtgtgttccttctgagatgttctgcaggtcaacatctctgggtaccgagctcg

SEQ ID NO: 14792 - DNA, 1453 bp, Oryza sativa
  unsure (1)..(1453): unsure at all n locations
nnnnnnnnnnnnnnnnnnnnnnnnnnnnnnnnnnnnnnnnnnnnnnnnnnnnnnnnnattattgttttgatttatgtttaggttcttcctgatgacatccgtcaagcattgctcgttattgttgaatgctgcatgaagcgtgattatttagcagcaatggaccaatacatcaagctggccattggcaatgcaccatggcctattggtgtcactatggttggtatccacgagcgttcggcccgagaaaagatctacacaaacagtgtggcgcacattatgaacgatgagaccactcgcaagtaccttcagtcaatcaagaggcttatgaccctttgccagcgacgttatcctgctctgccctcaaaatcggtggagttcaacagcctggcaaatgggagtgacctgcaggcccttttgtcagaggagaaagatccaggaaaccctcctagcgaggataggcttcgactcatgccagcgtcaaaagagtgatgcttcaacgcacaagcttggatcacaaatagaatatttgtaatctgtgtaatgtgtaaaccaaattttcctgctcttattttcatttttgtactcttgcaagaatctgagaatattgcctgctaatcaaattactgaagaaaggaatatactgtctgcttctcttctagaagagttcactggctaaggttccatgtgtaagtttggttgaataaaaccattctaatgtctttgctgtgcaacaaaggtgtatgctggcaaacttattagattcatcaggttggttaagaaccaaatagtcgaaaaaaaaacttcctgtatttattacatgaaagagaagaatctacgaagcacgtgcttgagatgtgcaccaagattatgtggccagttacaacttggatttttcctgaacctgcctagtagctcactgctgcctggtactcgtgcccattaatttcgtttgccttgttttgcaggtgtagttcagcagctatccctgcctcgcttctgctggattctgggtaagtgagcccactgcatcagcaacaaatgatattttgcttatcatatgaagggatttttggcgcgaatggattgttttgcctaattcttacgtttttagcagctgtgctgaatgcttgtttgtgggtgatgttaggctccatgcttttgatcctctttatctcttccctgacaacaaaaaggaatgttaatacttccatcacctctcaagtctcacctgaatatcgaggggggacatttatataagaatattcagagccatgtatgctctaggtgatgctctgcaattggccctcagtctagctatgatcacagtatatactcattttgtttttctgggctattacttgacgaaacagttgtaggcagacggcgtccgctgctttcttcctggcgctgcagaaatgtttcaagaacatgcttaattagcccatcatgatcg

SEQ ID NO: 14793 - DNA, 2287 bp, Oryza sativa
gcttgggccaacgccgcaccccccctgggcgtgcagggttggccgggggctaccacatgcatatacttaccttttttttcttccgtattacaataaaagcattttcgatttcttgaggactgtgtctgggccatcgttttcttttgaagaatcttggcttaaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcttggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgtagaaatttcctctttacttgattgcagattaaatcagtctatacaagaagggggcccgaaggcctcggaagaagaaggaaaagttattaagattggcgggggcctgggggctcactccgacgcgcccgggtcgtcggcctcgtcgtcgctgtcgtccgcatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcgaccgccccgccgctgtgcgctctcgcgtccagctccttcgcccgcgcctcgagctcagcggcccgctgatccagtgcggccctctcggcgcgggcgctttccatattgcggcgcgcctgctcctcccgcgctgcctcgcggaggaacaggctgtccgccagccgctgcgccgcgggctcggcctcctcgagagctcgcccccgctcggtgagcgcgtcctcgcggaggcggagtgcggactcctcttcggcgcaggcggcctcgtgcgccgccagtgttgcctcccgggtggcgacggcgacctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcgtcgagcttctcctctagctccgccgcccggctcccgtattggaggcggaggtcgtcccgcgcctcgtcgagcacgtcggtggcgatgagggcagtctcccgctcctcctccacctccctggcgatctccgccaggtccctacgacgggcctcgagctgtgagacgtgccggcagtgtgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggcgcgcccgcggcctcgtcgtgggtggccttggaagtcatcgtcgcctcgggcggagtcgggtcgggggtttggcaggccgcctagcgtgcgcgcgccgcctctgcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggccggacttggaatggcgggggggggggcgcgacgggatctcgctgaggcagaagaaaaaccagaagacaaaaagaaacgggtgagtgaaaactcgccttgggagatgggagaatgaata

SEQ ID NO: 14794 - DNA, 1394 bp, Oryza sativa
gaaggtaatcgccgaacaccatggcccccgtgagcccctgggatcgcagacccgccaggcggtcaagaacggcgtcgtagccgtctcccagatctaccgccgcccgccagctaaagtcatgcgccgggggctggctcagaagtcggaggcgcgcttcgtcggcgaggggggtgtagaaccaatcgctcttcaagtcgtcccactttttgcggaggacgcagggaatgtaccggttcagcacgtgcccccgcgtctggaagtagcagccaccgactgccgtcggcggcgacactgtctgtacggtgaagaacccccggaacagccggagaaatgggcgcaccccgataaacatctcgcacaggtgcacgaagatgcccaacgtcattatcgcgttgggggtgaggtgcgccatctagagatcataaaactccagaatatccatgaaaaaaatagagaatggcgggaccagcccctccattgcgaaagagagaaagaagacggaccgccccgggtagtgtggcgccgggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttcctcggcgtctttacacccttgccaacgctatgcccggctcctcgcttcccgcgcccactacctcgccccctcgtttcgcgcgcccacgcctccactaaccccactcgcccgtttgcggcgcatgcggcagatgtgcggccgtggcggttgagatgggcagatcgtgcgcgcattaactacgcccgccaaccgtgaaatgcgccatcatcatgtctccaggcgaaacgaaccggctcgtcccgattcgcacgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgtccgagcgcttccctcgaggggggcgatcgccctggcgtaacgccgggggctactgtcggtgacatggggccgggggtatcgtgactatagaggcttgggtagccgcggtcacccacgtggcctgcccccctcggggggggaaggggtcgggcccgagggtgacgtggccacccctccctctgtctccccgaggggtc

SEQ ID NO: 14795 - DNA, 1865 bp, Oryza sativa
  unsure (1)..(1865): unsure at all n locations
nnnnnnnnnnnnnnnnnnnnnnnnnnnnnnnnnnnnnnagagtaataattttgaatcttacagtaacattctctatggaataacggatggagtaatttcctatactattgtaaaaactactttttgtacactatacaaattaattcatgatattttctgatattataatggtctaatatttattttcgatcaagtgaataacatatatcaaataagcgcgggattttaccatagtaaagcatggtattttgctactccctccgtttttaatagatgacgccgttgactttttctcacatgtttgaccattcgtcttatttaaaaattttatgcaaatgtataagatataaatcacacttaaagtactatgagtaataaaacaactcataacaaaataaattataattacgtaaattttttgaataagaattatgtaaagtcccaagtgttcatatcatatggaatacgtacatatgtgcatgagttgtctgtgggtaactaccgtgtcatgtgtatacatctgcaataaattttaaaattagatagagaagtgcataatatggttgtcatgccattagtgtcgtgacacttattagtaattgactatggatatgcagagtgttgtaggctgtactatcaaccatcacgatttagctggtactattattaagcagcgcgggtgacctgttagtatattgtattatttgctggacaatgttgaaatatgctttgctagaatgtgacaccatctgactatcactattcgtgactactggtgcgcgttatgaaccaccaaataattagggttttaaatctcccattgtatgtagctgccactatcttccgctatagttgtttgagaagctaaccgctaaatactttagcccgctatttaaaannnnnnnnnnnnnnnnnnnnnnnnnnnnnnnnnnnnnnnnnnnnnnnnnncggaccagtcagctttgaaattcgtttctaaattagtgagagccgagagcgtctacttgcagccatctgtctagcgattgcgttacctcttaccagctagggttaggcaaataaacaacttgcctctaataagactggattacttcctttcttcagcagctttcccacccttctattttaacgattgttggtagactgatgtacggaataccaatgcaactccagcgagttactcctagggaaagaaaaacttcgggtgtgtttagttcacgttaaaattgaaggtttggttgaaattaaaatgatgtgacgcggaaaagttggaagtttatatgtgtaagaaagttttgatgtgatagaaaagttagaagtttgaaaaaaaagtttggaactaaactcagcctttagcaggtcattgccagcttgctgaaaaaaaaatcagtacttccatgcatgcctaatcaatcttaggacatgcggctgtgatgcttccgaacaggggcaattgcaaatttaccactactttgaattattattgcaaaactgccactagaaaattgcaaaaatgccactagaactgtcattcgagtggtatccttgcaatattcaaaaaaccggtggcaaatttgcaaatgcccctaaccaaatttaccataataagtccataacggtggtaacaatgctagctggcaatacagcgaatcagaatagtacctacgttgatttattttacgacataggccgtgcttagttctttggccaaaattatttttaagtgcatatttaaagtattaaatatagactaataacaaaacaaattatagattccacctgtaaaccgcgataagaatttnnnnnnnnnnnnnnnnnnnnnnnnnnnnnnnnnnnnnnnnnnnnnnnnnnnnnnnnnnnnnnnn

SEQ ID NO: 14796 - DNA, 3799 bp, Oryza sativa
  unsure (1)..(3799): unsure at all n locations
nnnnnnnnnnnnnnnnnnnnnnnnnnnnnnnnnnnnnnnnnnnnnnnnnnnnnnnnncagcaagccagcaacagcaacgaacattctccgttttcagttagatggtttctgattacaaaacaagagttaaaaaatgtactatttttaatatatcgcatttggtctacagtatatacattattttatttatatttggtacttaatttaagcctcacttagacctttgtacatagccttcaaatttgacggcccagtcctgctaccaagtagctagtagctagctaggcggctactagctgctgcgtggctactggtgtccgcccggcgtggcgaatccggtggctggggtcctaccacgaggccgtcgttcaggcatgccgatgttgatacccccacagcgcgaggcagcgcagcgatgacacgacgagcgcggctcgcgggcgcagcagcgcgcgcggtgtttcggggcggggaagggtgcgtgcgcgacggggcagcgcacatgcgggcctcgtggccacgctgccccaccccacagccaagccccccacccccgggtcgcgtggcggtacacgccccccgtacggagatccggaaagctcgtacgggcggggaacgcccacccacccaccccgagaagacgaagaaaaaaaaataaaacagccgcgactgcgacgtctcgatcgtgtgcgcgtggggagaaaaagcaacgcaaaaaataaaaaaaaaggcggccccgcgacgcgacgtgtccggtgccctcccggcgtttgacgcggcaacctcccgcatcgggccccggcccggcacccaccgggagcctttcgccgagccaacgagccaacgcagcgtacgcacggcacgcgcacgcgcggcgcgttgcaggatttctcggttgatgacgggggaaaaggtgcggtggtgtggtgcctttgcttggtgaaagatgggttggttatctggagctacaagtgataagggggtactgtagcagatgatgttaaacaccggcgtatggtgttcggaagtagcggagttctgcatcagcaaaagctaaagccttgccagttttaatttgccaccacgatctgttttcttgagctgttggtgattgaaaggttgggagtccttattacaaacgtaaatgctcaaaacacacgtacatttatccttataaacatatttaaaaaacggatcattatattttgagattaacaaaatcatcacaaatatctcgatatcaatacgtatatcgcatattaccgaagaaataattagccgtaaatatgagcattcgtaccaattctaatatttaaactcgggccggtgtacgtattatatcacaataaacctagccatttgacgacaagtccttctggtatacgtcgtgcgataatcagcgtatgccattcgcgtggtgtcgtatatctgtactgattccatctttgctgatggttaaggctatatttgattcagcttattagttgagctatttcatcatgtttttcaatgtacattatgtaatgaatttatatttgtgagttccgtaaataaataaatgtatctctcaagtttgtactccgtaatagtgaagtacttaattaattatgttctaatgacccatattatttcacgagcttaaggcttcgttcgttgagcttttcgacaacacgtgaatcaagataagctattaacatatagttaatcgagtgttgattactaaaatatttatttaatttttaagaaacttatatatttgttcatacaaaatacaccgcttaacagtttggtagcatatgcacgtaaaaaacgataaggtaaagttggaaaattgtaatctatataaacacagccttacacactagaaaattgatttatcacaaaaaaatatatggcatcaatactaaaatcatgacaatagatacatattaccaccatttttaaatcgctgttatccgtgataataaatatagtgctaataggttgttgtaacgatttatatttagtggtaacaaatttggatattggcacaaaatgatgtggcaaaaaaaatcgtattgcaacacttcacatcgttgcaataaataattattgtcactaattcacctgtgtaccaattctgttagaaaatacatatatttccatttgtgcctacctaactgagattagaattatggatttgagtatctaaagatttcaaatgaaaaaattgtcacatataaaattgtagattttatcgatagctataatttttatataaaatttgtctcaatcagtgtccatatgaaaaaaagtaagttaaattatgagataacaaatttttttgttggaacaaatttattgatcgtgggggatctagagtcgactgcaggcaaaaaatagtaaaaaaagtaacttaccacaaccatgtgttatgcaaattaccacaaaaattaaaacggtggcgatagaacatgttttttttttgcaacactaatggttttttgacgataactcatttcctattgcaacaaaaatattgaataaaacaacgatcgtaaatcgttgcaacaaaatatggttatttgctaaagaaatatcattgtaatagtataatatatcttcacaaattagttttcgttatagtaatttaatagtaatacctcaattatcaagttttcaccgaacagttgagagaagagatggacttgtggaccagagtagaggagattctggccgggtggctggagccttccttctcctccgaactttctcaccgactaaacgtctgaacctcgttgtcaccgagtcgcgtcaaaacatttaccagcgctaggttccaacttccagtataccgcccacattgacaaaagaaatcacccccgtccagaaccttccacggtgaaaaaaaaaaagaagtcgtactccgcctcataaaaaatcaatctatattaaatgtggcatattttaatactattacgaatataaaattatatttctaatcgtagtattataatatatcacatatatattaggttggtttttagggatcgatggagtactctatatcaaataagcagcaaaagaaaaaatcgccaaaagatggtaacagtgacgcacaattttcgttgtgtgttgacaacggactctggaactgaagttattttaacaagggactagggactgaagaatgcaaggcaaacttttgagagtaatccttacacggcatgatatattattgatgtagtggcttcatatgcgtttcccgtttttttagctggaaaaaacgcaatgaacaggaactgaagcatgccacatgaggacataaggataaggaacaacatggcaacttggctcacaagtgatcaggaaaaatattataaactgcattttttttaatttgagttattctctctgcccctctcatagtctcatgcatgcgcaagggataaaattttctgcccaaaaggaaaggcaaacaagatttgtttagctccatttcatgttaactaaagtctgaacctttgtaaggtctggacctcccattttattttttaatttaaacataactagcaagtctttactactccaaaaaacttacagaatttaccaagtggaaaacattacaattagtttatcgaggttcataatagatttctgatcatatacatggaggtgatatttttcactctgttcagtcagtaggtacctctgggaaggcggaaaaaaatgtgaaatgttaattgtgatcgcaactagatactctatccgtcccaaataagttaatctagtacgtgatgtggcatatcgtagtccgggt

SEQ ID NO: 14797 - DNA, 3084 bp, Oryza sativa
  unsure (1)..(3084): unsure at all n locations
ctttactactccaaaaaacttacagaatttaccaagtggaaaacattacaattagtttatcgaggttcataatagatttctgatcatatacatggaggtgatatttttcactctgttagtcagtaggtacctttgggaaggcggaaaaaaatgtgaaatgttaattgtgatcgcaactagatactctatccgtcccaaataagttaatctaatacgtgatgtggcatatcgtagtccgatccagattcgcaatattagaatatgtcacatttcgtattatattaatttattttggaacgaaaaggagtatgtttggattgttttttttcctctcaaaagaaaaaggattttgcatttgaattgtttagcttgtataggagtgtcggtgacatggggccgggggtatcgtgactagaggcttgggtagccgcggtcacccacgtggcctgcccccctcgggggggggggggggtcgggcccaagggtnacgtggccacccttcctcctgtctccccgaggggtcgggccgctcctgtttcggccccgagggctggggcaccccgaccccctgtggttttggcgccacgtgtgtgggttaggtgagcacaccgggctcacctacccgcatttatagcaggttggacgagcgcgccacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctgattgtaaaaagcatgtttcccttcttaggcagcaggaggcccatgtggtgaccccggaccagataaaaaggaggcccaggcctagaaaaagaaaggagaggaggagaaaggaggggagtggggactctggcgaatgggttctagagcctgaactctctctcgctctccggctctctgtattccttcacgcacagatccaccagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcaaggaggtataaaccaaaaatgaggcaagcacaaatcaaaattgttgaacatgggccataactacctttacagatgcatatacattgcatcgatttgtatggttatgaatggaccaccatgtaccctcatgtcccaagtgtgcttgctgggggaagcatagcatttagaacggtttcgaaatcaagaggcagacaaatgaagtgagctctccaactcagcacaaggcaggttttttctttgttggtacgtacaggacaagagggacaacaagaaaggacccacaataatttatactctatgggttttcatgaccgatttcgcaactagattttctttgttattaataggtgtcctttcatacaaaagaagataaaaatgcaacattgatgacatagttgcttccatctttaaaactattattacttttaagggtgcacttgtctttatcttctggttaaacaaaaattgccataaattgcacatcctgcttaaaaaactatatcataatttttgctggctacttttttccaagtgtttttgaccaattatataaaaacatgtacacacaaaataatacgaatgcatgaaaaatatccttttaacatcagcttaatggctcctttggaacgcatcagcttaatggctcctttaaattcaagtgtcttgttatcttaaatcctacagatagaaaaaaacacaaagaaacagtagaaatgatcatttggattgagtagaaaaaaaaacataggaatcaaacgagactgacagacacagaaattttttttcccaagaggtggcacctcatgttgataatccttcataattcctatgacttgacacaatctaaaagaatttaaaggaatttgagcaattattcctttgttccaaatggttacataggatccaatctatcaaattttttctcaaattcctttgttctaaaggggacagagttgaaggaaaaaaaacaaatccatataatcgagtaaaaattgtaatgcatatacgtgtggtcgcataggtgaaagttattagcattctaagggctcgtttggaatatatgattttcaaaatacgtaaatgaaaaatacaagattggaaggtcctaacacttcaaaccatatgaattgaaaaagttcaaaaaaaaactacaagaatgactgtttagatggagcacgggaaaagcgttggaatcaaaaagagagaagaataagcacaaatgattttttttttcaagaggttagaccttatgttaaaattccttcaaaatttctatgttttgggccaatccaaagaaattttgtaggatttttggatggctattcctttgatccaaagtaccacattggggattttttttaataggattgaagtcttccaaaaatccttaaaaccactttattccaaggagccttgctataacagtaaattgtttattgcaacacaaaccatacatatcttgcgttcgtacaaaaatatatgcacttgttttgctacgccgacaatcccagcctgaaaataatttgattgtcattgctaccacatgagggtgatcagccagcccagccctcccctccaattgaataatcaccaactaaccaacgaccatatcaagaatcccaagctcctgtcagcgttatannnnnnnnnnnnnnnnnnnnnnnnnnnnnnnnn

SEQ ID NO: 14798 - DNA, 422 bp, Oryza sativa
  unsure (1)..(422): unsure at all n locations
ctttttttttctttttttttttgcgtgtgtgtgattggttcttgaattgatctgatttgctgtggtgtggtggtgattactgattaggtataggcagaagcacatgagggtgaacatatgggcggtgaagcactggtgcaggcagattctgagtggattgctgtacttgcatagccatgatccacccatcatccaccgggacttgaagtgtgacaacatcttcgtgaatgggaaccagggggagtcaagatcggtgaccttggccttgccgccatcctccgcaagtcccacgccgtccactgcgtaggtaaggcgtctctgattggctagatagtgctactggattgtgctcgtgatnnnnnnnnnnnnnnnnnnnnnnnnnnnnnnnnnnnnnnnnnnnnnnnnnnnnnnnnnnnnnnnnn

SEQ ID NO: 14799 - DNA, 477 bp, Oryza sativa
acccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatgggtcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcggg

SEQ ID NO: 14800 - DNA, 641 bp, Oryza sativa
  unsure (1)..(641): unsure at all n locations
nnnnnnnnnnnnnnnnnnnnnnnnnnnnnnnnnnnnnnnnnnnnnnnnnnnnnnnnncctcgggaacaaggcgtcaagcttctcgtcgatgtccatgaaagcgagtgcggagcccactccgcctcacgcaccttggttggcaaggcctttcgccagggtttctattggccgacggctctcaacgatgcggtcgacctggtccggcggtgcaaggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaagggcatcactgcttggtttggggtgcctaaccgtatcattacggataacgggacccagttcactagtgagctattcggtgactactgcgaagacatgggcatcaagctctgctttggctcccccggccaccccagaagcaatggccaagtggagcgcgccaacgcggaaatcctcaagggcctcaaaaccaagaccttcaacat

SEQ ID NO: 14801 - DNA, 426 bp, Oryza sativa
ccaaaaatccgacaatcaagttgggacaagaaagtatagcgcctagacaaagcatctgcaatcatattatctttccctttcttgtgtttgataacataaggaaaagattcaataaattcaacccattttgcatgtctacgattcaaattattttgagagcgaagatatttaagcgattcgtgatcggagtgaataacaaattctttaggccacaaataatgacgccacgtctctaaggaacgtacaagagcatacaattccttatcatacgtgcaataattcaaaacaggaccatgcaacttctcgctaaagtatgcaacaggcttactatcttgcatcaacacaccttcaatgccaactccactagcatcacattctaactcaaaagtcttttcaaagtttggaagttgtaacaatagtgcgtgt

SEQ ID NO: 14802 - DNA, 5537 bp, Oryza sativa
  unsure (1)..(5537): unsure at all n locations
aaagcacacaagcaaaacatgctataagactactgaaataggaaacaaaactatttttaatggattctttgcatttttcttgatttactgagacttgaatggacttaaacggagctcggatgaattacttatgaattttaaaagataaactgtgtttttactaataaagaaaaagccttaatcactttattgcgcaataaagcccagggctaacgtcagcgaaaggggggcgccggcacgtgggccccacgggtcagcggctccaaagggagggaggtggcgcctggcaggtgggccccaccaggcggtagctcaaaggggaggcgagggaggcgccggccgggctcggctcggactcaaggccgaccggccgaccaaggtgaggcggcagcgaggcatggccaccgacggcggtgaccggcggtgcaagaagcggcggcgacggccgaaaggcggcggcgcatggccgaaggcgacggtggcggtcgaagacgacggcgcacgcgcggagggcggcggcgctcatgagagagagggaaggagggaggaaagggactcctcaccggacgagcggcggcgaccggagtggaggatggaagcgggggcgacggccgacgaacggacggcggacgggcggcggcaacacctaaagaaggggagggaggagttagggatggagaggacgaccgcgacgacccataatggccggccggagatggaaacaatggcgagctcaccggcggcgcgagggaatcggagctccggcggtgattcgcggcaacgaagcggcggtcgaggtgcgggcgggctcggtgagcgcgacggcggcgactgcgcggcgcggcggtggctatagtggcggcgggcgcgaccggagatgggcggcggcggcggagctcgggtgtgacagcgcgggcgcggtaagggatgtgggagaggaccgcaaatgggggaaacgagagaggggactcgggggagcgatttataggtgcgggagggggcggacgtggccggggaggtggccgaaaccgccggcgacgtggggtggagagagagagagagtggggtgggattcgaaatcgaatcccccctctcgagcgcgcgcgcggggcaggagcgacagggcgtgggcggcgtcgtggggaggacgcgggaacggcacggcgtgggcgcgggaggagcggaggaggtggggcggcagcggcggttgccggcgtggggcggcagctggaggaaggggacgacctgacaggtgggccccacctgtcagcgtcccgaaaagagggggaaggggaaacgggccggcccaaagaaggaggccgaacgcggctgggcgagctggattgggccgatggcccaagaaagaaaaagaggaaaagaaaagggaaaagggaaaaaaaaggaaaaaggaaaaaaaaggaaaaaggatttttcctgggattaaaatattgcgcttgcttatttttaattggttaaaattatttccaaggctctgaaaattccactaaaaatcttgttaatgcattggagcatggggaactcaagaaaaattccaccatgctatttccgattattaattgcatttattaattagggaattagctctaggttaattaagataatttcttcggacgatttatttagccaatttttaaagcaaggagagggggaaacttcagggcgtgacaaaattaccccttcagacccgaaaaccataaatttttcacgcctctttgagggtgttggcgagggcctccatctccaagttcttgcggcctatttcttcatccttagcccgaagacggttcttgaatccgtcaagacgggcccgcacggttcgttctgtcgaacaatgagccgcaagaatctggatgcaagataggagtaggcgaagagaacaaaatgtcaattatgagacatgtaaaaaaagaagagtggaaaatcaagaagagagaaaaagcatacccgaaccgccaagcttttaatagcggaacacccctcatcgaactcgttcagttcggtgaataggcttggggtgctggcaggcaagacaagattgcttactccctcgacaaagggaataaggtctgcccgggtcttgaaatcgccagaggcgaagtggggcgccgcaagggaatattccgaggcggatgtttcggcagccgcacccttccccttcgttttgaccataggcgaagcaaccggttgacgtggagggctgtcgaagatcctcgccgcagccgtcacgatccgttctgcggaagctgaaaccccggcggcggcgctaccacctgccccatcggcaccgagtgaaagaatgggggcggtcaaaaggtccaggctgcgcctagtgggcgaagtcggagtctcgtcggaagactcgtcgtcgctgaaaacgcgagcgatatcgatgagtcctccctttttggagatcttcttgaccggacctcccttcgccaccctgcctgacgaaaatgcaactagcgtcttcgccccctccaaatccttttgtcgaaggggggagctgttcgactccaccccggtctcgttgtgaactggacttggggtaggagtgtagccataggtgtcgacgcggtcttcggccgcctcgttcacggccttttcggcaacggcctccgcctcttcttcttcatccccttcctcctcctcgtcaggctcttcggcatcgtcctcgtcgtcggcgtcggaatcggaggaagcaggaacccttcgcttcctaggggcaagcttcacctgtccgcgcgttcgctttcgcgaaggtcctgtatcgtcatcggctttgtgggggttcgcccgaggaggcaattcgccgttgtaaacccggttcgcccggccggctgcctgtcgtgtcagcaactggctgtactcgacgaccgacacgtcgccgatcatcctatgggcttcggcttcagcttggtcgagtgtcaacactgcaaaagtaaagggtgtaaccgcgttgagcgtcaaacaaagcaaaataacaaagcgcaggagtgcatagcgaaagagcagtcttactattcgttccctcagggagaaccaacttcggcaaaccgtcagactctttgccttgatcaactgcgacttgccacgattgggagaggggaaagatgcgaagcatgcaaaattcctccaccaagtcgtggcagctaaggcgggagcaaaccttacgcagcagagcgaaccgcgcctccatagcgccgtccacggcgatcttgggtttccggttcggtgcgatcgccctgcgccggcaccggagggccttcgctgagtcggagccagcctcgaaggggatggtgtggtagaaccacctcgccatccaatggcgatcccacttcgacatggcggcgttcactggccagagatcgaatcgctcggggcgaacattaaagttcacgctcccaaacactgtcttcttcgtccctaccggggtaatcaccgtcttcgagttcacggtggcggacaatatggcaccgaagagttcggcgctaggctcgaatccggaagtccggtacgcccagtcgaagatagcgatccggaccagcgccgatgggctcaattgtgggagctccacctggaaaaggcgaaggatctccggcaacaacgcgttgcacggaaaccggagccccgcctcgaaaaacacggcgaacaccactgttcggttgtcgacgggcttcggtacaacggctttccccggggcgaaagcctgtccttcggctaacgccccagcactgaccaacttcgccaactcgtcgtcgtccatgagagaaatccccaaataagcagtggagtcgtcgtcgatccggccagggtcgggccctttcaccaaagaagggttaggcttgcggggagccatgacgaagggtgtatacagcggcaaacagtgtgtgcagtggcgaacaaagggagcgaacgaaaggtctaaagagccaaggagtgccaagagaagaagaacagaggaagagcgcgcgcggtgaaagtgactagcctagtagtaaaaagagaacgggggggggggagaatatatagctcacccggacgacggttcgcctacccaccagtaataaagcgccacgtgtcgcgagggtaggcgaaacggtaaattcccatcgaccgagctgcacagtaaaaagcccaattatggagaaggaaaagcccacgtggcccattactattcatagtaataaaagagactaaaatcccccccttcgacgctttgcagcagatgcgaagaggatattttctcaataaatttttctaagcataaaaacaaaacaagctttacttgcaggaatgatgtaggtttcggtaggagcaccagtcgaaagggggcgccacataccatattacatggtttgcacggtctcggccgaagctcctatctcacccttgcccgtgaggggcttgttggcgatatggcatgaggcctttcgaccaaacctgccgaaagcctgcgaccggcgaagattcaagcccgagacgttaggggtagtcaagacgaacctttcccatggcgaagactatggagcaaggatggcgagaggcaaggaatcgcagctaggctaaaggcttcctgggcgaagggcgcaaggcgaagagcatatgccgaaggggggggggcgacttcgccgtagcaggttcggccccggaagggccgaagaagctatcctggcccaccaagcctaggggtcaattgggtcggcaataatccgtcagcccactaagggcccatagaccgcaattacgttatatacccatgtaaatgtccctttcataagggcaatcatgtaaattcccctgtataaacaaagccctagtagaaagaacctgtaatggggctataaatagccctatagggccatgtaatagggggatccgagtaaaaaattctcaaattaatacactttgttttccaaccactgttgagtaaccacgtctttcgacctatgcggttgtcgtttcgacaacatacttaaaagacattgattttgaatttctaaattatgcactcctagacctccctgatctttgggttggcatataatatcccatcttataagcctatacttcttcttgtgctcatctccttgccaaaagaaacgtgatccataataatcaattttttgaagaactccttttggaatctaaaaaaaaatatcatcaatatagctaaactagagagcacagaattaatcaacactaacattcctcccacagacaaatgtttacctttccaactactaagtttcttttcaattctttcctcaattattttccagtccttgttactaagtttcctaaaatgcatcagaataccaagatatcttgtaggaaaactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14803 - DNA, 1359 bp, Oryza sativa
ccgctgcatttgtaatcttttctatttttgtaagacgtggatctgtatgtcaacaattatcgcttgtgtaccctggctggtcctggacagggatttaatgcacattcagcttagaaattctggttcgagaatttctgggcgtgacaaatttgtacttacccaattgggtatttggacttttccctatgcgatagtgaggttataggtgcaatattcctgttgttcgacaacacaactatatacaaagacctgatgataccagtaggttgcaacagttcattagaatgcacataaatgagtcaaatagctatagcttccaatgatcgatgcactctttgaaaatgaaaaaaaaaagataagaaaattaacatacagaatgaaagcaatggcaacgtaagaggattactgagtttttacacatggagtcagtatttgtggggtcaattgtagcaataaaaaaagctttgtaaatcaagaacctgattaattatcgattcaaccattcacagttacaacagtgggcaggatatttgttaattccattataaaaaaagggacatcacaaataacatggcagaagtagcacaccaaaacttacacgggacggtttcatgaaggcaaggaaaacatcaaaatgaaataaaatatcaaaacaaattagatagaaacttccaaacaccaggacatacaaacagtctgagatgaccggtcggccattaaaggaagtagtgaaattaccatagtggaaggtaagtgtcttcctcattctttgtttgaatcttgtgctccttgtgtcttttcttcctctttctcaggctcaggtactggcctttgaagcctgtctgccattgtctccatgcccaggtagcactgagaaaaccagactagtgtgagcggctctataccgctgcctaggctgacagcgtgcaggtaccccccgcatcggctagcggtgtagcagagcatctcaatccacacatctcgcaccattttctccaatgtagaatggtcgagcagctcctccatgaagaagatgagcgcgtcagcaagctcgcatgccttgggaatgaggggtcccacgcaatccccataaacccagcggtgtcgcgccgtgtgaaggattcctttggcgagctgctgtgccggctgcgctaaggtgatgctgtgcccgacgatgtcgctatacttcgccatgaatgtgatgtcatcacaggcattggcaaacaggtgcgatcgggtcccaggcatgagcatctctggctgcgatgtgaagaggtacatcatgtagcgggatatctccagaccaagaggcacagctgaatctaatgaggtgttgtcatcattgctggtccgggtctg

SEQ ID NO: 14804 - DNA, 7565 bp, Oryza sativa
aggtgcttgctagctgcaggatgatccttggctgagcctgggaggaacttcttcaaggccaactggcccctcatgcaattgaacctcctgtagcttgcagcactctttatgtacttggaccagccatagaaaatgacatgatgcttcactgcctcaaatatccgatccatggaaggtgtttgcttgatgtaccaccgctggttgacaagggcatcgcaatagatgcaagcggagagccagaggagacagttgggcttcttcgtcatccgtgcagcgcaccagatcacactctgctggtccaccatttggttcctcctgtcagtagccggccacaccgcaagcggaaaaaacaagcggcatagggtgacggaggagatcagctccagcagcgcagtactgaagaagaggatgtatgtcacggtgatatcatgtttgttgtacatgtctttgtggcttcttgcgtagaggccggctgcggtcgttgctagtaaaatggaaagcaaccggagccaagaggcaatgggcgtaatggtcaccctcaccctggtatatagccggatatatacatcaaagagcccagcacgaatcaccctataactgtaattagtgttgattgccatcagaaattggaggatcttgaggcgtttggaataggtgacaaaggcgtctgccatgaataactctggctgaagcacggactgcagccgacgcaaagttggtttactcaattgtccctgacgattcatgatctccttagccctctccacatactcgttgaggttgatgaggtcttcttcttcttcttcttcttcttctttttcctcctcctcctcctcctcttcctttttttggtggtctactactggttcgatggcagtttttacggtggacctttctaagttctcatggaattgcccaccttcctttctttctccttgtttgacggcttccgtttcgtcattgggttgcggccgctcacgaagttctcgagagaccacaaacattgtgactgtaggtataaagccagtagtgcatgacctccagtagtctgccaactgtcctccaccagatccaatcagcttcttccttcggggcacactaggagggtgccttgctatgcttcttataatggccctcttgagagcccagggcttggcacaaaacttgaggatgccaacaatgaacagaagaaccgcagctttcagaaggatcttcttacagaccaagccaaacagaacacatacatagcaaccgtgacttgggacaccaaggtgacgacttggcgccaccatagatagttgtcctggatgctgtaggaggctatcatatcttggccagagaggtgaatcaggaggatgggcgcccacagcacctccagctccgacgctgcaggagcctcatgcttgtgacggttgaagagggtggcaagggcgtagatcgccagggagtcaccgccgatgtatgcaagccagatgcatagcctgaaccacagcgagatacgatgccagcggacacctccatatataaagaggaacaactgtatcgtgttgcttccaaggacaaggatgcggagcttccaatcatcccaccaatccaaagcacttgagatacccataacttatgatgatatatttctctacatatatgtctagctagctacctctctaggttggaagcaagcttgctctcttgcttggagtatgtgggagtgttggtatgtcaatgaatatattggtcacacacacacacatatatatgttgttctactgtgtagcacaacagcttcttttcttattctttttggtgaataatgttcacactacagcttaaccaaacagattcatggcaacaagcttcaagatcaatccactgccaatggccccgtgtgtgcaaatattccaagatcaattaaaggggaaaagcatacggttttatcgaacacgctagaacgctagtcctagaaagaaaaaaaaaacttgaaccagcggggagatggaatctactgagggcaggtaatctagaagttgagacgactagctatcaacttcatgaacagtcactgcatatgttaaaacaacacaattgcacaaacataaccagtccaaatgagttggatgaaaacaagttaacatatataacatttaataccaacatgttaacatgacatttgatctgtactttcttgatctattctatttatccttgattaattcatgtgcccagagtagtttatttattttattttttttgcaaagagacgtatatttctataaaccccctttaattttggctatagcaacaggaaccaacaaatcaagagtatcggttgaaagaaccgatactaaaatgcataccaagtcaaaaaaaaaatatgggatgtgggatttaaactcaagatctttcatcttagccctcacgcgcgttaccatcccacctactctacatatccgacttgagtagatatgctttccttttgaactaactctataggcatatttagtaccggatgataacataaatctggactaaagatatttaggggactcggggcttttagaactggtactaaagagatctgtaccggtttttaatacatccagaatatttatggcttaggacatttggtaaaagatgagttctctgtagtagtgaaatgtcgccgacatttttgtaatcatcttccctcccttctgatttctgcccctagattcccgttcatgtttgtgtcttggtgcatctcagatttttcaattttttttgtcatgttttttttccatttataagcaatgtgccaatgtttggttgatgtgcatgaacatctggtgaaatatttcaaattgtttgagttcatgctgtgaatgtttggttggatatataatacccaatatgataatagtttgggcctgagatgaaagttcatgtccaatcaatcaaacatgagatgaatgagatttgaaatctgaggtgaacaaatattttatgcacaacgtacagtttgaatacaccatgtaaaaattgtggaatattaaatgttttgataaatgtgcaaacataaatatgtaaaatgatcatatattgaacaacgtttttaatgcgttgaacggctcactccagaggtaccaattttggtactccttaggtttcgttagttcccgcataagtactgagctctttaagtggcgaaaaaaaaaacccggagcaatcaattaatacataatacattaattatagatttgaaaaatgggttgtttgagtttttaaagaaacttttatataatacaatttaaaaaaatgcaccgtttaatagctttggaagcatgataacggaaaatgaggaaattcaagtttagagttggagtttagaactggggcttagtacctcttaaggacgactgtaaattttatccaatatatttcaatgttgttaatctatccaagctttacatgtggatctaatattctaatcttacactaaaccatataggcctcagaagacactactaatcaatggatgggctattacaaatggttacaatgaaaaaaaactagccagaaacttccaactgctaattaaggttttaatcactcttctcttcccgcaaagttattattagtactcttcatcttttcattagtgcagaaccataggtctcacagagttgaattctgcaatggcagagcaattgagttcgctggtcagaacagagcttggactttcatatggtttgcaaactgcacattcagatattacgattatgatatatttctatatttgcatgtgtcggaattgtagattttctcaaataggagaaagaaaacctatagatacatcgttgaattttcattgtgtttcacaatgtaggtaataaaatatattcttcccttatcttaactttgtgctttggttctctctaaaatttgtctgggtccaccagctgtccaaaacatgatataatcaaatcatgagcacttggcgtactagagatagaccactttgtccctttatgttttttttttgtaagctacacaactgctttaatttctttgtgtgattgtcgtaatattccacttccccatgtgtccgtgataatgtcgaagtcccttgctttttacaaagaaaattccgtgcccctaaccctgtaggtttattttcattgctgcacaccatttcgaagctattaacctgcaatgtactccaagcaatacttacttttgttgaaattataagcacataatgatttaatttatttcataaataaatcatgatattgcagatgtaaactagcatgaacacatcattagatctacatatgtaaactaagcagtaaaatatgaacagaccaaatatgcgtaacatatcgaacccgtaccgaggtggcggaaagaccggttactcggcagaaactactcgtggttgtgggcgtcgacgaaggcgcgcagcacgcgagcggagaggtaggcgagccgtcgcggacgaacagggagcagtcgcgcgaagcgcttcccaaaaaccttactgccgccttctcccggtgcaggacgtcgaaggcagaggttctgaagacctgctctcccgatcgccggtgcacgccggcaagcgggatggagtaatctacgagcgacggcgcagtacagagcagcaagcaaaccctagattgatttcgcgtgagttccgtgaaggcggcggctcggtttatatagtgataggtcgcttgatcagggcgcccgtgtaactgaaccggataagtcacgtgtaacttatccggactccacgccgttttcacgcaccggatttttcggaatgtttctaaaacaaaacaaatccgaatttcccgcagcaaaacaaaactgcaaaaggaggctgcatctgcgcaagggtgaggagccaattttgcggaccattcgacgcgtacgtcgtgcacgcgcgccacctgccctgccaggccaggccaggccaggctaggcgagcgagcgcgtgcgtgtgtttcccctcttctctcctccacacacgcttcaagtggctaggagagcatcctcccttttaaggaggtccccctctcctagaataagcaaggtagtactaaacttcacatacataccatcccatgaggtgggcttttatgattttccaaagaattaatcttcgaatgggccttagcccatctattaattccatcaatcccccaacaaatctcaaaatcccactgagatttgccttttccaatgtactgtttatatactagcggttcgatggagaccgattaaggttgaacatccacctagaacttcaagctacacttactcacaacttgaacaatggactacgccttgaattgcaagtcttgtgcaagcaagtttcactcagagtcttatctggtactagaccttctgtagactacccctcgggtggagcgtataagtcatactcctaggtctttagtaagcttcctagaagattcacccaaaatctccatagactgcgaccaacagtcaagcttacaaaggtgagttctttcaagaatgctctgcaggacagcatcttcgctaattaaagccaacagaactcattaaggcatagccaacctgccttgtagctcacgagagtacatgcatcttcacttagagagggtatagattggtactctcctgtagtttattaatggtttgttcttcccaggttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaatgttctaactccggagtttctcaatttcctaacagacttcaatcgtcttttcacatgtctagacgatttcatattatccttagaactattcactttgacaattaccgtttgattatcatagttcataaggatagccggcactggtttttcaacaataggcagatccattaatagatcacgcagccattctgcctcagcagtagcagtatccagtgccgtcagctctgctttcatggttgacctcgtcaaaatggtctgtttgcaagacctccacgaaacagcaccaccacccagtgtgaagacatatccactagtggctttgatctcatccacatcaaagatccagttagaatcactatatccctccagtaccacaggatacctagaatagtgaagccccaattccatagtacctttcagatagcacattactcgctcaagcgcacgccagtcatcatctcccggattagaggtcaaccggctcaacttgctcacagcaaaggagatatcaggcctagttgcactagccaggtacatcagcgagccaatgatttgggagtattccagttgattcctagcaattctcttgttcttgcgaagcaacaagctaggatcataaggtgttggagaaggcttactatcaatgtagccaaagcgattcaagatcatctccacatattggggctgcaagagtgtacccctattctcacctctaattagcttaatgtttaagataacatcagctactcccaaatccttcatatcaaaattttgagacaagaatgatttaacactacactggacaaggtcacctgtgacgggcccaaaccctcacctttgacggctttgggcttggtcagtgatcagtggtcactggtgagtccaatcacctttgacgggtgaaggaccgtcactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagtagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccgttgcacgtcgtcgagccctcctcaccgctgcgtcgagccgctgcaccgccgcgcgccgttgagccctcctcgccgctgccgctgcaagaacaaccggcggcggcgggcgggcggatccgtgtcccccaacctcgtggaggctagatccgacacccagcagtcgggggacggcggccgtggcgcccggcggtcggggaggggggcgaaggaggcggcgacctggatctggcatggtggaggcaggaaggaggaggctacccggatctggcgtggtgcaggcgggaaggaggcggcgacccggaggcggtgggcgaaggagctgac

SEQ ID NO: 14805 - DNA, 1442 bp, Oryza sativa
cgcctccgacacaggtcgatgaagagagagggttgagagggagagagagatggggggagtggttgagatggataaggatgagccggtagtagaggataaggatgagccgggatgagaggggagggttatgagaaagattttttttttatcatctttgacgggcacataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacaggtgactagttacctgtgacgggtcacctcctgatggctcaccgatgacggcatcctgtaggacccgtcaaaggtgaccctcatcactgaccagcacttatgcccgtcacagatatgccgtcacaggtgcaaggatctggcgtagtgtaacctcatttatcacctcaaggtttgtcccaaatatcagtatgtcatcaacatacaagcacagaataactccctcacccccaccatggctatagtacacacatttatctgcctcattgactgcaaagcctgtagatgtcaatgttttgtcaaatttctcatgccattgcttaggagcatgtttcaaaccatacaaagacttcaacaatttgcacattttgccttcttgaccttcaactacaaacccatcaggttgatccatatagatctcctcatccagctctccattaagaaaagctgtcttaacgtccatttgatgaacgagaagactatgtgaggctgctagggaaagtagcacacgaattgtggtcaatctagcaacaggtgagtaagtatcaaagaaatattcgccttctttctgagtatagcccttagtaacaagccgaaccttgtacttttcaatagtaccatcaggcctaagcttcttcttgaacactcatttgcacccaacaggtttacacccatagggtcgctctgtcacctcccaagtcccgttagcgataatggaatccatttcactacagacaacctccttctagtagtctgcatcaggagatgcatatgcttctgaaattgacttaggagtgtcatccacgaggtacacaatgaaatcatcaccaaaggacttagctgtcctttgtctcttactccttcgaggagcttcactgacatcctcctcagtgacatattcatgtgtatgttcagtttgttctggtggtgtgattgaactaggaattacttcagagggttggctcgaactactatgtgtatccttcattggaaaaaagctctcaaaaaaggtagcatcacgagacttcataattgaccaacatgcatgtcaggtacctcagatttaactattaaaaatctataggcaatgctgtgatgagcatatcccagaaagacacag

SEQ ID NO: 14806 - DNA, 8839 bp, Oryza sativa
ttataaattttaaaatagtctagagcctcgtctttcgttttcaacaagtacacatagcaaaatatagtagcatcatcaatcaacgtcatgaaatatcgttttccacccttcgtcaacaccccattcatttcacaaagatctgaatgtaggagttctagtggtgccaagtttctctcctcggcagccttgtgaggcttgtgaggttgcttcgattgcacacaactatgacacttagaacctttgacagtggaaaacttaggaattaaacacatgctggaaagccgagacatcaagccaaaattaatatgacataaacgtgagtgctaaacattagcctcatcatccacgccgccacaaatatggttcacagacttattgcagaaatcagaaagggaaaagcggaacaggcctccgcactcataacctttaccaataaaatatccttgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctatcgtgccaacaccatgaacagaagcatgtgacccattccccattaggacggtggaaccccgtgtgacctgataagaagaaaacaatgagatgtcagcacaaacatgtacattggccccagtatcaacccaccaattagtagactgattaactgaaaaaacagtaggtaaattatcatacccgcttccatctccagtgttgccaatggtcacattagcagacttaaaagtctgccctgcaggtgccttcatccccttgcgctgtggacacttcctagccacacacaaagcaagtcctctcatcctgattaggattgttattgttcttcatctgcttcttgaagtcggtggtctgttgagctttgtatttccccttgctcttgttctgggccttgtgcacaacattggcactggactgcccaccatcgcccttagacgcagcgtccttttcccgagctttctcctcaacatcaagagacgctatcaacccctcaacggagtattcctgtctcttgtgtttgagtgcagtaccgatctccaagatggaggtagtttcgcaataatgcacccggccacaaatttgtcgggtaagacacatttaaggagttcgagttccttagccatggtttgtatctcttgagcctgttcgactacagaacggttgtcagccatcctgtagtcatgaaactgctccatgatgtacagatcattgctagcatcagtagcaccgaatttagtattcagtgcatcccacaagtccttagcgtcggtcatgtgcatattcacctcgaccagacgatcgccaagaacgctaagaatgtatcccacaaagagagtagtggcttcctcgaattgcttctgctgatcagcagtaagaattccttcaggtttgccagtactgacccagaagcatttcatagctgtcagccacagtgaccctaatatgtcatctcttaaagtgcacaccggtgaatttatccggccttagtgcatcggcaaaaccagccatagtaaaatcacagcgcctataataaggtttttggattgttgaaattataagcacgtaatgatttaatttattccataaataaatcatgacattgcagatgtaaactagcatgaacgcatcattagatctacacatgtaaactaagcagtaaaacatgaacagatcaaatatgcgtaacatatcgaacacgtaccgaggtggcggaaagacaggttgctcggtaggaactactcgcggttgcaggcgtcgacgaaggcgcgcagcacacgagcggagaggaaggcgagccgtcgcggacgaacagggagcggtcgcgcgaagcgcttcccaaaaaccttattgccgccttctccgacgtggacaatgctagaaagtctaataatatgaaacgaaggaagtagcaattatcattgccaattgaaacaatagaccaggaatgacaacacggtgtctcaaatttgattttttttgtttgtgaaaataatcttgaaagcataattctattttttcacgcgcatgtatcctccctagacatatctcttcacctttatcctccttatcttctcatctttatagtaatcttgactacttttcttttgactctccctgtaagaaacttccattaatgcttagggtgtgtttagttcacgccaaaattggaagtttgattgaaattggaatgatgtgacggaaaagttggaagtttgtgtgtgtaggaaagttttgatgtgatgaaaaagttggatatttgaagaaaaagttgggaactaaactaggccttatttgagcatctagattacttgaaatataaaaagttgtcaaaggcataaagtttgtctccatcgtatgtttcatgaaaccataaagtgggaactaaaccaggccgacggagagggagaggagggagaccggccggatctgtaccccgtcacctatggggaggccgccgccacctcccttgggcactaccgccgctgcatgtcgccaccaccaacccaccaccccgagcaccttctccccagatctggctaactccggtgaggccgacggagagggagagcaagacgaaaaggggaccggatttgcacctccccgtcgctcgtggggagggcgccggtcacatgtgccactgctcgccgtctggaagagggggacggagggggagggaagcagccagccggcccgctgggacaggggagcgaagggaggtggcagccagcaggtgcaggagggagaaggggaggaaagggcagcggagttggaaggtgtgagacgaacgagtcaaggcgtccgcgtctcgcatcgcgcggataaggaaaaggctgacgcgcggcacggataaagctgaggccggctgggctcgcctggtttggctcggttttgtatgggtgctagttttttaattaaccggtacctataatataatataggtgtaggttcttcctaaaaaccggcacctataatatattataggtgtaggttcttcctaaaaacctgtacctatagtattggcaccggtttttcctaataaactgacacctatagttcttaaaggtgccggttggtgccggttgtatatttttttcaacgtgtggaggtaggaaaatgctccacacgttgaactataaggccggttttatagtagtgttatgaactgggtatatcgtaaaatattttcatcatctaaacagtctgaaatgaaaagtcatcatctagaatgttgtaaatcttttcgagatttacaaaattgatataatgttggtcttatctgacttcatatgtaaaagttatctatgttttaaaaaagtaaaataaccatatgataacatcactgctggttatttctgtacgaacctgcaaccggccatgttgaaaacaggccaaaaactgaaagattagattgagaaccaaattgatatgcttaaatttgctcgcagcaacaatttcaatattatgattcatcgatcttcgattttcaattacaacttttaatcttctgtttacttgcgcactcatggcattattccctgagtactgatgggcaatgctagaaagtcttacaatatgaaacggagggagtattcattatattacgtgatctctgcagctttacgtcagattatgattttgttaaattcattatttaccttgaactccaatatcagacttgagatgacaatatttcataattttctttttttttttggacatgtacataataatcaactttgttgctgtgaacctccacagatcctgagacaggggatgaatacacaaaaggtttgagaacagcacaaatttgcagccgtgagaaaataacagcaggataggtcggtgacaatggctacctagctagcaggatgggtggtaagagcaggatggttcgtcacctctaccatacctccatctccatggcatcacccttcagttcaacatcgaggaggcttcaggcacattgtacgtgatcttcgatcttggcatggtggtttacacagacagagggatgaaaacggtcataaagatatcagcttttattatttttatgaaagcggtatcgatacatgtgggaatttttgaaattgatgaatttaactatttagcgacgacttcgatactgcacatatggaaattttttagaacacctccttctgtactatatattttggcaccagatattgtgtaaactgttcttcttcatgagaagctgagcaccacttgtccaaaacatcacatacaggaggcggaagctttgttcccaactcctctatatagagatgctgttttaaaaacacatattaattcatttttaacttaattttaattaatacataattatcatacgctattgagctgctccgatatatcagagggaaagttcccaaccgacacaaaggaacacaaccataatcatgagcacagcacaacacgttaattcactcctttggcattcaattaacctttttaatttgttcttttgtgagagctacactacattactttttctgcctgtacactttccattttggccagacaatgatatcttccacctcttccctcacgtgctggtggtaatgtccatgtccctttgcttttcttagaaaaaaaaattcacatccctagctctactctggagatttgtcgtcgtcactaacacaccttttcatttgaagcggagggagtatgaagcacaggcttctaaaggactatgtttaaaatagagtgaaaaactaaaatattgattagattgacaaaggaattttatcgacattagatttttcattcatcattcctggcgtcctgcttttattcatctttgttatagtgtcacactaactcgtagggtaatactatgagggtccctacgatagatttatctacgttcttataataggatacatggtatcgtagtattaccgttatgtggttgactgcaccaggacctggttcatgtacttgcgtcatctcaattgtgtcaaaactaaaatttaacaatatgaaaaagggtagcgccaaaaaagaaagtagatagtggataggttatgagacaagggttcagacaggtatgccttctcgatgagaccttctcgatgagaagtaataccctatagtttagggattgtattcgctgattgttgtattgatctgaccatctgagttgtggttatatcctcaaggggtatcctgcccttcttatatagtcgaaggagacatgttacaagatagagatataaccccttacggtttaaatcactataactagttcacaatcttaccgaacaaagataacaatccatttccttgataggcaggtaaacgtaatacctgagtcttaattctttacatattctatttacatgatatatcccctataaccagttagatagtccagccgtgtggttatatggtacccataatctccacagtagcccctgagacattcatagtcgacaataaaatcttctctcaaaccaaaaatttccatagccaagtgcttcaattttctctgccttagtcttccaagtattttctcctattcagtaggatgtgaagggctgaaaaataaaaaaaatataaaatatacctaattaggtgtagccccccaactatgtatttgaacaaactaagcatatagtaaaggttaaaaagtttataataaccatccgagtggttttttaaaataatatgcacagcctaagcttaattacataaagaataatacagctagcacgtcactttactactaaagcttactgcataatgaacaactggtactggcgtcatactatgcacatattgccaaagcaaaatatgttaaaacacataatcgtcaaagttgcggacgcgtagggactcaaactccatctcactcggcaacatagcttcagccccatatactaaaacggaaggtgactgacctgtcacacgactgggtgtagtgcatagtgacgacaaaactgaaggcaactcctccacaaagcggccgatttacgacacaaatcgacaaagatggatgaactagactagaaatagattgaaatattgaaaaaaacgattcaatcactggtggagaaaccatttgtagtcccggttggtaacctccctttagtcccggttgtccaaccgggactacgaatccgggactaaagatagctatctttagtcctgggtgaaataaccgagactaaagatcgagctgacctttttttttttttgcatggccctgtttgctgcatggttgattatatatatatatacatacatatgttacaatacatatatatgcataatatatagtcatatatatatatatgtgtgtgtgtatgtataaatcatatattatatacacacacatatgtataattaaagctacttaacattttatgtgcatatatatatgttaccaaaatatatattaacacacaagtaaatgtgtacatatataaatatatatatatatacatgcatatatagtacaattcatttgctcggtagttatatctacgacttcgacttcgacgccggcgttatgtcagaagaggaaggaccgacgttataaattgttgatccgtcgtagtagaattcaccgtcgggattaagtacttcctcgttgatgaatcccatcagttgttcttgaacagccgtgataaaatccttgtgtgagagattatccctcatgtgaatacgctatcattcgaaaaataataacgtatcaatatatgaaattaataaacaacttaacaaatcgatacgcaatgaacctttgaatggtttatgtatacgtacatcgagctctcgtgttgtgcatatttagtttgataggcagtgggcatactcgcatacgtagtagccgcataagttagttccctggtcctgctttgcacactacatgagaaacgatgagagatttaatatactctttatattaactgtaattagatattcaattcaatataattttggatcaagcatgtactcactggaaaatgaaacctccgtccaagtttttctttccaagtcccgcagaccaattgacggaaccgatcccaagccctacatatgcagttgcaagctatgattaattaattattacctgagatcaacataatagcaatagattccccgcgactttggaatagatggcattatattacctgtctatcagtttgaagaccttgtcaaaaatcttctcctctttattcattgagtcgtacacagtgactctgcatgcatccaagtcgaagaataacaagacccagtggaatctggaatatgcgtgagatgagatatatatgatcgaaaatgtacatgctatatgtatgggaatgaaatttgttcgaacgacaataaaaactcactctgtgttgtacggcagtaatatgtacgtcttgaaatgttgctgcgttaggagatgcacgagattgtcctctgtatgtttctcgtacttgtcgatcatttcggtgttgattttccgagggtcgatgaacccagtatcgtagactctccgccgtcgggccctttgaatctccattctacaacgatgaaaggaaagtattattgcttacatatatgccaggagctaattattgaacgaaacaaatcgaactcaaagatactcacaaaatccatgcgctcagaagagagacatcgagggcgtccaactggtacagatcgaagagttccttgaaatggatccagagaacatcgtctccttgcaagaagtcggggtttctgatcctcgctccgaacatctctctacccttggcgctcatttccatgtaccgttcatggaatttgtacatctgtgtcggtagggactccagctgttcaggtttgacaagcggtttaccgagttcaaacttgtatgccaattccgccttcgggattggtgcgccttgaaccaattgatccacagatagaccggtgtctgcaatgaaatccgttatgccaaaatcttcaccggtcaccaaaggctcgacctcttggtttggttgttctccaagctgagggactggtttggacttcttgtgataggctctctgaagtgttcggtcatagtccgatatctgtaaggcctccttgtttgttttggacattcccttgaagaagttcttcacgctcgggtcaataggtatcttcttttcaggacttcgaggcttgagttgcctcttcacctctcctgccacataagcatcaagctcctcttgactgcaatcgtatggtggctccttgtttttggtggcgtcaactttcgccttcttcattgcccttgtgcgggcaggcggtggagcttggcgagaccttgtcttgggaggtgcaggcggacacagtggaggcggaggaggcggaggagccgaggagatggtgcaagaggacgtggcggaggaacctgaggagatggtgcacgaaatgccgcttgtcgcccaggaaggatgatgtaccgcttgcgccatagtatgatggcgtggcttgtgtcacgtagatgcgtctaaccgtcccctcctgggtagtccaactcgaggtcctcgtacgcagctttcaccagctcaacttcgaccctcgagtatcctgctgaaatcggcctgaagtggtaagtcccggaagggtcccgttgggatggccattcccaacgccaccttcacgtgatgagaggttatctattagtaatcaacctaagcagcaacttgcggaatgtacaagtcaaaaatataaaactacgagcataccttgattgataagt

SEQ ID NO: 14807 - DNA, 2039 bp, Oryza sativa
gaagaggctaccactacgtccgttagtcgactggcagcctcgcgtatctgatcgctgaagacaagggagccatcaactgggttaagcgttccaccgtgagcatagtaccagaacttcgatcgatccggccaattagcggtggccggttcgatacccctctcaagcaagctaacctccatctcctcccacttcggcttcgcgatgctatatccgcctgagcccaagtggtgatggtacttcttcttggcggcattttctttgtttctggccatcatcgcttgcccttgttgccctgtcttgtaagcaacgaactcatcccaatgatcccttagctttgggaatacgtcgaagttcggtgttagtcccttcaggatgtattttttgtagaaatctcccttgaagctctggaactgttctgccattttcttcagagtccaccgttcactaagttatccgtacccgcgggtagcgtgaacgtctcgagcattgtggtccacaacatctctttctctgaatccgggacaaagctgtcatcatccccgcgtgcccttgttctgcgccagtacaccgtgctgacaggcacgttgtccctcacaacccaaccgctgtggcgtacaaaattcttggctgcttctgccggggcactagttcggccgtcttcgtccacctcagttatgatgtgccgaccctctatcttcttcgcggcacctcgttgtccgcgtgccctcttctgtccagcagagggttgacttccactagcctcctccgcatcgttcccctcctcgttcccctccgcagccctctccacggtcccctcctcgttcaagtactggtttggatcctcgttcccctcttcttcgttctagtactggctgcttccctctgcgattgtatcgtataatatctgttcctcatcgcgatcagccatctgtgcatacaaaaaatatttgttaggtatataggatgtatttgctaaccgtaatattgaaactctgctaatcttatattaaatctcttataatcttatattaaatggctactaatctcatattaaaattgtaataatcatacatatatgctaagtctaacaatcttatattaaatctctaacaatcttatatttaatctctaataatcttatattaaaattgtaagtcatatatatatatatatgctaagtctaataatcttatattaaatggctactaatctcatattaaaattgtaataatcatttatatatgctaagtctaacactcttatattaaatctctcacaatcttatattaaaaatttaatagtcatatatatatatatatatatatatatatatatatatatatatatataggctaggtctaataatcttatattaaatgcctactaatctcatattaaattgtaataatcatatatatatatgctaagtctaccaatcttatattaaatctctaacgatcctattttaatctctaataatcttatattaaaattgtaatagtcatatatgctaagtctaataatcttatattaaatggctactaatctcatattaatattataataatcatatatatatatgcgctaagtctaacaatcttatattaaatctctaacaatcttacatttaatctctaataatcttatattagaattgtaatagtcatatatgctaagtataacaatctcatattaaatcactactaatcgtaattatattaaatcgataacaatcttatattaaaagtgtaataatcatgtatgctaagtgtaacaatcttatattaaatatctaacaatcacttatttacatcacttgcctgcgcgaattccttcgatggctagctaccacttcggcttgagggacgacgccgacgtcttctgtgcaacattaccaggaaaatgtattagtctaaacgggtcaagttacatatataatcatatatgtattaccagtaatcgtattagtagaaacgcgttcgttctcacacttttagtacaagtgcattcacgttcgtaagcgtttcgtgcacgttcgt

SEQ ID NO: 14808 - DNA, 54320 bp, Oryza sativa
  unsure (1)..(54320): unsure at all n locations
nnnnnnnnnnnnnnnnnnnnnnnnnnnnnnnnnnnnnggcagatgagaaatatctcatatgtgttgttgtgtagtagtagtagtagtgagctccaacctggaagttttgactctaaattatttagtgttttcaatacattatcttgaataagtttaacaaattaaaaataataagaatgattggtaagtatatatatatcaaacatgctattatcatttaatactcagtaccgccatgatccaaaaaaaaaagcatcacatcaagcaaatcatgctccataaacaatttagtgcatgatgcatcattatcaaaaactatataattacacagttaataacatatctctgacattctgagctaatgagctatacctctgaccaactataaatacacctcgctcctcagagtccaaacacaactcacacacagctcgtattttcctagcccagtagcccactagccggcatggagaagaagcgggtggtcatcgtcggcgccggcgtgagcggcctggcggcgtgcaagcaactgctggagcgcggctgccggccggtggtgttcgaggcggacaccggcctcggcggcgtgtgggcgcggacgccggagtgcaccgcgctgcagacgccgcggcccatgtaccagtactccgacttcccgtggccggagacggtgacggaggtgttcccggaccaccgccaggtgatggactacctcggcgcctacgctcgccgcttcggcgtgctcgactgcatcaggttcggccaccgggtggcggggatggagtacgtcggcgtcggcgaggaggctgtgccggcgtgggatgagtgggctgggaacggcgacgctttcggctccggctccggcgagtggcggctagaggtggtcgacggtgagggccatattgaggtgagaatttcgctactactacatccattttttaaacagacgacgccgttgactttttctcatatgttttaccattcgtcttatttaaaaattttatgcaaatgtataagatataaatcacatttaaagaactatgagtgataaagcaacccataacaaaataaattataattacgtaaattttttgaacaagacgaatggtcaaatatgtgagaaaaagtcaacggcgtcatctattaaaaaaaggagggagtactttgcatggaggaagtttccaaatttgcatttatcatattgtttggcctacatttatgacacataacaaacttattggaaaaaaataatttataagtggaagctttatacctgcgtcattaacgatctaaaagccaatagtaataaaaatagactgtaataaaaatctggaaaagggtacggtcaataaagctgaataaaataatatttattttcattttgtcaaaaattatatgtaaataattattaaaataaatactcttgtgcaaaggaattttcctaaatttgtatttcaaactttttatgtaggcatagaattttgtctttgatatttgaagttctgtcaaaataagttacgattttatcaacagttcgaaagctacacttattatttaaaacatgtaggcggacactttaattaatttattttaccgcgagcaatcaaaatcatatgtcagcagagaatgttcgcgtcgctagtaggagatatttatcagtatggaacaatttgtgtttctactaggagaaaagagacgcatagcgccaggaacaagggaaaaaggtcggggcgccgcatcatatcattttggataggcatggacagaggcagaatccgatgtgattcaatcagacgagcaatcttacacagaaacacagtaagggcatgcttagatctcacctcaatccaacgtggtgctacagtctacagcaaacatgtgctaatgataaattaattatgtttaataaattcatctgctagattactgacggatactgtaattagttgatttgttagtatcagaacaccctatgcaacaccctatataatacctgacgtgatacagtaaaactttaccccctaaatctaaacaccccctaatctagactagctaggtggcaccctttgtgcatgggcatgaaatgcaggcctgggccaggctagtatgacatctgcaccctaataaagaaacattatatgacacatcttatagtaaccttttttattgaaatggagggaataaatatatcggctcatgaatttatttatatgttaaataaataataagcagcatgatggattaccatttatttaacctataagcagttcacggatcgacctacttataccctaaaactattaatataaatgttgcagctagcatttaaaatttattcattaatatgtataattacctaaaactattatttatcaaccagtcatctttatcccatccatcttccacttatattcatcctttatttaataacagatattagagtagtttcttatctgttcaaaatatttatattcgcggatgtagggagtacatataaatatcattgtgtggcacagacgcacagtgctttggtttataggttacatccactgttagaaaaaaagcatttttcctgatgtgcgggtctttttttcgcagtcgaacatgacccttggagccaaatgaccgtctacaaaaatataaatcggggtaaagttggaccacttaagcggcgcctgtgaaaatgattttcgcaggcggaccacttcagcgacgcctgcgaaaatctattttcataagcgcaacttatatgatccgcctgcaaaaatcgtacctacccataaaaaatctagtcatccttatcctctcctctccaccactcatttccctccccctcctctctctctcactcagaaaaaaatcctcccagcagcctccctcctccccgcctccaccgtcggctccctcctcgccaccggcgggctcccttctcgacgatgacgacgatcacgatgccgcctccgcgcgccgccggctcccctcctcgccgccggcgtgctccttcctcgacgacgacgacgactgcgacaccgcctccgcgcgccgacggctccttccgccgccggccacgccgagcgacgacaacggctctcctcctccgctagcttccctcctcgccccctccgtcgccggccatgacgagcgacgacaacggctctcccccgccgccgctggcatccctcctcgccgctccgccgtccgcttctcctcctcgccccctccgctgccggccacgacgagcgacgacaatggctcgcctcctctgccgcccgcttccctcctcaccgcctacgccaccggccacgacgggcgacgacgacggctcgcatccggccgccggctctcctcgtcgatgcaacgacgatgacgacggcacttatgcagcggctcggctcctccctctcctatgtgggagcagtggatggaggagagccgtggccggagggtgaagccccgcctgcgaaaactgttttggaccgcctggaaaaaatctttttcctagtagtgatcttgtctcgttgttatcgttttattaggttagaaaccatcagtgcgatacataagaaagttgacatgtacttatatggtttttacggcagtttggcactattatatatcctactagtgaaaccgcaatatagaaaatgaaataacctaaagcttcaacaaatatatcccctaggtatataggccatcaaacgtactccctccatcccaaaatataagcatttttagttatgaatctggccaaaatataagcatttttagctaatccagattcattgctaaaagttgttacattttgagacaagttaattaaagaaattaagtggtaatagtaattgatgcagctactttccttaagaaaaaagtaaaagccgtaacttccttcgaaatctattttttcatcctaagttacaaaaccagttctctctcgctttcaacttttaagaaacaaaagcacatgacaccataaaacatatttcaacgttgatcaacgttaacgtggtttgatcaaggttccagtggttttcaccttcaaacttttaaaacctactaacatttactataccctgaaacatatttcaatatgctttctattgatatggaagtggtttgaagtgtttaaagtatgttcgcatgtggatgatgggaacatactgcctccgcatggaaaacggagcgatccattagcacgtgattaattaagtattagctaatttttttaaaaaaaatagattaatttgatttttttaagcaactttcgtataaattttttttgcaaaaaacacaccgtttagcagtttgaaaagcgtgcgcgtgaaaaaactagggatttgggttgggaacctagaggtccgaacacaccctaaacagttcgctgtgtcctgcgattctacgaccagagtccgtcgatcgcaacttgattcctagcccaaagtcacggcaatatttctgatgtcttatcctctctgacattgagcagtctcagtgcttttcttcgatatagatcattcctttataacctggtggtcaccatccaaagaaaaaaaacaaggtgttcaccatcaacaaagatcctggaatgggctagctctgctggttgcgaaagaggcaaccgtgcaatttgtggcgcacagcgggggcatcgctgtctagcgcgagacatccaattgcacaaatcgcagcatccatgccgagagagatccattggctaatgtgtttatttttctttgttttgccttttttttacataaaaattaaatttattatattcatatccactaatatttactcgatcttgattatacttttgtatcacataaatgatattctaatacagtaattcttggtcaaaatcttgtcctaatataaaacaaaatatgcaccatattttaaaacaaaggaagtaatataattcatcatagttatccctaaattaatttagtcacacatttgttactcaaacttctcatattccagacacacaaggcggattttgtcatactttgtattgggaggttcagtggagtgcccaacataccaacatttcctccaggcaaaggtccagaagcatttgatggccaggtgatccactccatggattactccaagatgggcaccaagaattctaaggaaatgatcaagggcaagcgtgtcacgatcgttggctacctcaaatcagcacttgacattgctgcagaatgtgcagaagtaaatggtactgacaaattaacaatctgatttcctccaaccatttttttcagtattttttctcttgtgcaactttagatgctgaattaaattttccccacttactaagtgtttcttcttcgtgtaggtactgagattccatgtacaatggtggtccgaacaaagcattggatcataccagactattttgcatggggcgtccacatctcaaagctgtatcttaatcggttttctgagcttcttattcacaagcctggtgaaggcttactccttagcatcttggccaccctcttgactccattggtatggcaattctgttttaattatactgctaaaatttgctttctctggttaaattgaagcaagactgatccatgcatgtttttcctctttgcacatgttcagagatggatattttcgaagtttgcagaaagctattattccattccaatgaagaagtatgacatggtgcctgaccatagcctatttgaggctttgattacatgcttggttgccattacacccaaagaccattacaagagattagaagaaggcagcattgttctgaagaaatcaaagacatttagcttttgcaaggaaggtgtgcttgtcgaaggccaatcttcgccgataaagagcgatatagtgatctttggaactgggttcagaggggatcagaagatcaaggagatgttcacttctgaatactttcagagcattgcagtaggctctgcatctacaactgtacctctctacaggtcaactcaacaattgttttttgcaaggaacaaatatttaattagtacaatttccaaattctatcttggactgttgaacttaatttgctgcatgaacacagggagatcattcacccaaagatcccgcagctcgcggttatcggctattcagagagcttggcaaatctctacacatcagaattacgggccaagtggctggcacatttcatggatggtggcttcaggttgccaagcatcagtgtgatgcagaatgatgtcctggaatgggagaagttcatgaagcgctattctcgtggttactttcgcagatcctgcatcggaatccttcacatctggtacaatgatcagctatgccgggacatggggtgcaatccgaggaggaagaacggattctgggctgatttattcgacgtttatggccctagtgattatattgatcttttccccaagaaagagtagtactttcgactcggagtcgtgtggaataaatttatcgcctgatcatgcttgttttaaggttgtcactacctggtttcttggatttctgctgttttgcatagtgcaaattcagtaaaccgtgtgaagtgtaaggtacagttgtgtaatataaggagatggattttaatctatctacgggcatgtgccttaaataacaaaaaggaaaaaaaatccaaataacccctataagtaactggtcttttcaatctctcccaataacttaattttgtgcaacatatgctccctacaagtccattttcttcttctaacttcccacctctgtctagttttcactgatttctggccgcgcttagcaatttctcacatctttgtagatctcagcatggctagtgaagttgcttttgtcttctcttgttgggcataagattcaatacacatttttatgaaatgagataattatcatgtcttaccgtcacatagttggtggaattaaagtgtgtaaaagtgaaaggtaaaataatgctatggtacacacacctttggtggaaaggagcaactaccctcacagtgatggagggtcatagggtgtgagaaatagctagaaatggatagaggtgggaagatggaaaaaaaacaaacttattatgagtgttttgtatggaattaagttgcaaaggaagtttgaaaacactagtgacttgtaggaggtatttggatatttcaaaaaataaaaacaaaacactctgtatccatgcacaacatataagataaaattattagtccaattcaagagaggtctcacttttagtagtatgatttagtttttctgatttattgagggatatgtattatgctatatttcatacccaacattcttgaaacgtcctgtaagtccttatttcgaaataaaacaaattgtgtattttattcctagtactcttctttcaaattaacttataaatttgatgcatgtattaaaaaagtaggtggaattaaattggagaaaattgtgaatcatttaggagggggagtagccgagtagggctgaataagacccctatccagatctagaatgtagtactagttttctatatttaggcccggtttagttggcaaaaaaatatttgttttaaggtgtcacatcagatatatggatacacatttaaagtattaaacgttgtctaataacaaaataaattacagtttccgcctagaaactgtgagacgaatttattaatcctaagtaatccatcattagcaaatgtttactgtagcaccacattgtcaaatcatgacgcaattaggctcagaagattcgtctcgcaatttacacgcaaactgtgtaattggtttttttccacattaaatactccatgcatgtatcaaacattcatgtgatgggtgaaaaatttttgttttgggaactaaacagggcctaggacagagccagcgaaaaacttcctcacctgagggtttgtttagttcacgaaaaaaaaattttggctgtcacatcggatgtttgaccggatgtcggaaggggttttcgtacactaatgaaaaaattaatttcataactcgtctgaaaaccgtgagacgaatcttttgagccttattaatccgtaattagtacatgtgggttactgtatcacttatggttaatcatggactaattaggctcaaaagattcgtctcgtgattttctccctaactatgcaattagtttgtttaatctatatttaatgcttcatgcatatgtctaaagatttaatgtgtctaaaattttttggaaacattttcgagtaactaacccaggcctgaatcagtaatctcgtcagaaatcaagagattttccaccgtggctgtgtgtaggcccagtgatgtgcataccagagaaatctcccacagattcctgggcacgttgccttcctctggagacatcccttgccttctccacacctccactccattcgattcctcccgccctttcctccccgcttttcctacaaaaacccctgtgtcgctccaaaacctgagctcctctgttctgttcccttctccacctatcacctctcctcggatcgtcagcaacagcggcggcgatgtcggcggcgccggtagtggacgcggagtacatggcggaggtcgagagggcgcgccgcgacctgcgcgccctcatcgccagcaagagctgcgctcccatcatgctccgcctggcgtgcgttgccgtttcatcttcttcttcttcttcctttgtctctgctgtccttgctatgctccacgatcgtgtatgtctagctcgccgctgatgtcgtctgctctggcgccgccgccgccgccggccgccgctgtttttgcgcaggtggcacgacgccggcacgtacgacaaggcgacgaagacgggagggcccaacggctccatcaggttcccgcaggagtacagccacgccgcgaatgcgggcatcaagattgctattgatctgctaggtctgtgcatgtttctgtcagattcttgttcaggatgtgaacttgttttttgatgctgttgttgttaattttgttctgaccttaacaagtttgatttgagatgatatatatggttctttcatgtggtgcagaaccgatgaaacagaagcatcccaagattacctatgctgacctgtatcaggtaactcagctgcatatttgaacactaacaagtaaccttacaatgggcctgttcgacagctcgattacgcagctgttttggctgtgctgtacagcccagccgttcgtctgcctgttggctggcagcggcctggctgttggctgcctgcagcctctacagccgctgttagctagctgctgtagcactgtagctgctgctcccgtgcagctgcagcgctgcagcagcaatctcatccgaacaagcccaatcctactttcctgctggtaaacttcaccaatcacataccaattataaatctcatcacctctaatttcagcttgccggagttgttgccgttgaagtcaccggtgggccaactatagattatgttcctggcaggagggtgagttgatgcatcgacattgattttttttccagactgaatatcttatgaaaccatcttgagttctccttttttttttctcatttatctacaggattcttcagattccccagaggaaggccgtttgccagatgctaagaaaggttgattcatgacccgttatctctgctcctatctactaatctaaaataaaatatcagctccaatgcattgatacttttttctgtgatttcttgggttaattttgctaattataaatgattaaatgaaatgagcgctgaaaccttccaatatgttgtatgcacaaagttcagatgatacaattaaattcgaaattttgtttttctggataatttgcttcaaaaatgtcaaaggtatttagtttcttgtactatattttacttttttgaaaaggtgctgcgcatctgagggaagtcttctacaggatgggcttatcagacaaggacatagtagcactctcaggcggccatactctcgtatgcaacatcatctttctactggtgtatataatatatcaactactattttccagctaaattagagatcatgttctgaatagttcattttcaggggaaagctcgtcccgaaagatcaggatttgatggtgcctggacaaaggatccactgaaatttgacaactcctatttcatgtaagattaaatatgacttgtccctccacagaattaattattgatggtgcttggacaaagaatcctccgaaatttgataactcctatttcatgtaatattaaatatgacttatccatctatagaattaattaaatatcaccatttgcttcaatgcagtgagcttctgaaagagaattcagaagggcttctgaagttgcctactgacaaggctcttgttgaagatcctacattccgccgctatgtcgaactatatgccaaggtacatcgcatttatatcccaaatcttttctattcactgtaacatttcaggtagcttatcaggatggtaattaattttttttcttttctgaaaatcgtagtgcttctgtaaatgtcatgttttcctttgttatggtaatcacaatagtttgtaaactataaactttctgatagattgcattagtattgcacaaatagaaacctaaccagaatgatgtgtgcaatgagcaattgagcattctctagttagtagttaatgagttcttgatttgctaacaataatttgtatttttctttgtaggacgaagatgcatttttcagggactatgcagagtcgcacaagaagctatctgagctggggttcacgcctcctcgctctgcattcatctacaaatcatgccagaaaccaaagtccctgttgatgcaaactgcagctggggttgcagttgctgctgcagttgtcgcatgggcttacctctgtgaatccaacaagaggcttggctaatttaatttgcatcgatcacaatgatcgttatttcgtctcaaccactaatggctgtacaaaaagaaggtactcgattggaacatttggatgatgtatatgtgtttgttggtatatatatgtgagtgctgctaagtctgctatgttgtaacggtgtacaaagaatgaaataaaacaacagccaatggttgtagttagattgtgagcgttattttactcgattacacaagatgcgcgcgtacacctgcgaatctgcctcctaacatgctgtaagagacggttgtcagcggcaaatcctgatctctgcccaacaaggtttgtgccctagagctaaccttaggatgctatatttatttagtagtcgtcatcgttagagtcgggtttttcttagattagtcaatccgccaatatatgcaatagtttcgtcatcaacaagtccagtttatggaaccccaactttaagtgctaatcattcattagaaatttagattgtgttcttccttattctttgagtttcttcaattgcttgtagggataaactttcatggtgaggtcaactacgtgagagcatggttgataacaactaaatgtgtgggtgtagctgttccgagatgataacgtgaacgtcttcatgtcgccaagtcgaacctattggaagatcgggtacctaggcacatcaagtgttattagagcattaggttgaccgataggtatcatctgttttccaagtgttaattttcatttccattacctagagtccagaaaaggctaaaaaaaatactaccatgttcatctagttttagttttcccttgttcaaaccactttgtgcctatgcatgaagaacttgaatatttggagagaaacaaagtttggactttagttgaaccaccttctggacaaaatattattggaaccaagtgggttttcaaaaataaacaaaatgaggatggtttgattgtgagaaataaagctagacttgttgctcaaggttttactcaggtggagggtttggattttgatgaaacttttgctcatgttgctagaattgaggcaattagacttttgttggcttttgctgcttcaaaaggttttaaattgtatcaaatggatgtaaaaagtgcttttctaaatggttttatacaggaggaagtttatgtcaaacaactaccaggttttgaaaattctgattttcccaaccatgtttttaaattgtctaaaactttgtatggcttgaaacaagcacctagagcatggtatgatagacttaagaactttttgcttgcgaaaggttttacaatgggaaaagttgacaaaacgctttttattcttaagcatggtgataatcaactatttgttcagatttatgtggatgatatcatctttggttgttcgactcacgctttggttgtggagtttgctaagactatgtgcagggaatttgagatgagcatgatgggtgagttatcgtactttttgggattacaaattaagcaaacacctcaacgtacatttgtgcatcaaacgaagtacacgaaggatcttttgagacggttcaagatggagaattgcaaaccaatttcaacaccaattggttctacagctgtgttggatcctgatgaagatggtgaagctgttgatcaaaaggagtatagaagtatgattggatctttgttgtatctaactgcttctaggccagacatacattttgctgtgtgtttgtgtgcacgctttcaagcttctcgtcgtgtttcacatcgtcaagcggtcaagcgaataatgaggtatttgaatcatacacttgagtttggaattttgtattctacttcatcttctatatgcttaagtggatattccgatgctgattttggaggttgtagaattgataagaaaagtactaatggaacatgtcattttcttggtacatcattaattgcatagtcttctaggaaacaatctagtatttctcaatcaactgttgaatctgaatatattgctgctgctagttgttgttcacagattctttggcttttatctactttgaaagattatggtcttacttttgagaaaatacctctcttttgtgataatactagtgctattaacattgctaagaatcctattcaacactcacgcataaatcacattgatattcgttttcactttttgagggatcatgttgagaagggagatgttgaattgcagtttttggaaacaaaattacaacttgctgatattttcactaaacctttggattctaatcgctttgcttttctttgtggtgaattggaaataattcatccttttggcatgttttgaaggggagtttgtacctcatggttttatcaagcaaaaatatgacaatgagaaaaattgagaaaagagagctttgtttatacatatggtattttcttgtgcatgctaacaatactttgaaggtttatttgtctctagcatagcttgtatgtattctagtattttcatgagatttagattttgcttttaagggagatgatgcatgacacttaaatatgcaatgttgatgctagcatgtggtttgatttctaaatgctctatatatatgctttattgaattattattcctcaaatagctttaattgctcattgtgaaaagagaataaaactacgaaaaaaaatgaataccgaatccttggaaacagtcttgacgacaaggacgtattcgatgtaagcaaaataatgggtgccgaatccctagaaacaatcctgacgacagggacgcacccggaataaaagagaaaaatatgagcaaaaatgctcaagaaaaagaaaaagtaaaaaattctcttggttgttttgtgctaaaggttatttgagaaagagtgataaatgcaataggtatatgtgtttagtgtccattcttcaacctatgtgcttgttaagatgttgcattataaatcgtatgaaatcatgaattttgattgttgattcaagcttaattgtaaaatctttggttcatggttatactttaattcatgtttgttatgttatagatgtgttcatcttctttttattgcaacacatgacatgatatgctatatgtcattaatgaacataattcctatgcttgaataaatcattgtcaaaagggggagaagcaaggtgaaaatttttggagagcatgttgtttttgcatgttgtttttgattcgattgggaatttctttcttttcaaaagtgagagaaattttcttttggattttcgagcacgatgtgtacgtttgtacgaagtgtgctttttaccacttttgtttttatttttccaaacaccaaaatattttttatgggtttgccaatgtgttcatcaaaggggagattgtaaaatcaaaggtgtttttgattattattctgtgatgaacaattatcataggagattattggttttgttatttgaaatttatttgcgaagtggttttggagatgattggattttacaggtgatctacaggtactgctgtctgttgggaccggtcagaccggcgtatatcgcgcggtcagactagcgcagcccgcggtctgacgggccgactctgtgtcggtttcggtttcgggttttttgtttggatatccgtgatagtttcatgattatggcttctagatggatactatgcgtatgcaatactgttgtttactaacaatgagtcaagttggagatagcttggtctcggaatatggtttctttgtttatttcatgtgtaggtgactcgatacctcgggagagtatttacggtgatggaccgggagtcggcttggggataagacgacgttcgtggtggtcagagatcatgcgagatacttaggctagagttgatgcacgtggttggtgaagattccatatggcatacgatggaggtattgtgtgcgtatggaatgcggagtcgaatttggaaagagtccaaatttggtatgattagttatgtaaagtttgtttcttatactagagggtttcctaaggtgtttaggactttaggctgcctacctcgggtataaatagaggggaagcgtgaggcttcccggtatcacttttgagagcaatggagttgagagttgagttagggtttcgagtttagtcgaaattttttgtaaggagtgctgttggtgcactttgtaaacacagagataatcaataaagttgtcatccactttaagagttattcgattggtgtttcaccaggtttcggcggtcggtcagaccggcgggcacacggcggtcagaccggccacggcgacagggagtggcatgcaatctcagcggttcgaccagtcaatcttcatcggtcagaccgacgttcattaggcggtcagaccggcgcaacactttcggttagaccggcgcaacaccttcggtcagaccgcgattcgttgaatttgagggtaacttttatttccgctaaaaattcgaatttgaatggttggtaatgggtataccaaccatagtacaaaaaaccggaccggaccggcggttgaaccggaaaaaaccggaaccagcactctcaccggctcggtttgctctaaagaccgcccgtgcaattgaaccggtataaacccggtgaaccggacgattttttgcttaaaaccggcgaccaggctatactaaaccggcaggtcagctaggagatgggccggccttccaaggcccacttcacttccggcggcccatgttcgttttattgcctaaaaatgagaaaaagtgctactttgggggtttgaactctggctggcgaggagcaagaatgtgatcctcaccactaggctaacatgagctccctgtttgaagggagttatgcataatatatgatggttccggttcagcattagaccggttgacccagcggtccaaccggtgaaccgatgaaccaagggtccaagcggttcgatgaccggtccgggtttttctactatgataccaaccattcacccccctctggttggcttagttgttgtgattcgatcctacagtagtgactctcctttattcctttctactctcttttctatctctccctgaggctagcggcacaaattgtgccaaagagaccacaagtaatcgatgttacacacctcgctggctacaacatggccgtggaggccccttggcttgcgcggtaagcttgtggtgtcccttggcacccaatccctaaaagtatggagaagcaccatggcgtcctcgatcagcctgaggaggaagcaagcaagcaagcacattggtgatttccacatcaagaataaaatgaatgtaaatgaatctagatagtaatggtcaagattataccttcattaggtgttcgtgttggcattcttggataggctggcgagaatgcagcgcttgagttgtgaaatgttgatgaggctgattgagcgagaagcagtggtgcctggtttagccgtgtcgaagtgatggtggtctttttagaggagtttggtacaggatactgtgccgaggtcgccggagcacgtctaggcacaacttggggatgtaatcatggagcattaccaccacatcctggtaaagctgcagcatgaggagcacgcaagcccgaagctctagtgcagactccatccgcgacgatagctctagcgctatgtctatgtgaccttgaccatctaaagctactctacgacatcatgctccggtacggaaagcttcccggtcgtaggtggcaactatggacgatgtcctgtaccgtgagactgtgcacacgtgcactgcaagcttaccgcacgcatccaagggatccacgaccatgtcactactggcgaggcatgtaacatcgattgctcgtggtcttttcagaatgatttgtgctaccggcctcggggtgagatggaaaagagaggaggggaatatatagagagagatgatgttcgctgattggctgacatgtgggtcctattgaatcagtgagtcaaccacagccaacttatcacgtcagcagaaaccgcttcccaaattattgaaggagttgatttacaccgggtttcaaagatggggaggcgcattcaatcatgagaaggaaaaggagggactccaaatagacttatttcggcctgtaatggattcagactgtgatcacgcactgggctatagaaagcacccggcgctggacagcccagcgttctctcttctctagtagactcgttctctctccccctttctttcccttcggcctagactccccagtctctccggccagctcgttcccccgccggcgccgcccagcgccgatctccgtcccgggggcagcagcgggcgccgccgacttgctgcttccgcccgcatcctcgtcgccggtgagcacccgtacgcagcatcctctcttccatcccctctataccccgcaccttttctcttcgcccttaacccttagctgaacccgcatgccgcaggtttggcccggctctgaagtaagcaggattctgaatctgagaacgaggagttggattgggggactatggctcagatccccaatctcgacaatgctcctctcaatctcgcggccctcaggtatctcgtgatgatccccactcatctgcttacccttgtgtttgttcctgtgaattttaacctgtatgtttgatgtgcttcgactgtgaatttcaacatgtatgtttgatgtgcttcgactggggcatcagggacagtgcaaaggacctgctaaacatcctcaagagtgtgcgtttctcaacatcccattttcaattttaaatactcgtgttattgacggtggaaactgaaaagtttgtattcttttcctgtgtatcagattagggggaagaagtgtgtagttattgatcccaagctcgcgggtactctgtctctgattctgcagacctcactgctaaaggtgcgatgagctgatcatacagtatggaaatgttaacagtcaattgttttcatcttaaatgacttagcagcttctgtgaaatttagcattgtatcaatagtatgcttacattgcatttcatgtatggacaattaagctactctcacagttaacatatatggtctactaaaggtgcgatgagctgatcatacagtatgtatatgttaacagtcaactgttttcatcttaaataataacttagtagcttctgtaaaatttagcattgtatcaatagtatgcttacactgcatttcatgtatggacaattaagcgactgttgcagttaacatatatagatttttggacatgcacacagctcatgcatggttttttgtgcttgtcaggaatatggtgcagagttgcggcttctctctgctgaacccctccaaactgagtgcgctaagatcctatatctcgtacgctctgagctgaagttcatgaaattaattgcaagccagattaagaacgatgagcctaaagggcttcagagggaattctttctttactttgtgccacggcgcacagttgcctgcgaaaaggtgactattgttttcgtactttgctggttctattgttctatctgtggcttaggattcaattatattagaataatttgctagcctcagacacaattcaattattcttagtctgattgtagtaagaatgacaacttatgcaatcatcgctcccaacatggatacatgtaaatttgtgtagtataatgtattgttacttatatgttactgagataccatatagaaagaaagtccaccttacaggccttaaatcaggataattaagattgaatgagtcgtataggccataccgcataatgtatgcttagatagtgacctattttggaagataaagaaggcttgcaatataaccattgttatttgttcatccgattaatcgcgattaattgtcctgatcgctcccctacctccgatcaggcacaggtaagtcgatcagacgatcagagagctgatcgtccgattaatcgatgattagtcgcaattaatcgtccgatcagggtggaaaacgagcagttttcgttcatgggctgcctccctgagaaaatataattttgggcctgccagcccagcccatgttccattttgggcagatgatgggcagcaaatgatgcttcttctttgaccagatgatgcttgctttttaccatatactacagattatatattattgagtacatactacctccgtcctagaatatagcaacctaggatgggtcccatcctaggacaatgtatgtcatgtccacatacattgtcctaggatgggtctcatcccatcctaggttgctatattcatgacatacattgtcctaggatgggtctcatcccatcctaggttgctatattctgggacggagagagtaatatatagcatatatggccagctggacactcctgctatatactaatcgaccaccctcgattaatcgtcctgatcatcctgatcggtgcctaggagagcagggctgatcgcctgatcagagaacattgaatgcaactatttaagatcctttcatcccaatgatgctttccaattttagtacaattatcttatagtccatgtaccatctttgtaaatgccttcgtttatatgcttatttacatgtaaatacaattttgcccaaaactggtatgtgttgtagttagtgtaggttgaatcatgtctcagataattcatagtctactaatatgttcttcatatcgtgaacaaccctttctaggatatgtcaccttccagtaattcctgtcactcacctcccaaaaaaggaaaacagaaagaaaagcccttttcagtaattcaacttgggaagcatgagccatatgcacagtatttataaaagcccttttcaggaattcagtcttcttttattagtatttcctgggacttaacgccacatatcagatattggtattaataaagaaaaatatgtgacaagacaattgaggatccaagaatgcttttactagtttttgcctaatctacaaaatatatgtagttaaagtgcgaatagccaaatactctagaaatgttttattattgcttcaattatattgtcataaaatttctgatttgattgatgggtacaaaactccctacaaaaatgatcatatgtattagtttttgaatggaatgcggtaaaatcagctcacctgagatccaccagtacgcagagtagattaatctactggcaaacaggccatacgcaatgttcatgctcatgtgccaaaattagcgaagctgttttccttattctgacagttggaggaatgaattagggatcaatatcagttgccgtgtcgtgccgttatggagaacttaattgttttgttatcagtagagcgactagagcctgattgtagtgtgtttttcttgctgacctatcttgatgcttggttcttctatacaggcttagctattgcaacagtactttatgagtaatcacatcctctttgaacccttgaattatagctgtaagacttcgtcaaatgcccttcataaattcctatttgtatgttacttagtggtccacattttgctactgatcataaaaatatacaaaataaaaaaaataataattacctcaaactttatgtacgtgacaacatgagaaaattagccacctacagatgtgcatttgcaaggaataaaattcttttttttttttttaaaaaagccatcaaaagacacctatgtatgtatatgcaaccacagatcatcctttggagtgagatttgttgtacctgaattcctccttttacgactaaacataaagatgaatgtcagtgaggcatctccaaagttgaactatgacaagaagaattgtgatctgtattttattctgcactgcagattctggaggaggaaaaagttcatcagaaattgacactcggagagtaccccttgtatctagttccattggatgaagatgtgatatgttttgaacttgatcattctctgcaggtactaatccatactagtgcatattccctccgtcccaaaatataagcattttttgctatgaatctagagaactatgtgtccagattcatagctaaaagttgttatattttgggacggaggtagtatattcataatattgatataaatcttactggagcatgattttcaggaatgccttattgaaggggatactagttctgtttggcatgttgcaaaagctatccataagttagaggtatgtgtcttcctttcatgtattttggcatttaccttttccattctttttacttgtttttactaaggttgtaatggtactctcgcaagtcgtagcaagtctgggtgccaggcctccaaggcacctatgcaagattatatgtatgcaatacatgtttgtacaggagtgaccacttaagctgcacaatgtccacctgcgctacctccctccttcacgatttcttaacttatcccttcccagttctaacctccctactaggatgctcttatttctcagtaaacataagattctcagttttctctcctgttctgcatttcacatcttcctcctcacatcactgatcctaaactcgcactagaagcaaagaggtaagaaataaacaggaatctggtgaagctggtgatggtgaaaagcttgtcagacactggagggctgtacacttttctaatcctggtcatctcggcattgatctctgttttctgcctctggctgatgcgctgtcctagagttgactaggcgacccctcgtgctgtcgtaacaactagtgtttgaccatcaccatcaccttttctagtaacataatcatatcaaatttcccatcaaaaagcataatcatatcaaagtattataatgaaaaatctagctgtaccgttttcatgtgaatacctaactttcttgtggtaaaagattcacataatttgtggcccatactctaggatgacaaatgcaaaagaccagagggtgtactacaaaagttcaattatatttgtttatagcagaagcattctatggacagactaaatttttatcatctataccatactgtagtttaaagagtacttttcagtgctacaaatctgcaaccttatcatcttttaattccgtcacacgtaaatatctatacactatagaaatattatagtactgcacttatgcaaattcctttctttccccagtttgcctttggagtaattcccaatgttcgggccaagggtgttgcatccaccaaagccgcagagttgctgaatagtatgcaacaggaagatcctgtcaacatggatgatgtaatgccgactgataagcttttttgactcagatctttcagtttcgctgatcatttatttctttttggtgatttagatggggactccggagataaacactgttattttgttagacagagaggtaaaatatatttttcattttatatggtactttcagctctgaaaactactgtcacactctattttgatttcttgttctttttggcatttatatgagcctttgcatctatggttctctatgtttccaaatatcaactcattacattacacttagggaagataacccctttgatttgttacacatttgtaatgtatctatttttttctatgcaggtggatttagtgacaccgatgtgctctcagttgacatatgaaggtttattagatgaggtagactaaatattgccaaatttccattctggccggcaactcattagtatttggtttttagcctttttatattggatgactacatgccattatggttctcactgtacaaatttacaatttagcatgtctatcacattctaacatttaattataattccctttgtggtagtagtgagcaaactctattcttgggtatgaattatcttatattataccattgtgcactaggttaccccctcaccctctgcttttttttctgtaaataaagttacaaaaataataaaaaaaacaaagttaaaatgtcctttctgttgtatgcagaatgtttcatactccatgagctatgattttctttgttgtcccaaataggaaatgtgaaatgccagtataagtcttaagaattttgatttattctcctccccacctattgggtttatatgtgagtatgttataattatctctcaacaagtacagtcatatcattagataggagtgcacgacccaattccatattgtgtctgcatggatgttactgttaggtgtgtgatatgccctaaataaaatgcaatccaatttaatagaatgtctgctattccaatgctgcattcccatggtttaaattttacaatcgattcacatgaactatttgatcattattctgcagatgttgcaaataaacaatggatctgtggaggttgatgccactattatgggagcccaacaagatggtaaaaaagttaaagttccactgaattcaaggcaagtgttcttagtatatgcatgcatatttccagtctgtaaatatgtgtaaactttttaaggtttctctttctcccatctttgggaggtattctgcctcccactacttggaaggtacctcttcagaaagggaggtgctaaaactgatcccacaagtgggggtaggattggaaattcacctttccatctgctcctgagtttttctctggtggtataggtatttagtgtgagtaggagtttcctgatcaatactgtgaggtatatatacctcaatgctccccaaggaccagagaaaaaacttcacattgttgaccattcccttttgttctgatcaggcttacatctcttgcttttcaagtggtgggtaggtataaaacgtcccaggatgggaaataacattaccattgtgttgtgtcgctgcgtgccattttcctgcaagaaattgatctttcaatgctttgcatatattttgaaacttcctgcttcactactattaatgtcgtcccttagggaacttattctttagatgcaggagttttatattttgtttttgaaaataattgcatagtttcttctactccctctaggctaaagtgagtgttctcctagaacacatgtcctgaaatttgtcaaagttttcttatacacatccggaactccgtaatctatatatcctatatagttggaaccaaaaacttgacatgcatcgagccaatcatctagaaaataatagcctttggatccctctcatgctttgatctcaccatccatttgtcatatggatttacaacccactaagtgtagttattgctataaaggtcaatatgcattgacccatgacacctagaaaactaataaccatcggatccctctaatgtttgatacttaacaatgcgtcaagtgtcatatagaaatgcactttcacatcaactactatagaacagatattgtccatttagatattacgagtacacaatttacatattgttttcattgagtttttttggaagtatttctaaattccctgctgcaacgcgcagggtatcagtgtatcactagttagtttgattcccccatacaactattttgtggcacttatctacctactagtattcacttatttgtaactaacccctcattcctatttttgtgtgatttctgataatgtagtgactgtattttacttcaaatacctgctatctgctggactgatgccttacattgccttgccactttgataaacattcttataaattcattttgataaaagtcggttggtgaagttatatctcagaaaccatgtcaaatgcatgtgataattgtttatgactatcctctaatgaaaaataaatggtgtcctagtttcattgactttgtatagtcaatcttttgaaaatttgaatgtcttcatgattacttgtaccataataacaagttaaagtctttgtaccaatcacagtgcgcagcaactttttatacattttataggcgctggagaatcttggtaactctgagttatttttcttgtcactggaatccactaaggaagcaatatccttagtggtagtgtagaacggtgggtagtggtagtgtatgcactgtgcagcccagcagatgctctttttttttttcttgaaagcatatttgaatctattttccttctcaaattctgtacatttttatttaactcacattttacagtatggtcttcactcttaactatcagtttctttatgctaatatggatttatacatatgtgttaatactctgtccttttcagtgataagttgtacaaggaaattcgagatctcaattttgaagttgtagttcaggttagctaagcttgccttctgtttttttctttatcttttgtaaaggagtttttatactaatctgttcttggttctgtttatcatccaatatcattatagcttactaataatttgaatcttctgtagcagccatcatttagtaatattgcaaactgtgctgcaggtcttgcgccaaaaggcaacatctattcagcaagattacgccgaagtaaaatccaccaatgtaagatatagataattctgtttattctttagtatttattggccctcttagtagtgcagtcatatactactaagagggaacaactttttctgctattttactgtcaaactcatacaaatatcagtttgtaaattgattttgaaaattagaattcatgattaaattattttgtcctttttatgcagcatgtttgaaaatagttttactgaatgtctatagtttaacatttacaagggaaggaaatatactacatactgaatcaaaagtcaattatttgatttgtcaatttagggggcatatctgttggtgcgcttaacataagagtaggtaattctgttggtcaaaatatgactactatatgtgaagttataggtggtgtttgctgaggcaatttgggtaaaatgcacataaatattgagataaaatcatcggtttgcccttttcacaaaaatacattttcttctgaagtactatagcgaattttttgttatctgcatttttttttccagtttgtttaattctctcctgtccattcgatcaggcagctatcttttttgttagaataatctgtgaatcaggaacttatgtaaataattttattgtttgaaaacagactcaatcggtttcggagctgaaggactttgtgaagaggttacattcactgccagagatagctgtgagttaattaagtgctgtcagttggtcacttgttttgtgtaaattaactaacaccctgcattgatgcagaggcatgttcatttggcacaacacttgcaatcatttactggaaaaccttcctttcatgcccgattagacattgaacaaacaatattggaggtgcaaaactttgaaatgtgagtttatctttctactactctgtagttcatgtttatttactttataatgcaattcttgtgacgtgggcaacatatcaagattttctgtcaaccctgtaaattagctcattcatttatattttacttctccctagtccctagatctaccccccctcccccccatttttctccagccagtcagtttgggttggctcactgccacaattgaccatcaaaatgcaaaccattctttgtcaagagatatattgagctctgaattcttctggaatccatctctcctgctcgtgttattcagatttcataaattgatagtaaaggtgactaaggtttgttttgtgtctacgtcagcttgggcagaccaaaacaatcttccgtacttctcagctattgttcttattgcaactttaacacgcggaaatttcttgttaacagtcttcctttgagccaaactgtggattgttatgagatctgagtcctgcttttacgtcattttagataaaataactgccatcattttttttatttatttcccctgaattcatgtaacaataatatctaactcatccccagatgttttgaatacattgaagagatgatacataagcaggagcctattgaaaatgttcttcgccttctagtgttactttcacttacaaatgctgggttgccaaagaagaattttgactacttgaggtatgtttatgttactttttgtgtattgcttttgtttgtattaaattttatgaccattatcagttcatatttttgcatctaggaggatatagtagccttatgctgacaattaaggctgtgttcgccattccttgttaccaaccggaacagtacgcatggaaaacagagcgatccattagcgcgtgattaatgaagtattagctatttttttttcaaaaatggactaatttgatttttttaaacaactttcgtatagaaactttttacaaaagacgcaccgtttagcagtttgaaaaacatgcgcgtggaaaacgagggagaggggttgggaaaagggggtgccgaacacagcctaaatgtgttggccaatcgtttagccttgaacatatatttttgtagctatccgatctatagctgtgtcttctagcaatcttaactattagaaaaccacctgagcattatcaccacagcaactggtggattcacccagcattacctacttaaccatgtagctaactattggcaataatatgttgtttttgatgtctgatgtggacaattgacaagctaatgtgtgcaatcttattaagttataacataacagggctatatttatgatttctttccataatactactcctaatgaccaaaatgatttatttatttatttattttacaatccaagaaaacttgagcacatggagcaattgtttaatgtatcatatatttaacttcattatgtgccagtgtttgtaagtcgtaacatgatttggttacttttgaaaggcctttagaaatgttgaaattttgtcctgtgcctaatgcaaattgaattgttttgatgtgagaaaattatgtataataagataataatcataggctattgtttgagttaatctattataatattgaattgagtagtatgatgcattatttcctatgtgaaaggtagaggttgtgaaaggccctttagaaatgttgaaattttgtcctgtgcctaatgaaaattgaatttttttcatgtgagaaaatcatgtagaataagataataatcataggctattgtttgagttaacctattgtaatattgaattgagtagtatgatgcattctttcctatgtgaaaggtagaggttttgctggcactagtatccatatccttttaagacatagatattttaaaacaattttgtatgcaaaatctgtacagtatcgatgaatacatctctctcaaactgtcacccacctatctacacagcttttttgtcccctggtgttcttcaatattacacaataggctatcctttttttcttctaatattcccttagaacagaattttaattcaatgtgaaagattcgaaggtggccaaattatcatgcatttatatgtacttacatgttaaacagaggcaaagacatgtttgatgtaccaatcaaattcattgtgtaagaattttttgttaatacgtgcatttaactagtataatatgaagtacaattgcccatatgaacagggctatcataagtagggtgttgaaaactgaattatcttgttttgctaagcactgtcttggtaatttttctgcacaagtgcgatactgctgctggaagcatgcgtgcataaacatctcttgcaattactgggtcgagggttctaagatactattttattcagctctagtagtcattgggatctacaggaaatcatggtatgctttataggaagtactacctctgtcccataacaaaactacttctagctatgaatctggacataggctatgctcagtttgtagccagaagttggtttttttatgggacacagggagaaataacatgtttggcgtcattaggtaaaatatggcatattttacgcacgcaaaaaagaagaaggtttactgcttttttatgttcacttactagaaccactaattctgtgtatatcaagttattgattgactgctataaatgctatttgggtatatgtgatttaggacatgtacacgtctcttggaatttaattgtgccatgccagcaacatcaatcttacaataagtcctcaacattgtcttctatctgtttttgtgaccctggccaggcgggaaatactgcacagttatggctttgagcacatgcccttgttatacaatctggaaaaggctggcctatttaagcgccaggttagtcagattgtctctacaacgagatttcttgttttagtcctttccagacccttaaatggtgttctcatctaactttctacagtatgctgttctactatgcaggaatcaagaagtaactggattggtattacaagggctctacagcttatagttgatgtaaatgatactgcaaagtattagcttctggaaactttacatttcctacgcattcatttttgttccatttgctaatgctgttactatttggtttcacactagataaatgcccttgctttgctacggataaaaggaaaatatcacaatatttctaaaataaataaatcatattttccatgaaatatgttacccacattttcctaaaatgtggctatccacattaattttatatgtggctgtccatttcgatttagttatgtatttaagaagttcatggggtaatatgtaaaaattgcaatgggagtaggtggggtggcagattcactgccaccactattgcggtctttttaaaggagtacagatatgcatgcttgttgcttggtgtctgaaatttttgttgacgcatttataaaaaacaaacagatcattgccaatcatctttcctagtttctagtgtcttggttacattataaaacaactattacagcagggtaaccaatgttgtttcgtttgctaccctaccaaaatattggtaatgacaaaacctaagcaagtttttgtattaccaatatttttttggccacatgtgtgtgtggttgacaaattttggtagacagcgaagcattcccaaagttctatttaaaatgcaaaaattttggtagtgcaaattttggcttcaaaataaatatgctccaaattgggggcagtgggaacactacaaatactgaaactgggggtatgttgtttaatatgttgcataaggcagtatgagctggaactaataagaattgtagataactcacaactggaaaaataggatcattctgttacagaaagcaactagagtgtttggcttagattattcagaaagctctgcattgcctcttgctgtgtcattctttgatattattatctgacatatagtataatcattcctactgcttgctgggcaatctttagtgactaattttcttgtcatttataattgttatcttggtcacgataacaactactacttacatgttcttgtttccgttctcagccctagtgatatatcatacatattttctggatacgcccctctcagtattcgccttgttcagcatgctgtgagatctggatggtaagtttattgtcctaatcttcctttttcattgagaaagcttttttcttgtgtcttcaacagttccatgtagagaaatgaaaaacggtgacttgggctcttgaaatcttcttggattccaattcgcatccttaactaataagccagttattcttcaatctcaactttgaaatccagtcaaaataacacatgaaaccttattccatggtttatgttgatatggtggtggttttcgttgtcatgaccttctattgagtttctttgatgtggacccaactaagtggtatccatttcaataaagcatgcatgaaaggactctgcactaactaaaaccactgccatatgactgtatcaacaaaaataggatggaatgatttggatgttcagtgtgaaaaatggacttagagaagagttcatggccaaacatagattcacacaatgagaaatgtgttcaatttcatagaagctatctttttctgggaatttgttgtcctggaaacataatttcaggtaaaatcaaagagaataaaagggaaaaaactcctactctgtctgggagtaatatagtcactattacatatatgcttctatcctaaaacgttagaggaaaaaaaaattcaacttttagtgggaaataattgttcttttctcttgcataagatttcacctctcccattttctaggaaatcggcttgtaattttcttctttcttgcctttcccttatggactgcattttttacagaccttattgtttacttctcttaccacaacacctgagcaaaatgtattgctgcatattgattagcctgcttttgaacttcctcacataactagtatgtaagttgtctagttgtgttaagcaagtgatttgcttgagtgaccttttttttcttgttgccatgcaggcgatctattgaagaactgttgaaactattgccaggtcctcatctggatttgaaaagagtgagtgcatattgtctttatgaaaagcttacttttgtagaattttttttaaaaagaatttcttttatttctgtagggtagttcggccattaattcttcattggatgtacaccaaggtttggggcttcaacagagtattgacaggtaaattttcgtttagttacatggaattgtttttctgatttccaaaaatgatagaagtggtagaagagaattgtgttggtttatttaaagtttacacaaaaaaggtggtttcagatttaaattctgtattctattcatgaaattcttttgttgtttagtagttataagtttctagtttatgcagctcagctacttgccatgttgagatgagttgggtgacgtgagttaagtatttgtgtttcccaatttccctagacctcatgaatgtacaattgtgaggactacccagcgattgatttagtaaattttaacccaatagggcctattattattattattttttttgaaacagcctattatgtttgttaggtgctatcttgcccattgctactgccttccctgatcctctgttctgcctgcataattacacatacaaaagctgctgctcccactctttctctctgtgttatctagtgctcactgccagccacagccaaaatcaatccttcagtgtcctgtttagggctccagttgatgctgatgggcatggtaactttgtgcacgagatctccttcatgtttcttttgtatttgtataatttatgctgaatgtcaggctatctgtgtaatcattttcttgctggtttcttctatttaagattatttgctctcagtggtgatgagggatttatgagagatctgatacaaacttatgagagcaaaccagaaacagggtctgagatctaagcttcattgtttgtgttattgtcaattcaaactctagactagagtagttaatggatcatcttgactttatttcatcacttgatactgtgttgcctaccagcaagtactccagagcccatcagaaattcagaataaggaggttatctatattgatccatagctcttctatcgccttgggtcatcatcaatttgacatcatctgctccactaaaatagatttcgctgaaaaccagctatatctaatcttggttggactttcactcctagctacaagtcatccccatattgttctccatacatggtcctcaaaggtctgttagacctctagaaccttaagaattaacatgttagaatagtacacaattgttttggaacttccatagacaatcgaaaagaaattcatgagccttataacgtcagatactacattgttgaattttggttttgtttttgcatttacatggaaaatactgttcttgtcaaattcctaatacttcgtagcatgtttcttctcttcatctgtttttattctaacgtgtgtttgttctagggttggacatcgttctctggttttggttgtctttattggtggggttacttttgcagagattgctgctcttcgattccttagttctcaggtatcctttgccaaaataatttatgtgttttagatgttctcctcaaatcgacagttcgacaccaagatattgtcaagttgggatattttgaaattcacattaacatctgttctacttgtgttcctgggaatatctttttggtacgctccttcaaatagtaacaattagtaattataggttaaatatatccttgattcgcattgtggctttttataagcctaaattactcactaactgaaccagtctgcaaggctacgagtattgtctgttaggttgcttcccacaccctggcggcggcccttatgtggaggaattactactcgcttatgctttatttagtacaccggcatcgtgcgtaagatatttcagcattcattgtcattcaggagcttcgcggtaggttaattgatcttttattagagtatgcacatatggagggtaatcaagctgctaatgatgaacaatgtagtatctgacgtaataaggctcttgattttcttttcggttgtctatggaagtttaatgcccctcatgaataatgaaatagagctcctgatcagggaaaaatggaagttccttatttttgtgacttctatctactcgcaggaagggatgggctatgacttccttgttgcgaccacaaaggttgtcaatgggaacacaatactcaggccaattataaccaatagcaaagaggtgatgatatagagtaaataatcttttgctgcacatccttttcttttctgattgtactctcacacacccgagctccacttggttctcatagttgttacggctcccttgtatgttctcaaactgagtgtatatattttaacatctgtagatctttctagattaaaattccgcattctagtttggcatttcagttctctattgcccgttttcattttccttttctacctcttgttgaatgtgcaaacttgaacgacaccagttatttctctttcaaatccactgtattttgcatctgtgcgttttgtcatcggacaattcatttctgtaatacggcactatctgttctagacacattttgcagcttgatttgtaccaaaagtccctcaaaggcgttttggaccatgacttgactattaaccgcagatttcgctggaaaagaagggcatagaacggttatattttgaaaaaaaaggaacatagttttgcttgccccgtaaaatacaactggttgtgggcatgattttcgttgctaggtcgacgctgggaaaaaggaaagtacacatctccaatgctaaaatagttacaaatacgtagtgcttattagaaacgtactcacataatacccaactaaggtggtgttttggattcacggattaaactttagtctctatcacatcggatgtttggacattaaattggagtattaaacatagagtacttacaaaactaattacataaatgagaggtaattagcgtgataattttttaaccctaattaatacataattagtacatgtttatttcagcatcacataggctaatcatggattaattatgctcaataaattcgtctcacaaattagtccatatttatggaattggttttattagacatagtcccatctaaacagcctctaaagcactgatgaatccgtggaaagaataaaatgttaggcaagtaaaataaatgaaaaagaaaagaaaaaaaatcaggcgtctccactccatgcccgtagatgtttactcccttctttttcgttctcccttctttttttctcatctcctgctgcctgcttggatgctcctatgtgttcagatgctcctatacgatgtatatgcttataacgagcaacttcgtttttaaacttcaatttttttttcttctattttacttatccaattaacaatataatcatactgatgtatttgttataattaaatctttacaacaagattttacttaattgtatccaaattattttttaaacatatacagttttatttagatgttatattttcttaatgtttcactatttcatttataaatggtgcatgctatgttttaataggtctcatactgtctaaaaatgttttagcaaaattacttattattgtgaatatattttgtgtttcactagttgggactagttgtaatcagtattttctgtggtgcagctctttgaaactaatttgatcaaatgatgaaataattcttttataaacggtgaaacaacgtttgatttttttttgtcaaaatataaccacatgggatcttattgcaaacatttaattgtaacaaatataatgatttaaccgtagattggataaacaatttattagataaaatcatttatagtttgaaaaaaataagtggtgtgcatgcatgcaacattgagagagagagagagagagagtgctagaagtgctagaggggcgtttggtttttgggaatatgttggatgtctaccgtgtaggcgttaaaaaaaaaagacatacacaatatattgaagccgaagccggacatgcataatacatcgaagccgaagccattagagttgctcacaaaattgacgatgttgtgccttgttgtattagggtaatagatatgtaacatggcctagtttcaatcccctagttagcttaatcgcgttggatcacaatatttgttcgtttagattagaaataagtccattttaactccctcaagtataggtcaaatatatccctcaaccataatatgaatctaaactattaaaattggtgtagaattactttctcgttagttttgagggtgtgattttcgttagcgtggttcgttgatcaatccaactagctaagtcaacgtatggggaccacatttcaatcactcatcttctctactctatcctctcatcgcctgggtaggattatggttatcgctcgtcatcgcctacaccggtcgttgttactcgctgctcgccaccaccccctactttgagatggatagagatcactacctgcagcctcttcggccgttgccaaggtgtgagaagaagagggtcaaggagactcggagcttgtcgcccacagcaacctcgcccaccgccatgtcatgggaagtggagagaaggcaacggcgaagcatcgatgatagaagcttaccgaccacgctgcctatattcactgagagagtcattttacaccagttttaatagttgggagtcaagatatcctaatagttgggagtcaagatatccggtattgcagttgatggatacaaaccagattggactagtaagttaaagtgcaatattataagttcgctttaggttcctcaatttgttactgagtccgagactcagtaggtcccacttgtgtcaaccaaaactgaccattatattatatttggttcaagatgttattttgagttgtgagatgagctgtaccgacgaatctcagactcgataacaaattaagggacccaagtaatcttattgaagtgcaattatacctttagattgtatatacatgggccataaatcagtatgggctgaaaacacacttaaaaaggccgaaaaagaaacgccgttgccggggatcgaacccgggtcacccgcgtgacaggcgggaatactcaccactatactacaacgacatgcttgaggcaaaaatgctcctaaaactaacgtttgtttcactaacactgtagcaatcgtcgtcctaaaaatcttttgcctattcaacggttcagaaactagtgactgtatggaagcagcaacaagtccgttccaggtaaagatattaaaatttatccacaaatataagaatttatagagtactacctaccattcacagaattcatagggtactacttctcatttactcctttctgagtgaattacacattgggctacctcttattaccagagttacacattggactaggggcaaagtaatatttgcactttgcactagacaacttcacacaagtttcagattggaccagtgtttcctcaatctcccttctcttctcttcctcgttgagctcgttgagctgaagccactatacgtgagcttgagtttgagcactaccatgtcctcccttgtattgatagctaaaattagcatgctaggtgaggtgatacgattagtttaatttggtcattagcatactaatgatcattgatagcataacgagaacatgttaggagagatgataatagcagcaaagagaggggcaacggtgatgggctgcctgacttggagacgatgagggtgtggtgaagagtgaaacaaatggcaaggttatgtagtccaaagtgaaaatcatgactaagatcctgtccaagctgcaacaagggtaaaaaatacatgacccaaactgcaatttactccttttttatcttagttcaaactacaatctcaactagcaatttatagaaaatttatagaaaaatagttcacatctacaatactaaataaatgcactgtcaagacttattttatggtggattttaattaaactagtttgatgttggagtgaaatgcatggtcggttcttatagttacacggtggtatcacctaggtcccacatcgtgtaaaatacataattagattcataattttggtttgatgtatcacaataggcccaaacctcgtttgaccatgtatgactgcactactgatgtggcgctccactggcacacattttgcatttacccccctccccccaacaataggatgggttgcacaagagagtagacgctagacagtgaacacaagtgtggatccagccatgtccactcttagcgatgccggtggtggtcaggtgcggcggatgagcaaggtaatggaggttccatcaccaccgatgcatagggtggctagtgcagagcttggaggccagggatgggtggggcagcgtagtggtggtgtgaacctcctcctcttcacgtatatcgcccccttctctcctcccccctcctgatgtagccaccagtgcacacctccacctgtccgacagcgcagaggcaacgccgatggtcgctagcaccatgtctagtgtggctggtgctcaggcatggtggacccgtcgacggcttgtgcgatgcagaggcgacttcatgttcatcccacactgttgaagctcgtcggcagggccggcggtcaggcaccatggatccacatcgatgttagttgtcccctcgatctccttccctctagatcaagcggcaatgtagtttggtgtcatgggattcgctgatggcagagctcgaggtcttcatcactgcactggttcctcttttgtgcacacctctatctgtttcaccccaatgtatatcttcctccattggcttcaccgctggtgttcattgctcgccctcttgtgcaacctgtcctccctctgagagggctgattgcaaaaatatgtgctagcatggaacaccacgttgacaattgtacatggtcaaaagaggtttggacctactgtgttaggtcatggagctaaatatgcatttttacaatatagggatataagtgacactacaatacaacttcaaccaccagccatgtatttttactcttgacgttatcttgatgtatttttccacaaacttgatgaaaaggtattttgcttttgaaacaacaataaaacacactacaatatgaaatagagggagtacacctaagtggattcggaattggctgcatttgaaagctcatttatcttttacaactccctcgtttagcactagcacactttaactattaaacgatacattatttgcaaagtattttatatagaagtccttttaaaaatcaaataaacctatttttgaaatttacaaccgtaaatatttaattaattatatgctaatggaatttcttattttcgtgtgcggaaaagaatatgaggtttcaaacatagcatcatgttcacagcagttcgtgtgcttctacttcaaaaaagaatatgagagggtgtgtttagttcacgtcaaaattgaaagtttggttgaaattggaacgatgtgacggaaaagttaaaagtttgtgtatgtaggaaagttttaatatgatggaaaagttgaaagtttgaagaaaaagtttggaactaaactcggctagaatgtttctgctagaatgtttctgcatgagattgagctgcattgatgccgtcctagctactgactaccgaggacatacattgccgttccctagagtaggctttattgtggtaggcgacgtacccgtcgacagcgagtcgcctgtggtgacttcgtcaatctctacaggatttgccggcacagtcttcgaagatgctcataggggtagggtttgcgtgcgtgtgtttgtaggggtgagtgcgcgtgcgttgtgagtgtctgcgttgtactgtgtaattctaaaaaaaaaaaaaagaacatgggccggagccaccggcgaacgcgggagttggggaggggaatttatagggttggtagttgagaggatgaactaattattaaatttatagcacagctctagaaataaatttctcttctttttagactgtattttgcgaaactgaaaatgatggaaagcatcctacggatggaactacaccgggaatagagaatttatgatgtagattgtcgaaacaaaatttcggcaacactaaaagggatagcaatcaagctaaaaaagtggatgtgttagaagatataatactctactcctgtccggggaattattttgccgagtatattattgatatgatgatccgggagaaaagttacgcccctaggagcactccaacccctccttatataaggggatgagccgagattacaatgtgcagcccatatgcattacgaactaggctaccttaaatatattacaattgcaaccaattaagactacgagatatttccttgatatacaagttaacataattcccgagtcttttcctaaatatattctatctgtataaattatcccctataaccagtcggatatactcgtcaatcgtcatgtgggtatgtggtacccataatctccacataggtggaagtttgggttaatttcctttccggatctcatttatcgtgtacttgtgcttatcaccacgcgcgcgctctccaactccagcacgcccaagaaaccaaaggtcaagctgccaagtaaattgctcagaacgccttggttattttcgttggagcaagtttaatagtatagcccactaccagcttcaaattatctataacaaatgtaatagctaattcatacaatagttacttgctatactataaataactggtcccacctgtcatacatacattacgtcttggagcccgtgctgcagctagctacatgatctgtagcccgctgcttttctctctcttcttttatctctttaaaatatgtttatagctggcttatagcctactattgtacctgctcttatctgtccagttgaccgcttaattatggatggttgttgcgctatcattgtcgcagtttatatccagctaaggtcttgatccgtcctggtgcatgtatatccgcgtgctgttccatcgatactccctttttccaaattgatcgtaatataataaaatccaaaatttcttaaattgatccttatataaccgtatggacacggatttcatcgaaatataattaatatatcaaaggagaacgtgtgcatgctaatgatgtaattgtcatgatattttaatcgatgcatgtatcgtgggaaatatacgcatggtgttttgattgatgtgatttaaagtatcattggccttggtgcataattaaacaataaacatatatgatgataaatttgaaatagaaacaacactatgcggctggtcgggcggttgttgtcatgtataatgccttttaatcgggactagtttgcgagactttatcaggtcgagtctcccaagttttggcattatgcatgcatcatgtcatgtgcaattatccactcaattcattcatacacaggatctgcatatataattacatttaatttgacaatttgacccattcgaaaactaattttacaaatgaaccgcgaccaaaacttatttcgaagtaacccttttcagcgccataagatttggcgctgaacaaaagggttacttttgaactaagttttggccgcggttcatttgcgaaattagtttttgaaaaggtcaaattgtcaaattaaatgtatataattacgatgtaactaatataactggagtacatatttgtcatgtaactacaattacgatgtaactggagcacatgcatgtgtgagcgtgcatggtaggtttcagaatgtgactaaaaccaaagcgattagagccagcttgaattgataggctgattttgaattcagtagaatttaagaggatatgaaaaaacgactggatcagtttggttcggcaagaactaacagattgaacctactggagatgttttggtgcgatgtttccaaagcatgtcaacctctcagatccatcttggcatgccggtttccatatgagaccgagtccacaatcccactcacgtcaagacccaagttaattgatccccctttccacgttcaggagtttactcttactcccgaatccggttccaactcataccgtgacctaaaatatttcgattttggaatcgagttctgaatgcaaaaaaggaacatatgcgacgagggattttcatttttgtaagtgactacctatatttatgctgacatatttttcatgaaaaaatagttagcatatatttacattgtaatttataaattacatacgtaattttagtatatttacaatatgagttttaaaattatatatatcattttagtttcacgtactgttattttaagttgagaaatgctattgttcaaaaattttgggcctccccattttaatttacctgtcaacgtgacaagggacatgatgagatgggttccggtctaggtcagcataaaccgcaaagccaatccaacgattagaaatctaactgggatgagggaagaaatatgtcgccacaaatatagcgattctagggagttatatttatggcaccatatttttcaccaaaaaatagttgggatgtatttacattgtaagtcctttaattacatatataattttagtgtatttataatgtataagtctcaaaattacatatgtaaatcctacaattacatatgtaagtcccaaaattacatactaattatatattatatttgtaagtggtgtgtaagtgcaatgtaatagctgtgtaaatttgtactactaattacatttgatgtatttttacctaaaaatttgtcaccatatttttatagctgctaacgtcttgcatcattgtttggtttatatcccataattttccacagcacgaatcttagaggagatcaaatgatctagaaatcgactataagcaagccaaaaatgtggtgacagtattttagcaaaactattttgtaatccactaattttttggtttgcacttttatatttgagcttgtgtaacttttatattttaattctgaagtccagcttgtaatattttgtttgggtccttggtcagtttatgttgaagaaaaaaaaactaaatctaggaaaaaaaaaagaaatacagaaaggtgtttagagagagagagagagcgccctacgaaaaaagaagaaaaagagcacaaaaaaatcagaagtggaaaagcgagagaagtttgtgcatgttctttacgacttccctgtgttccctgggtcgtcaccgcctcctccctcttcgatcggcactcatttgactaggacgtccgtgtctccctctaccttgcaccatcaccggcctcctccatgctgacgatggcgtcaccgtggggccattggtcgtcgccgccatcggcatctctcctccctcccctgatccttctccacggctggcaaggcagagatggggaagaggaaggccaatgtgtgatggagaaggcgacgtcggtgttcctgatccggtcgcctttgctcttcagccaagatctgttcgcctttcctcgccgcgaggagtcttgtgcgacgatgatgccaagctgtgaggaactgaggaaagagcagtcgcttctccataggaagaatgccgaactaccctcctctgaggtgaacttcaacagcttgcagtgggaagatttgaaattgggagcctgagtcagagtaggagcgccgagcgcaaactccattgtgtcttcatttttttttaagaaacacattacaaactcaggcacttacaacgcgcttacactcacctatgaacgcacacagcacaccctatgcctatgatcacttctggaagactgtaccgacatatcttgagatagacgaagtcaccacgagcaccttgttgttgatgggttcatcgcctattagtaaaagaataattagccgtaaatacgagcgccaacgtcaaatctagtacttacccgggtggactggttccaccacaagaaaaataactagttgtgctacactcgctttacccattgtgtcttcattttaatgtatcaaactacatttcttttttataaaatagctctcatagaccaaatctctctccaatggatctttaattcaatggaatattataattgttggtatgtcttaacgattacatatataatccgcaagcacacggatatatcactgtagcatttcacccggaagtatttcaaagtatcgtatttatttaatctcaagggaagatatgataagcgagtactatgctaataatttatatcacttgtatagatcaaagtctaatacaggggttaatcaattcgaatatagggtaggctgacacacagaagaaactaaccaaactactctcattaaaataataatctaaactaagtggagaaagaataagaaaagaatcatttatgtttttctagtatatagtcattttagtctacacttgtgttgtcgaaacaacaaccgcatacgtcgaaagacgtggttactcaacagtggttggaaaataaagtgtattaatttgagaaatttttacttggatccccctatgggactatttatagcccccattacaggttcttaccactagggttttggttatacaggggaatttacatggttgcccttataaaagggacatttacatgggtgcataatgtaatagggactcatggcccctggtgggccgtcgggcgatcgccggccttacggtccctgggcttgatgggtcggaaaggcttcttcggcactcgcgggggcgaacttgctgtggcgaagtcatcttccttcggtatatactcttcgccttgcacccttcgcccaagaggcctctggcttgacaaggtactcgcacgatctctcgcccctcgccgttcctgttccatagtcttcgccatgggggaacttcgccctgtctaacgtcgatgtctcgggctcgaatctccactgttcgcatggttttggtagatttggtcgaagggcttcatgccacactgccaacaagcccctcacgggcaagggtgagatcggagcttcggccgagaccgtgcaaaccatgtggtatggtatgtggcgccccctttcgaccgatgctcctgccgaaacctacattgttcctacaaataaagtttgttatctgtgcggctgatattattttgctgctcttcgcctccttcggagggtggcatatatattttttatttttcctgggcagaaaggaacagtaatgggccttccctttgcgggctttttactgtgtagctcggtcgatggtaatttaccgtttcgcctaccctcgcgacacgtggcgctttattactggtgggtaggcgaaccgtcgctcaggtgagttatatattccccctcccattctctttttactgccagactagtcactttcactgcgcacgcgctcttcctccgttcttctctcggcgctcctcggctcttcagtcctttcgttcgctccctttgttcgccactgcacacactgttcgccactgtatacacccttcgtcatggctccccgcaagcctaacccctcttcggcgaaagggcccgatcttgaacggatcaacgacgactccaccgcttatttggggatctctctcatagacgacggtgaattggcgaagttggtcagctctggggcgctagtcgaaggacaggctttcgccccggggaaagccgttgtaccgaagcccgtcgacaaccgaacggtggtgttcgccgtgttttttgaggcggggctccggtttccgtgcagcgcgttgttgccggagatccttcgccttttctaggtggagctcccacaattgagcccatcggcgctggtccggatcgctatcttcaactgggcgtgccggactgtcacgcccggaatttctatccaaaattccaaacgcttacatgtgtgttaaaccctcgtccaggaatcaaccgaggcacacaatgacaaattaataatagagtacgaataaataactatttaacattcgcaaataataaaatattacagaggtggatagttcctctcaaaaaaataacattctacgcagcggaaaattaaaactaaaacaaactacggaacagctatggcgactccactccacaggcatcttaaccaagaacaagcctaatcctccagatcatcaccttcactgagatactcctcttctgatgaatgaatattgcaagaatgagcatatgacatactcaacaagtcacacagcaaaaatgcaagtgcacaggataacaaaggatggcataatatagctcatttgcagaaacaacatttagtaaatattttaagagaatagtaaaacagttgtataattaatcaatattaaataaacactatacaacacacccatgttgcataggcccaaccacatttgaacaaccaaccccggttgaacaaattaaacctccaaactaggaattatccattccaaaccaggagtcaaattaattaccacattattaccactaatgagtagtgtgagactaatcacgaaaaacattgctcaactcacccataaccgcgggtacggctattcgaatagattaaactctgatcagaggtgtaccactgtacccacaagacacaaccccacatcatgttaccatgtgcctcaataccaccacggtacctcggaaaggagttgtgacaataccccttgcacaacataacccattacagcacacctttcctggatcataatcacccccttataaacaaggcatggactccccagcgacccccgtggacttctcgccacttctcagtctggcgcactataacgaatcacgctatacaaaagataaagccgttgcccacgctggcttgtggttggcacgataaatgtttcacaacagtagctcgcgaaccggtcttaattgtcatgagcacaaccatcaaaaccatatgctcacaacccaccttaaccaggttttaattatcaattaattaacatcacacgatttaccatcgtgagctaccatttaatgtaaccataattaataataataatgtaacatagtttataattaatccctttagttagctaatgtttctaagcatggctaagcaaacttacatatagcatttagctgaaccaatccaatatataaggttcatgctaatccaattataacccataggaaaataaagtcatcttcagccataaattaactgggaaaggttcaccacccgatgacattcgaaaacaatgcatagttgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaagaaagaaaaaaggagatgatgacgtcatgctgacgtcatccatggccggccggctagggttagcaagctcgccggagataggacggtcggccggggatttggaggacatctacgcgtagaggacgacgagacgaacccgatggtactcaccacaacggcaaacgacgaacgacgacggccggcgacgaggaagacggcggcggcggctcgggttaacggcgacggcggagctccggtggtcggcggcgaagggggacgggcggccgaggttctcctcaccacggcgcacctaacggcgacgagaaaaggcggcggcgacggcggaatcgacggcgcgacgacgccggaagatggccggcgacggcggcgacttggagctcgatgcggcgacgctacggggcactagagagctcgggatagggggcaaacgaaagaggacgacgaggtggtcctatttatagccttggattgaagagatcggactccaaacgagaggaatcgactcgggaaaaatccaaactcggttttagggataaaatcgaaacgaactcgattcggataaaatcctcaacgatttgctccgaaacttgggggaaaagatagaggagaacgagaggatcaaaacccctcaatcaatcggactcaaggaggccggattgaggcggatttggagggagaaggaggcggctcgggcggcttgagccggcggctggaggttagggatggatccgacatgtggggcccacatgtcggtctcccgagaggagggggcggcggcgacggtttgggccggcttgggccggctcggccgtgcgggaaagagggagtattgggccaaaatcggcccaataacctaaaggagaggtttttgaactttttcaaataaaacaatttgtgaaatgttgtttcaattattaaaaatacttcccttgctcaaataattcccagaaaaatctagaaaatagaggaacaagcatagtatttaataaaattttatgtagctcatttttatgttgaaaattttcctagaaaattagagtttagcttgtaggcttttaaaataatttctaaaaattccatttaaaccacagtttatatatttaggatttttaggacgtgacaaacctacccccgttaaacggaatctcgtcctcgagattcagaagaactggtgaacatataaggatgagctgacttcaattcatcttctcgctcccaagtggcttcttcttctgaatgattgctccactgaaccttgcaaaaccgtataacgcgattcctggtattcctctcacttacttccaaaattctgactggcttctcaacataagttaaatcttcttgaagctctatacgatcaggatctgcttcctccgtaggtacacgtaaacatttcttcaactgagacacatggaacacgtcatgtattcccgccattgacggaggcaactctaactgataagctacttcacctcttcgactcacgatcttaaaaggtcccacaaaacgcggtgccaatttccctttggtttggaaacgatgaacacctcgtaacggcgtaacccgaaggtatacataatctccttcttcgaaagccaaatctctgcgacgattgtcggcatagctcttctgacgcgactgagcaacgcgcaacctttcttggataatctttactttttcttctgcctctcgcaatatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaagctctcaacatatcttctaaaatttggtttactctttccgtctgtccatctgtttgagggtgataagcggtactgaaattcaaacggttacccatctctacttgtaatttctgccaaaacttcgaagtaaactggctacctctatctgacactatcttcttaggaacgccatgcaaacataccactctggccatgtataactctgcaagcttattccctgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaatggttgtaacagaccggctggcttctgatgttctttatttcttggatatcaggatcattcacttgagcttctctaacttgatcaaacagagtaggttgagcttccaaagtagccacaaaacctttgctgactattcccaagttcatcttttcaaattcttggcataactcccaaggtaaacgtcgaccttctgacatattacagtagcttttcctgctaagagcatcggctacaacatttgctttccccgggtgatagtggatttccatatcatagtctttaatcaactctaaccatcttcgctgacgcatgttcaaatcaggttgagtgaaaatgtacttcaaacttttatgatccgtatatatctctgtacggttaccgaaaagataatgacgccaaatcttcaatgcatgcaccacagctgccaactctaggtcatgcgttgggtagttattctcatgaggacgtaattgcctagatgcataggcaaccacctttccttcttgcatcaacacacaacccaaaccgtgtcgggacgcatcacaatacacttggaaacctttcctcgaatcaggcaaaactaacacaggcgcagtcactagccttttcttcagttcttggaaactttgttcacaaccctccgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctccagacgagatgacatgaccaagaaacttcacttcggacaaccaaaattcacatttactgaacttggcataaacctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaataaatcataccgagttgtgaaggcggtctttggtatatcttcctcatggattcgaagttgatgatatccagaacggagatctatcttggagaaaactgtagcaccttccagttgatcaaacaggtcatcaattctgggtagaggatacttattcttgatggtaacctcattcaacgctcgataatccacacacattctctgagtatgatctttcttctccacaaagatgactggtgctccccatggcgaagtactgggtctgatatatcctttctgaagcaaatcatccacctgtctcttcacctcagctaactcatttgctgccattctgtatggtctcttatggatagggttggttccaggtaccaagtctatccgaaactctatgtctctcttaggtggcatacctggcaaatcctcgggaaacacgtctgggtagtcttgtactatggggatctcttgtagagcaacttggtttaagatcaccccatgagatttaggagaggacacaaagaaagaaactgtttccccattgctactggttaaagtcaccttacggttggcacaatctataactcctctgtgacgagataaccaatccatccctaagataacatctagatctttggattctagcaagataagggaggacgggaaaagaacttcttctattcctataataacggaaggacaatactgtgtcgaaaacacttgattgcctggggtattaactagtaaaggtctcccaagactaataacttccatcccatgattgctcgcaaaacttttagacaaaaaggaatgtgtagcaccggaatcaaaaagcacagttgcgggtatagagttaacaggaaacgtacccaaaaccacatctggtgcattctgagcttctactgctgcaacatgattaacacgtgcctttggtgctggagcattggagttgttcggggctggaacgttcttcacgcgccgaggcttaggacacttatcagcataatgtcctggatcaccacaattgaagcacacccctggcttgcttccctgttccttcctaacgggctggttctgaactggagttgctgcaggacgaacaaccatgttgcggttgtcattgccacgattaccagtattgttgttgtagaactggcgttgggagcggacaactgatgaagatcctccttgagggtacgatggagcttgaggtccagtaacgagacgcggcctctggttactgccctgttgtgccttgaattgggcagccctgcgtttcttctgctccatccggttatacttgtcttcctgacgaatcgccttgtccaccaactgctggaaatcccgaaaatccgtagacatcaaagcataagacaactcatcattcagtccctctaaaaacttctcctgacgttcttcatctgaacgaacatcttctggagcatagcgagctaaacggttgaaatcatggaggtactcggtgaccgaacgagatccctggttgagtgctctaaattctctcttctttagagctacaacacccgctggtatgtgcgtcttcttgaaagcggccgtgaattcctgccacgtaataggctctccttcagccctgccttggcgaaaatgatcccaccattcagcagcaggtccatgcagttgatgcgaagcaaaagaaactttctcctgctcagtacactggatcaagtccaacttcttctccaccgcatgcagccaatctcctgcttctacgggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccacttccacttccacttccacttccagttccagtgcgcgtgttcaccatctgacgataagcagagacaacaggaaagaaacgacagagagacacccttagagcggagttatttaattaatttaaattctatattgctctttactgtatatgattacatttaagttgcattaacactatctcaccaactatcttacactctgacaagcaaaagaactagactcatgctgttacatcccacccatgatgtaagcaacaactaaaaacccacacactcacaagcaaacttaaacaagcaatctaacacagcgaactacggcaacgatctaatctaagcgactaattccgccttgcgtcggaacgaagcgatggatcttcttcctctggagtagctggctctctttcttcagggtcttcctcttcttcctcatcacttatgatgtcgatgacaggttcagcacgatcgggcacagcttcacccatcacgcgaatcttcgaagctaactggagacgaggtggcggacaggttctctttcttgcgatgaggtgaagcttgggtgttggaggcggcgtttctcctttaagttcagctaattccttctgtagacgatacaccttgctctccaacttgcaaatcttgcctcgattccaattttccctgtcatgagctgctttgtctcgctccacacttactgcatccatagcactaagcatatgcaccgcatgcatcagagtggcactctcttcaccatcaggacaggtataggttccatagtcttgaccatgaggcttgtgaggatgatactggaaagctgatgaatccaactcttcttcaaagcgttgacgcaactctccaatggccaccagagctgcttcttgacaagcctggctgtacgatcttcctccagcttcgaacttaatggacggaaggtcttcacgatcactagccaacgttacacgaacacgacacttctcctcgtcggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaagaattaatgcatatttttaagttagctgcaccaactagacttaattgattttgaccaaaaaggaagaaaataaacgaaaagaaaataaaggaaaagacacatacaaaactattttatatatttttctttttgaatttaacttttgaacagagaaaaatcagtttggacaagtgaataaaataaaaccagaatacttaagacctactataagcacggtacaatgtcaccattaaaggggatgagtagtactggtgccagcatgattaaatcgataccataatagatgtacagtgccgactaatcaataagatttggtaaagagaaaaagaaacattttgagaagaacaaccttttgcttttaaaagaaaagaaattgatttaaataaattttgtgcataaccttgcatgtgctgccaacttatttaatttataagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaaattaataatagagtacgaataaataactatttaacattcgcaaataataaaatattacagaggtggatagttcctctcaaaaaaataacattctacgcagtggaaaattaaaactaaaacaaactacggaacagctatggcgactctactccacaggcatcttaaccaagaacaagcctaatcctccagatcatcaccttcactgagatactcctcttctgatgaatgaatattgcaagaatgagcatatgacatactcaacaagtcacacagcaaaaatgcaagtgcacaggataacaaaggatggcataatatagctcatttgcagaaacagcatttagtaaatattttaagagaatagtaaaacagttgtataattaatcaatattaaataaacactatacaacacacccatgttgcataggccca

SEQ ID NO: 14809 - DNA, 9333 bp, Oryza sativa
ttggccggctttggccggctcgccgcgcgggaaagaggagtaatgggccaaaatcggcccaataccctaaagaaggggtttttgaactttttcaaataaaacaatttgtgaaatgttgtttcaattattaaaaatacttcccttgctcaaataattcccagaaaaatctagaaaatagaggaacaagcatagtatttaataaaattttatgtagctcatttttatgttgaaaattttcctagaaaattagagtttagcttgtaggcttttaaaataatttctaaaaattccatttaaaccacagtttatatatttaggatatttaggacgtgacacggacttccggatttgagcctagcgccgaacttttcggtgcaatattttctgccaccgtgaactcgaagacggtgattaccctggcagggacgaagaagacagtgttcgggagcattaactttaatgttcgccccgagcgatccgatctctggccggtgaacgccgccatgtcgaagtgggatggatattggatggcgaggtggttctaccacaccatccccttcgaggctggctccgactcagcgaaagccctcctgtgccggcgccagggcgattgcatcgaaccggaaacccaagatcgccatggacgacgctatggaggcacggtttgctctgctacgtaaggtttgctcccgccttagctgccgcgacttggtggaggaattttcatgcttcgcatctttcccctctcccaatcgtggcaagtcgtagttgatcaaggcgaagagtgtgatggtttgccgaaattggttctccctgagggaacgaatagtaagactgctctttcgctatgcactcctgcgctttgttattttgctttgtttgacgcttaatgtggctacaccctttacttttgcagtgttgacacttgaccaagttgaagccgaagcccgtaggatgatcggcgacgtgtcggtcgtcgagtacagccagttgctgacacgacaagcagccggccgggcgaaccgggtttacaacggcgaattgcctccccgggcgaacccccacaaagctgacgacgatacaggaccttcgcgaaagtgaacacgcggacaagtgaagcttgcccccaggaagcgaagggttcctgcttcctccgattctgacgccgacgatgaggacgatgtcgaagagcctgacggcgaggaggaaggagaggaagaagaagaagcggaggccgttgccgaaaaggtcacgaacgaggcggccgaagaccgtgtcgacacccctggctacactcctactccaagtccaggtcacaacgagaccggggtggagtcgaacagctccccccttcgacgaaaggatttggagggggcgaagacgctagttgcgttttcgtcaggcaaggcggcgaagggaggtccggtcaagaagatctccaaaaggagaggactcgtcgatgtcgctcgcgttttcagcgacgacgagtcttctgacgagactccgacttcgcccgctggccgcagcctggacctttcgaccgcccccattctttcactcggtgccgatggggcaggcggtagcgccgctgccgaggtttcagcttccgcagaatggatcgtgacggctgcgacgagggtcttcggcagcccttcgcgtcaaccggttgtttcgcctctggtcaaaacgaaggggaagggtgcggccgccgaaacatccgcctcggaatattcccttgcggcgccccacttcgcccctggcgatttcgagacccgggcgacttattccctttgtcgagggagtaagcaatcttgtcttgcctgccagcaccctaagcctattcaccgaactgaatgagtttgatgaggggtgttccgctattaaaagcttggcggttcgggtatgcttcttctctcttcttgattttccactcctcttttttttacatgtctcataattgacattttgttctcttcgcctgctcctatcttgcatccagattcttgcggctcactgttcgacagaacgaatcgtgcgcgcccgtcttgacggatttaagaaccgtcttcgggccaaggatgacgaaataggccgcaagaacttggagatggaggccctcgccaacaccctcaaagaggcgaaaaccgaaaacaggcgcctccaatccgagtttgagaaaggaaacgaggctagggccgaggtcgatcgcctcaaggctgaactggagaaagaaaaggcccattccgctgcgctgaccgactattataacctcactgagccgaagatggaggctcttcgcctgaaggtcagcaaggctgaagcaagcgctgtggaggagtcgcagcggttttctcgagagatggcaaaaacaaccgagtccgggaaaacggcgtgccaaacgctgcgcctcgcccttactgacatgggtgcgaaggtgtgaggggtccctgctgaagatgcctcagctttagacttctccgagtggacctagcaggttggtggttcggtttcggactgcgccactacgtacggcgattgctgctcgcgcgtatcggcggccttcactatgggccttttgcaacagttcggctgtgagcacgtcgctgagttccctaactatgcgaaaggggactgggagattagtgcgcagaacatttcacccgcgtttcgtgcatggcgaaaacatttctggcagaaggaaggccggtccactgccaaggcacgccttttggagcaactggcgaaggcgggggcggcagtccggtgcgaggaagaggacgcggcagacaaagagggtggaggcgatgcccaggatcacccagaggtgtgaggccctccgccctttccttagatttttgtagttttccttctttttgtgtttgcctggagaggcgaacgatgtatattcggcaggctgccgctaatcccccttattgtagccaaaaaagggccccttggatatttggaatgtacaactcaaccttagccactttttggtggttgaagtctttggcgtattatgatttcgcctgtttcgcattatacaatactttcccttttttcgcctattcttactatgtaaattgtgttttgctctttttgcactgtctaccagggtgttcgccgaaagttgtgcattcggcccccttctgggagttggtggagtcaaacgagaaatttgtggcattgaagggtctgccgaaggtgcgatgcccatttcggcctgtttaccgtgagatggtgataaacggtcgcagctataatgtttttaaggttgccggctggctgcgggcgcaccccgggcgaaccttagaagactacgattttgttcgctcaagacgtttggaggatatggctcgcttttggcgaaatcatcagaagactgatcagcaggaggcgatctcccagcgtcgttacagtctagtctgtgtttcgccccctactcatcttagggttgcgtatgatattagtagtgatgacgaacctagttcgtctaaccactccttagagagagagagagagaggttgcgggggcgaagatgtaatttatctgtgagctgggccgtgacaccattgcccttttctttttcacttgtaccattgtgataggtttgtatactttgatttttacttgaaatcaataaaggtgttttttattttcttttcgctatttttgcattgtcacttcgtgtgcttttcgttgggtcggaatgtgtcggcccctttgcatatattagcgaaatgggttttgacttttcagctttcggcttccgttttcgatcagtttcgctccacgttgtaaggagctttttgtgctttccttttgatggagtgtaacggtgttcggttagttgtttcccgaaacaagctgttacggtttcaacgttcggcgagcgatgcttcggccgattcgtttcgcccactggcctttttcgctgatcaggcgtttgccttggggtttttcgacaaactgtcaatcacacaaaaataaaaagaaggcggaggacacagaggttttatactggttcgggcctccgtagtggataatagccctacatccagtttttttttgtcttttctcattttcctctttttttctttttttttcttgccgaaaggcttacatagtgccaagggggttacgtagtgccgaggggctaatatgacaatatgtacatttttacaagttggcgatttgggtgccacccgttctagacatagaagcgcttgagagaggcagcattccaggaatggttgaactcgtcaccttctagtgtcgccaatcgaaaagatcctgtcctggacttgtgcttgataaggtatggtccttcccaatttgattcaagcttgcctacaacgatcggccaggcaacagctctgtcggtcgaacttttttgttgtaagttgccgaagtgcctgtgtcatacttgcgcatgtgttcgagtgcttcgactcttaccccttccaagagttcgagcgacacctcacgccccccttcgtccccggagaacgtcacccttggtgagttagcccctagctttgttggggtcattgcttcatcgccaaaaagtagcatgaacgggctgaacttggttggtcttgtacgggtcgttcgaagggcccagagaacagacagcatttcctctggccatttgcccttcgctgccccctcgagccttttctttagtgcttctaggattttgccgtttgtgcgttcggccgccccgtttgattgtgggtgtgcgaccgatgcgaacctgatttccaggttaagcccttcgcacatttccctgaacttgtcagagtcgaactgcttgccgttgtaagtgatgaactcttttggcactccgaaacggcaaacaatgtttttccatacgaacttttgtactgctgtcgaagtgatcgctccgaggggctcggcctcaatccatcgagagaagtattcgacggccgccacaattgcgaacatgtacccgtttcgcgccaccgggaacggtccaatgatgtccagtccccatctggcgaaaggccagattggtgcaatgggctgcaactcatacttgggcgcggtttggcttcggccatgacgctggcaactttcgcatttcttgatttgctcaacgcagactttcaacacagtgggccagtaaactccttgtctaaacactttggaggcaactgttcttgcaacttggtgcgcgccacatagcccctggtgtatctccttcgccatttcctcgccttcggcgaaagagatgcagcgaagcaagggttgaagtaccccggagtgatagagctggcccgagaccatcttgtactttgtagctctgtgctgcaagcattttgcttctgcttcgtcttccggaagccatccggtttcaaggtgtttcacaaatggggtacgccagttgtatgggtcttcgcccagtttcacttggtcgattgtcgtgacctccaagatgtccgtgggcacacttggtgcatacaggacttcaaaaaagatgccaggagaatgtgggccgccacaagcagcagatttcgccaaggcgtctgcttccttgttctggcctctaggcaaatgttcgaccgttatgccggtgaagcattttttccatagaccgaacggcctccaaatacctcttcattccttcttcttttgcctcaaaggatttgtcaacatgtcctgcaacagtttggagtcggttcggattagtaagggccgaaccccagtgcttttgcctttcttaggcccggaagaatagcttcgtattctgttgcgttgttggtagtttcgaactgtagccttgcagcataccgaatcggcacaccattcggcgaagtgagtactactgcaatgcctgcccccctgtgcgaccacgaaccgtcggagtacatcacccaaggctattcgaccggctcgggtttgggggcgaatgctggtgtccactcggctacgaagtcaaccagcacctgagacttgacagcagtgcgggcgacaaaatacaagtcgaaaggggatagctctgccgcccacttgctgagccggccagtgacttccttgcctcggagtatttctcccaaagggtactgcgatggcactataactttgtgggcctgaaagtaatgcttgagtttgcgcgaagccatcaccagggcgtagacgagcttttctatttcaatgtaccttgtcttcgctccttgcaatgcttcggagacgaaatagaccggtttctggcctgaatctgtttcttggacgagggcagcactgactgccactatcgaagctgctaggtataatagcagttcgcttcctggtgctaggctgatcaaagctggcgggctttacaggtattgctttaactcgtcgaacgctgcttggcattcgggtgtccaattgaattttcccgtgctccggagggttttgaagaagggcaaacctctttcggctacctttgagaggaatcgactgagtgccacaattcggcctgcgagcttttgtacttcacgtacgctcgacggaggcttcatttgctgaatggcatcgattttctcgggattcgcctcgatgcctctttcagaaacaaggaaacccaacaacttgcctgcacgaacgccgaaaatgcacttctcaggattcagtttcatgcccgctgcgcgcaggttgtcgaaggtttcctgatggtcggacgcgtggtcgaaagccttgcggctttttaagacggtgtcgtcaatataagcttccacatttcgccccaactgcttgcaaaggaccttgtacaccaacttggcgaaggttgctccggcattactcaagccgaaaggcatcctaaggtgacaaaaggtgccaaatggagtgatgaaggctgttttggggatgtcggccgggttcatgtggatctggtgatagccggaatatgcatctagaaaactcaagagttcacagccagccgtcgaatccactagctggtctattcgtggcaaggggaaatcgtccttcggacatgccttgtttaagtctgtgaaatcgacacacatgcgccatttgccatttggcttccgcaccagcactggattcgccagccattctgggtggtcgatctcttgaatgaccccagctttgagtaatttttgaacttcggcttttgctgcctcttggcgatcagcggacatcttgcgcagcttctatttccttggcttggcatccggcttgactactatgtgatgcatgatgagattttgttgaaacacctcccacttcatcggggctccaggcgaagatatcaatgttcttcttgagtacctctaggattttcttggcttcttcttcgcccatgtcgccccagcgatacgagctttgtggggtcggcatcatcgatttgtatcttggctatcttgccgtgaggggcgggctttggcacgtgcttcgcccggtcatgcggttcggcctcaacattgtgcactgctctgttgattatggtcagatcaccttttgaggcagccgaaggctgaagccccttaaccacgatcactcctgttgggccgggcatcttgagcttgagataattgtggtgggaaatggcttcgaacttgttcagggttgcacggccgaagatggcattgtagttgtacgggatgtcgacaacgtcgaacaatacttgctctttgcatctgttttcccctgtgccgaaggctatcatcaactgtgcttggccaagaacttgaactgcttctccgccgaagcctcgaagtgatgctggtgctggggtaagggcttgggtagtcaaccccatcttggtgcgggaacattactccttcggcatattcaggcccaaaagagatttggtggttcagatactgcggagccccttcgcctgccgaagtgatgttgtggatcgttcgtagctgcatcttcttttgtcgcttcaacagttgggttagcgggtcagcccttgtaatcacttggattattctgcgctgtgcatcttggcgctgttcggccgggggtgcttgttcttgagctacctcgcgaggtgcttcgaccgctgctccctgctgtgaccttgaatcttgtgcgttaccacgttgccgaatgtttcggcattgctccgtggtgtgcgaagagcgtctgtggaaggcgcagtagaggtcttttcagaccttcttgcggacgggcagtagatggttgcttgcttgctgagcgtcgaactccttgcggagggcgtgcacttcttcgacagccatcacatccttgcccgcacggtcggttctgaacttcctccaggtcatgggggcttgaccttgccttggcggttgtccttggattgccggctggggttggcgaacagcgaggggaggtggttcggcaacttaaactttgtgcttgggcttgagcagcggcgacggaagccatatcgtactcagcttgaatagcttgccgtcgcttggaatcgtcctcgccccttgcgaacctgtcaatgaagcgaagtaggtgctcaagcgtctgtggctccttgttggcgatttttcttgtgagttcgccctcgagcaggccagccgaagcagcgtttatgacagacgcctcggttatgtcttgaacttggcatcgggcctgcgagaagcgacgcatgtactcccttattgactcccccggcctctggcgaataccaagtaggtgctgctgcgttttcggctcttcataggtacctcgaaagttaaggacaaagacattgcacaattgctcccatgagtaaatgctataggctagcaaattgaaataccacgagcaggcgatgccgtccagagcgagatgtattacctttgccttggtattttcgtcgccatgagccgcttcgatcgcggactcgtaaatggagaggaattcttttgggttagttttctcctgagtagcgtgggacgggtgggaacttgaattggggtgggattggacgggtcttgattcccccactcagcggtagcccctttttgccccccgcccttttcacgacaccttgctgtgggtacggcgtggcgaagggcgaaatcacggcttgcgcgtgaggttgggccatggcattcggctgcctagctccaattggttacgcttgctgagccgccatggatgggtcaaaaattggctgcgaccatgtcatggcgacctgggttggtgcgtggcttgctccgaagcctggcgttggtgcttgcggccaaacggttggcgcctgagcagcattgataaagtcgaactgcggtccttgactctacagcgaagcccccattcttggctgatttgatggcaaacaactgggcgcaccttgacttgtattcccctccggg

SEQ ID NO: 14810 - DNA, 1087 bp, Oryza sativa
accgatctagcggccaactgtctcgacagataatctagcaaaaccaaaaagctaaagatgtctgcgggtactgataaatagagttagggtcgtacaaacccctctcgacgcacccctaatgggttccacacgatacacgggccaaaggcccaaatacggtgacgtaataccgggacagattctggccatcaaattgttcggtcaattcccattgactcggaaataatttgaacgtgggaccaaaaccattggaaatgatatcttcttagctttccatccatataaagaacgccccaatccgagcacgtatgcgacctgggcgcatgttttagtgcagactggtcctggactccgaattgcacctgacgtcgacttggtttgggcctccaccttgacttggacgtcccggatggtcctccatgggtctaagtccttctccaagtgtctgcttgtcccctccattgttactaatcacaatataatcattaggtagcaatccattctcgaattcatacaaagaagaacataggaacgagctcacctctaaatttaattgtcgctcacgagctcttgttatcggtccttgaatgaccgttggaggattgttgtgtgtatccgaggtagtgatgtccgcatcatcctccccctcttcaattgaagtcgtcctcgactcaagctcatcctcttctcccaagtatggcttcaaatctgaaatgttaaacgtgggactaaccccaaactcgggaggcaactcaagtttatatgcattatcattaatcttaacaattttaaaagggccatcagcacgaggcatcaacttagactttctcaattccggaaatctatcctttcgcaagtgcaaccaaactaaatcacccggttcaagattaacctcttgcctacctttactaccagcaattctatacttttcagtcatcttttcaatgttgaacttggttaactcatgcgttttcaaaataaattcagcgcgtgccttagcatcattatgaaccctctcacttgtaggtaaaggcaaaatatcaattggagcacgagggttgaaaccatacactacctgaaaaggact

SEQ ID NO: 14811 - DNA, 809 bp, Oryza sativa
  unsure (1)..(809): unsure at all n locations
cgtatgcttactgttactcttgcatctggcgaagcatgtcctgnagacgtgtcatgttctgtcgcatggcttccatgtcggcttcggtttgtgtttcggggtcatggttgacggcctgcacgccggcgagtgcggttgggccccctgccggctgcgatggagcgtcttgtggcaccaacaattggcttgtcgaaaggatctccgccctggtctggagtgcccttgccgccgcagcagccttcgtcatgtcggccgcgttcggcacctgcacagaggtggtaggggccgaaggcggtagtgatagcacaggtgcggaagcagatggcgctcctccatcttcggcaacgggcaccgaaggctctgctccctcttcggcggccatgtccgccccggcgtcgctttcctttcgcctcgtaaccttttccttcacgaccttcttcggtggcattcgctgtcagtggtttcgctcggaggtccccacggtcggcgccagctgttgtcgaaacgacaaccgcatacgtcgaaagacgtggttactctatagtgtattaatttgagaaatttttacttggatccccctatgggactatttatagcccccattaaaggttcttaccactagggttttggttatacaggggaatttacatgtgcactagggttcccgatctcccgaaaggttctgataaacaacgatttgggcggagtcgcgacacaaatcgatcttgcttcttgaacgcgcacgctcttgagccccgcaatcgcagcactacgtctcctctggttatcacctgtgtcaaaacgcggat

SEQ ID NO: 14812 - DNA, 1301 bp, Oryza sativa
gggactaaagatcttttcccgctattaccaaattctttttaaacccggttcgggttaggaaccgggagtaaagataataacagttgtgtcttcaattacattacatatgtgtttctaaaataggaaatagtgcattacaattatttaaagtcgcacaattaatgataaaaccttcgaaaaaattattgttgtccgtagtagaatacgtggataatatataataagcacatgaatgatttaaaattgttaaaaattctaattaacatatctaaatagcacaggcatgatttagaattaatacaaaatctaatatcatatataactagcatatcatgatattaaattgttaaaaattctaattaacatatgtaaataccacatgcatgatttaaaacctttagaaattctaataatcatatatatgtagcatatggatgatttcaatttgattaaaattctaataatcatatatatgtagcatatggatgatttcaatttgatgaaaattctaataatcatacataattaacaaaaaaattaataatcatatataactagcatatggatgatttcaatttgataaaaattctaataatcatacatatttaacatttgccatacaacaattgattagtatagatattcggtacatccaacatagtttacatcgtgtacagaacaattacggcaatacatcggcggtgacggttgaccggacgtactttctcctcactattgttccttccttgtgatcgctacgtgagtaaggggtgtcttcatttgataggaggatgctagggtcaattgtcaccgtgaaagggggttgcccatcaaactgatcgtaatcctcatcagtcttgtcctctactccgacgatttttctttttcttgggagaaccacgtggcgcttcggctcgtcagtcactttgcccttttttcctttgctagacatgtccttgacgtaaaaaacttgggttacatcatcgacaaggacaaaaggttcgtccgagtatccaaccttgttaaggtcaaccgttgtcatcccactgtcatcaatcgttacgcctccaccagtcaacctaatccattggcaccggaacagagggaccttgagaggtccatagtcaagttcccatatgtcctcgatggcaccgtaatatgtgccagatgtaccatcgtgtcccatggcatcgatacgaacagcactgttctggtttgtactcttcatgtcttaagccctcgtgtagaatgtgtacccattgatttcatattcctggaatgtcgcgatcgagccagatggt

SEQ ID NO: 14813 - DNA, 5165 bp, Oryza sativa
ttttggcgcgaactagagccaagtgctcctcgatgtagggagccaccaatgaagattgttgcagaacagtgaaatgggctttacggaataaatagttgtctgccgtcattattgctttcctttcgagagtcccctttccccgtagtctcccttcatggcgtgattcaggtaccccgattgggcgaaggtcttcgataaattctacgcagaattcaatgacctcctctgttccataccccttggcgatgcttgcctctggacgagcacggttatgaacatacttcttcagaacgcccatgtacctctcgaaaggttacatgttgtgtaggtacacaggaccgagaataccgatctctttgacaaggtgacaaagcagatgcgtcattatattgaaaaatgaaggtggaaatatcaactcaaagctgacaagacattgcaccacatcattctgcagggcttctaatctatcaggatcgatgaccttctgcgaaattgcgttcatgaaaacacatagctttgttattgttgtccggacattgtctgggaggataccccttattacaactggtagcagctgtgtcatcaacacgtgacagtcatgagactttagatttgtgaacttcttcttcttcgtgcttattattcgctttatattcatggagtatccagacggtaccttgatgctctccaagcattcaaacatactttccttctctgccttgctaagagtgtagctggctggactcaagtaatggcttcctttcttctttggttccggatgaaggtcaccgcgttgttccatatgcttcagatcattacgtgcttccagtgtatctttcaactttccatatacacctaggaagccaagaaggtttacgcaaagattcttagtgaggtgcatcatgtcgattgcgtggcggacgtccaagaattcccaatagggtaactcccaaaatatagagttctttttctacatcgccgcgtgaccatcttcgctctctataggctggctgccaggcccctttccaaacactactttaagatctttaaccatagaaaacactgtttcccgctgcgatgtttaggcttcgtacggtggtcctccttatgttcaaagtgcttgcctttcttccgtacctggtggtttgctgcaaggaatcaacgatgacccatgtacacaaccttcctacagtgcttaagatacatactttctatttcatccatacagtgagtgcaagccttgtaccccttattggactgtccggataggttgctaagtgcaggccaatcgttgatggttacgaacagtagcgctcgtaggttaaactcctcctgtttgtcctcgtcccacatggggacaccttccttcttccacaacagtttaaaatcttcgaccagtggtcttaggtacacatcgatgtcgttaacaggttgcttgggcccttgaattataatcggcatcattatgtacttcctcttcatgcatagccacggggggaggttgtagatacacatcgtaacgggccaagtgctatggccgctgcacatctcaccaaaaggattcatgccatccgtacttaaaccaaaccgtatgtttcgtgcgtcctttccaaagtctttaaattttctgtcgatgtttcgccactgcgaaccatcggcggggtgtctcagcatcccgtcctgtgacgctcttcagcgtgccaccgcatcattctagcgttccccttgttcctgaacaaacgccttagccgtggtattatagggaaataccacatcaccttagcaggaattctcttcttcgttagctgcccgtcaacttctcctggatcatctcgtctaatcttgtatcgtagtgctttgcaaacagggcatgcttttaggttctcgtactcctcaccgcgatataggatacaatcattcggacatgcgtgaatcttctgaacttccagtcctagagggcacactatcttctttgcctcgtacgttgtctcgggcaacttgtttccctccggaagaatgttcttgacgagtttcaataaatcgccaaatgccttgtcactaacaccattatttgccttccattgcaagaactctagagtggtatccaactttttgtgcccctgctcgcaacctgggtacaacgacgttctgttgtcctctaacatcttgtccaatttatgggcccccttttcactttcgcaatcctccttggcgtcctgcaacatctgaccaagatcatccgcaacgttgttaccatcagcatccctttcctcctcacccgtttgattttcttcaaatccagcgtactgagcaaagtccggaatattatcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgacatgaaaaaaaatcgtacacacataattattcgtacaataatgacaatcatacaataattataaaataattacaaactctttcaacagtcacacaataatgacatatcattattcctacaaatattatgaaatattacaccgaataattatatatttactatttataaagttttaaactaatattaatgtgttgtacttattttaatttttcattttactttgttttctattattcaagattaactttcactatattttccttctcaacttttttataaaaccttctttagcaaataaactaaatttctatatattctttcttctccccccaaattttctctctcatcaactaacaacaaaattttgaagacaaaaaagtgtgcaaaacatagctccaaatgtaatatgaaaaaaaaaatattggaggatgaagttgctaaccttttaggcacctccgatttgtatataatcaccaaaataaattcactagaaattttggcatgacctcccctcttttttgaagaaattttgaagcttgctcgggctggaggaggaagaagacatatatataggggtaggactttagtcccggttggtgttatgaaccggggctaaagatcgccgtgatctgttaccaaccgggactaaagttacgatctttagtcccggttggtgttattaaccgggactaaagatcccagggggggcctgacaggtcctgacagcatttgaacagggactaaagatcatttttagtcccggtcaaatatgcccattaccctttttaaccgggactaaagatcatctttagtcccggtttttgttgcaaccgggactattgtggaattagcccgaccgacgaaagatggtttctccaccagtgaattgacttgtgtgtagattatatattgtatgttaaattgaaccggccatgtcctttatataggggttagtcttgccacctacaggtcctcctctatgtctaattcgggaaagaaaccaaagaaaacctgtgacatagcctcccgagtaaggaatcccgaggccgacgaaaatggacttgggctcaaactctgccggtctgaccagcaacatgccttcggttagaccggccctcagaccatggtctgaccggcccatacacggcggttagaccgacctagtggaggaaaccggtgaccttcccaaatcttgggcaatttttcttattttgaacctatctagcaaatttgggtgtaaacaattgtatcaacatatcacctcaacttcgttgatgtggtaaacttgtaaacataggtcctctctgtcctttttcttggcaaagaccacactattttctttatcgttgaatcgttgtagcgcatcaataatcggaacccaaactcctttaattttcacacttagtaaattaaacatagttagcccggatgattatgttatcagtaatcaccaaaactctaaacaagggactaggtgcttacactcgacactgccagatgctgggaggctgtccgaggatgttgagtctcacatggttagctcagagggtggaaaataattgagagaagttgcaagatgaaaaaacaaaggaaaaccattaactctactcactggagggcaaatataagtatatgtaatttcaaattgctattaacttacaccacaacacatgatgatttcaaaatcatagatgagtaaaaagccccgtaattggttcttatatgtattgcatgcatggctgatcataaatttgtataactaatcatgctgtcgaatgacttgcttcactaagcactctgcattctttagacagaagccatgtaatccttttttatcttcgccagtctcacaaccacttcgctcattgtcattctttggtctggtaattcatgtgagcattgtaaacccaactcaaaaactgggactataaagttattcaatgaactagaggaatcttgcaccagtaaccggttatccaccacatccatgacatttgatggaaatgcactagtaacccactgccttagagatagttctccaacaaacatgggatcagttggcctctttccagtgaataactccagaagcataataccgtagctgaatgcatcgcttttccgtgatgctttcccaactgacccatactctagcaatattttttccaaacaggagaggaataaattagtagcaaaactaatagttgaatcaaaacgagagaaaaaaaaacatactagaaatacctggtgccatataaccaattgttccaggcatacttgcagaaataacagagttatcgtcaccacgtaacagttttgcaatcccgaaatcggccaccaatgcaaccatgtcttggtcgaatagaacattgcttggcttcaagtcgcagtgtaggactacctcacagtgatgatagtgaagatactccattgccatggacacatccaacagaatgtccagtctctgaaggaatcccagttgctctccaccttcagagtgtagctgtgtttctaagcttcccttgggcatgtagggaagaaccaaagctctgaagtccaggttgccacc

SEQ ID NO: 14814 - DNA, 14657 bp, Oryza sativa
gctttctctccctccctccccccacctcgccgccgctggagcccgccggcggcgaagccggcagcgggcagggaaggcagcggcgaggccttcttctcttcgtagcgtctccctcctcggcgcgaaggacgaagacgacgaagctccccaccggcgtggtccatagcggctacggcggcgaggtgtggagaagcggcggatccggagcccccatggccggatccggccctccctcgcctggatctgcgtggcggcggcgcgaggaggcctggggcggcgcgacggcatgcggtcatggtggcggctggctgcaaggcggcgaggcggcggccggctgcggctaggccggcccggcactggcgcggaggtggcggacggctgcggcaaggcgtggaggcggctcgtcagcggcgggcgcgggcagcggatggccgcggctcgtcgtggccggctgggtcgcagaggcggtggccgcgcggaggcggcgggcagctaagcctgcccagagcggcagcggtgcccctgctcactcgctcgccctggccacccagcgccagcccatggcgcggtgggtcgtccaggcctcggtggtggctcggcgtggtggccgggcagccgggatgccgtcgcggtggctaggtgaggcgcagcggccggacttcaggggcgccggcgggtggcgccggtccggagcagcagcaccaccggcggccagatggcagtgcaaagggagctggcggcgatgggccgtcttcctcgttgccggtcggcaccctcggccttcgtggagctcctccccttctttgcggggagtttctaggttggattgaggcggcagctcatcaatgggggaagctcaggctgccgaagcaatgccacctagtcccgggttctccttcggccaaatctggcgaggcggccggcgggtggtggaacggaggagtcctaggccagctttcaggggtggtggttcgttgaagtcgaccgacggaggggcgtcggtgcggtgtggtggatgccacgtgctgccatttgtctgtgtggtggttctgagttggtggatggcgatctgcagtcaaggttgtagggacccaggcgaaagcctagtccggtggttcccgggccgtcagcggctacgtcttcgggcgtcgtaatctccttggagcgttgtcgagggttaccctctccctttcttggcgagcttctctgggtgaaaaccacatctttttttatgggcgatggcggcatcttggatgtcgtgaccaccatggtggcatcgttttcggagcctcgtctctgtggtgttgctgtaggcctagcggcgttcggccacgctcagcgggggtcgtttggtgctaggtttcaccctcagcggtttgtgcttgggtggtagcgcgtggtgtgttgcaatgcaccttggtgcattttgttgttttttctcttgtaacttttattccttcttaatatactcggttggcctccttcggccttcccggcgaaaaaaagaagtccaggttggaacaagtggtgagtatcctaatcaagttgcgatgccgggccatgcgcagggcatgacactctgaatcgaagcttctaatagcttgttccagctccatgttgagaacttttattgccaccatagtaccgtcgttcagttggcccttgaaaacttttccaaagcttccagcccccaacaatttagtctcactaaaattatccgtggctcggacaatgtcatggtaagagatcaacctattgttgagcacatcttccatatcaggagaaatgattctatcttgttgcttggctttcttcctcatcatcatgtacatgcatgtggctataactccgacaacaataataacactggggagcaagaatttagtatttgccttttattactattattgttgctctaacatggcataaaccccaaacgtggaacaccaccacaaaggcgggggttgcccatcaaagattgcagggtgatgtttgcaaagatgccaccttctggtattggaccatgtaggttattgaatgaaaggttcaagctagagagatcagtaaaatttgctaaatattgtggaattgtccccgacagatcattgtatgaaacatccagtgatttcaagttgatcaacttgtcaaaagagtttggaaatgaaccatttagtgagttgtgtgacaggttcaggtatgttgtcattagaaactgtccaaaggattcagggatcctaccaaacaaccggttggaagagagatcaatcctgtcaatatgatttagctgccctatatctactggcaatgcaccttccaaggagttctgagacagatcaacggttatcaagctattcatatggaataggcttgctggtatggttgatgacatatgatttttagatagaacaagatattgtagattactgaggtttccaagatcgtttggtagcacacctgagaagttgttgttattgagtattagtgtttgtaggttccttagatgacctatttgtcttgggattgtgccagacatgatatttccagagagattaagaacttggagcttgtccattagcatgattgattctggaatagtaccagtcagttggttgtttgaaaggtccaaccaaacgagattgcttaaattcaacagggtagaaggaagatcaccggataacctgtttcctactgcaaagaaatttattagagtacttgagaagtttccgacatagttagggagctcccctgtgaaataattcaagtcgaagccaacttcccagatattttgacagtttgaaagtgtagccaagaagtcgaggctcccttgtaggtagttgtctccaatattgaaccattcaactgatcctgtgctaccgattgcagttggtactgctccggtaaaactattagcaccaattaagaatacagctagttccgaaaagttggcaaaaaaggtagggatggatcctgtaaaatgattatggtcgaggaatagccctttgattttcctgagctgtgcaagttcttgtggaatctgtcctgttaaattgcaggattgaaggccaagggtgtcaagattactaagattacccaatgcagatgggatcggaccaacaaggttattactctctaaatcaagtaatacgaggtctggcagttttcccaaccatgctggaactgggccctcgaataaattatgtccaatgaaaatccattggaggtatttgcagtctgcaagccccaacggaatctgtcccatgaatctgttttcatacaagcagatcttttgcagcatggggaggttgaagctcttgttaccagggatagatccatctaggtacccgttgcctccgagatgcaacatttctagtttggacatgttgaaaattaactcaggtactggtccagaaaagtggttatatgctatttccaagtgttgaaggatgggcaaagtgccgataccaactggtattgtccctgacaaactgttattccggaaggttagatattttagcttaggggtgttgttgaacagatcattgggtagtggtccagtcaaataattcactagcaaatctatgtacctaaggttgcgaagattctgcagctcacgtggtatttgcccagagaggctgttataccctacgttttgggagaggagactacgccgccgcagcggcgacacagtcgggcgcatcctttgtgaccatgcttgccctggccaccgccgccggcgcgcagccttggatcgagaggggtgagacctccacgacgccgccgcgtagctttgcgacgtcacagctgcgcaaaagccggctgcgccggaggggatggaagaagaaaagttacacccgcagggaagagatggaggatgtctgcagctggaggggatggaatggccacgaccacgaggaagaactatgtcgaccccatcgtacccccatgtattgaacggtcagattacaactggtatctacaggtacttgtaccgggcggtacatttcgctggaccggaacaagcctccgggaggtgtggattgtggtgttggggaggagcggaccatgcgaaaacccagctttgcccttccacctgttcggcgaaggggaggtaccattgaggagattttggtaccggacagtaccgaggattctcatccgttagatcggactcaatggatggctctgattacaggtactgggaggtaccaccagtcatgatggactgtaaaaaaactctttttagatagaacaagatattgtagattaccgaggtttccaagatcgtttggtagcgtaccagagaagttgttgttattgagtattagtgtttgtaggttccagagttgacctatctgccttgggattgaaccagacaagctatttccggagagattaagaagttggagcttgtccattagcttgattgattctggaatagtaccagtcagttggttgtttgaaatgtccaaccaaacgagattgcttaaattcgacagggtagaaggaagctcaccggataacttgtttccttctgcaaagaaatttatcagagtacttgagaagtttccgacatagtcagggagcttccctgtaaaatcattcaagtcgaagccaacttcccagatattttgacagtttgaaagtgtagccaagaagtcgaggctcccttcttggtagttccctccaatattaaaccactcaattgatcttgagctaccaagtgcagttggtactgacccagtaaaactattagcaccgattagaaagacttgtagttcagaaaagttagcaaaaaaggtagggatggatccagtaaaatgattatggtccagatacaatgcattgagttgctgaagctgtccaagttcttgtggaattagccctgataaggtacacgattgaagaccaagggagacaagattagtaatattacccagtgcagatgggatttgaccgataagattattgtaacctagatcaagtaaaaggaggtctggcagtttgctcagccatgttggcacagggccctcgaatgagttctctccaatggaaattatttggatgtatttgcagtttgcaagccctaatggtatctgtcccgtgaatctattcgcaaatagagagatcatttgcagcatggggaggttgaaggtattattgttacctgggatagttccagttaggccccagttgcctccaagagataatatttgcagcttggacatgttgagtatagttgttggaactgggccagagaagtggttagcctgaaaatcgaggtgttggagcatgcctaaggaacccacagaatacggaagtgttcctgtcaaactgttgttcccaaagtctagatattgtagcttagaattgttgctgaagagatcattcggtagtggtccagttaagtaattcgttatgaaatctatgtgcgtaagattgtgcagtttttgcagctcaagtggaatctgccctgatatgctgttgtgccccatgtcaacaacctcaagccttgtgaggtttcctaccactggtggaatgacgcctgacaagctattccggcggaaaacgagaacttcaagacgatgcagctttccgagatcggctgggatggcgccggtgagtcccgtgctagtgaggttgaggacagtgaggaaagagaggttaccaagatgaggcgagatgcttccctggagtggcacatcgtgcagcacaagggcaacaacccgtgcccggcggcgactacatgacacgccgaaccaatgacagaaagatgtggcagtagtccagttggatagaacgccgcgagggtcggcgagctgggctttgaaagccagcagcgcggtaacgtctgtgtcactgccgttgccggcggtgacactgtctggggtcgaagcaatggcaatagaagcaatggcaatagatgctaaaaaccagaggtacagtagcagcgtaatcatgatcgaagtggccatgtatggaagctggttggactggagaaatttagctaatcggctttgtagtttgcttaattatatagcttgcttacaacttctcttcttatatatatagcctcctttttgtgatgtttcacagtttcattgaatcggtagcctttcatgctttgaaagagaaattcaggggaacgaggagaccttgacttaggccttcgtgtaaatcacagccttttgtacttatagaaatattaatgggttatgtaccgtactaccagcgagttgagataatctattgtatactactgggtttgttcgagtttaacgatttgccattgacattctttttaaaaatacccaaaatacccttatgaacatagaagcttagcaattgatttatcttattagaagttccaaaaaaaatatgaaaacttttatgtggcctccttattacataacatggaaatttctataggagttttaagttttttacatttatttttttaaaaaaaatataacttatctgttatatggtatataaaaatacctttttattagtttttaatataaatcatctttcacacactacataagatagttttatgctatcatctcctggataagcaaactctctctcatataccacgtaaaaacacttttttaaaaaaactaaatataccagaaaaaaaattacaacttgtatagaaacttccatattgtgtaaggaggccacgtaaaaattttcatattttttttgaaacttctaatgagataaatcaattgtttatcttgtatatctctaagggtattttgggtattttttgaaaagaaggtccggcctaatggtatatcgtagaacaattgttaaagtcaccggtatattatagaaagagaccatgtcgatggcaaatcattgaactcgaacattaggggtgccaaggtttcttcagaaatttgtggcgtggttagtgtttgtagatacggcgacaccgctatggcgagtgggttttcggtttacaagagctatttcatcatataaaattgttatacgtgatgtctaatatccattaaattattgttgagggtcattatagaccaattttgattgtcaatatatctaaaataaataagaactagtaatgcctgcatacatatttgtttaagaataatctattttcacttgtacttggaactttatttgtatgcgggagatcttcacataaatggaggagatgatggaaaataactgaataatcaatcgaagtccgacgagtggcacacttatggatggatgggcttacaaacccattaaaaggaataagatcactttgactccctcaactgaccaccgaatctaaatcgtatccctcagccacaataccagaaatcttgacccccgaacctgcaaaactggtgcaatttggctcccttagtggttttagaggacagtttcgctgacgtggcggacacgtggcagtgttgacctggcctttgtcccacgtggcattgacgtggcgcttatgtggcattaaaataaaaaaatatatgcggggcccatttgtcaattaaaaacaattgtgtcagtgggtcccacatgtcatcctctcttatcccttcttcctcctccctctcctcccttctctatctctccctctttctcctcgtgcgtggggagcggcgtccggatcggcggcagcaacggcgggcgatggatggagcggcagctatgggtgaagggtaggcggccgggtgttggagttgcggacccggaggccggatatacccctagcttccttcctcctcccgatagaccacaccgtggccgccgttgcgccaccgaccgtcgctggtgacctcttaggccgtgtggggcaagcgggtgcaggagtgacggtggcggtggtggcttctcacggtggaccacgatggtggtggtgccctcgacggtgtcgcgcagccatgcacgaggagctcaggaatgcatggcgactccgcggcgtagcaccgagctccatcaacctagatccagagctccgaatcggccacgacgggcgactagaggacaagctgcagcagcagggcgggggcggcggcttgatgtggtcacagtggcagagacagtaaaggctcggtggaaggcgtcggccttcatcgtcggtggaaggcgtcgccggagaccactcattgcttcgcgtcgccacctcgaggccgagacgcacccaccgccgccgcaaaatcggaggtggtgcacaaccttgagcgcccgctctgcatccttaaggaggagctgctcccatgcccgttgcccgaggtccaccgcctaccaccggctcatgtcaaggggggagagagagagagagagagagagaaataagggagagaggaggaagcagaagggtagtgagagagaagatgacgtcagtgggtcccacaattttttttgaatgacaaataggccccacatatattatttattttaatgccacattagtgccacgtcaatgccacgtggggtgaagaccaggtcaacactgccacgtgtgcgccacgtcagcgaaacggccctccaaaaccaccaagggagtctaattgcaccggttttgcaagtttgggggtcaagatttctgctattgcgattgagggatacgatttaggttcggtagtcagttgagggagtcaaagtgatcttattccccattaaaatatctgcaattgggccaaaccaccatgccgctggacttaagatccatcaagcaacgcactagaaaaggcacaggctaattgggccagaccagggctaattcggctgaaacccctcctgcgcgtttccgacaattccaaccgccacaaccgccattgccagcctatttgaggagttcactctctattccaaagggcgccaagaagaagtcaagagctctctccagtttatttatattgttctagtgctagtggtgtaggaatagaatttttttcttagttcttcaagtctttaggagaattcggatatagctttagtagcttctctctcttttgtaagacttaattcattaatgaaatattcttgagaaaatttcctatgcacccatgaaacttcacccaatccattctatgcccctgagatttgctcattcccttcgatacccctaaatttcagtttggatcccttctataccctttccattagttgaccactaaatttctatcatagagtccattttgtcctttgctatcaagaaaatataaatttatgaactatattgatgaagcgtataaatttattgtttgtgactattatatgtatgagtttattttgtgagatattatttaacaaaagtaatattttagtttcgcctcgcgaagggaaaacaaaaataatttttatctatggcaaccctttggtatcaagaaaatataaaattatgaagtatattgatggactgtataaatttattgtatgtgactatcatatttatgagtttattttgtgagatatttttaacaaatgtaatattttagtttcgcctcgcgaaggggaaacaaaataatttttatctatggcaatattttagataaaacaaagaaatatttttgaccattaaaaactgcatattttgttatagtagtatgaattttttataagataaatcttgttatgcgagattaaaattatttttgctaaataatatctcacaaaataaacttataaatataatagtcgtatacactaaatttatacactccattaatataattcataaatttatattttcttgataccaaagggtaaaatagagtttatgatatgaatttaacggtcaacttaacgtccaactgacggaaggggtacagaagggatccaaactgaaatttagggctatggaagggaatgagaaaatctcagggtataataaggattggatgaactttcaaggtacatagggaattttctcaatattcttcttattatagtttcggtcctttactttacttatataattattcgagtaccgactttagttcatacttgtctcgtaatagttacgtagctagcttactggagatctgcaatggtattgctttaatgctcatctatatgattgctctatgtcatctgctgagatgtagagtagtattattaaatggtattatattccattatctaaagaaaatggtgttatatgccatgggtctgtagaggtaggccgctgatggtgacagctcagtacggatattcctcccatgtgcgtatataatactaagagaattttttggtgtgggtatttctcggtattcattacgggttggatggtcataacgggttgtcataaggaactcggcaattaggggtggtttcttgatatatcaggtaggcatagttagggggtattggctgcataattgtaatagcaagttgttggcggtgtggcatgaagcccttcgaccaaatctaccgaaaccatgtgaatagtggagattcgagcccgagacatcgacgttagacggggcgaagtccccccatggcgaagactatggaacatgaacggcgaggggcgagagatcgtgcgagtaccttgtcaagccagaggcctcttgggcgaagggtgcagggcgaagagtatataccggaggaagatgacttcgccacagcaagttcgcccccgcgagggccgaagaagccttttcgtcccatcaaccccagggaccgtaaggccgacgatcgcccgatggcccatcaggggcccatgagtccttattacattatgtacccatgtaaatgtccctttcataagggcaaccatgatgcggacatcactatctcggatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagacccatggaggaccatcggggacgtccaagtcaaggtggaggcccaaaccaagtcaacgtcgggtgcaattcggagtccaggaccagtctacactaaaacgggcgcccaggtcgcatacgtgctcagattggggcgttctttatacagatggaaagctaagaagataacctttccaatgggaattgaccgaacaagttgacggccaaaatctgtcccggtgttgcgtcaccgtatttgggcctttggcccgtgtatcgtgttggaacccattagggttgcgtcgagaggggtttgcacgaccctaaactctatttatcagtacccgctgccatctttagctttttgggttttgcttagattaatctgtcgagaacagtttggccgctagatcggtttgtaagaccccaactcgtgagcttaatcattcatctgcaattttggttgtttttctatctcgttcttgttattgttcttcgattggcaaacaaggattggccttcttggcgaggtcatccgcgtttggacacgggtgataaccagaggagacatagtgctgcgattgcggggctcaagagcgtgcgcgttcaagaagccggatcgatttgtgtcgcgactccgcccaaatcgttgtttattagaacctttcggaagatcgggaaccctagtgcacatcaagtggtatcagagctcttggttcaccgtcatgttcgctcagtttccttaacctagagtctacagaaaagccaaaaaaaattttagttgttagttaccttaacctagaccgtgtttagcctttacatgattctttttcagagtccgtagtgttgagtttgagtcctagtttaagttcctgttgctggtctagtgcgtgttttagtctagtcatgtgtttgtcctttgtaaccctagccgccacctttcaccgtgtgttagggttcatcctttgagagccgtttccaccatcataaacacccatccagatcaccatgcatcaccaaaacaccctacaactccgctgccaccacattccaattccaccgcataatagactaggttatatcccctctggaaaacctagtcggaagccgaaacttcaaacagccataacttttgcatacggacttggaatcaggcaaactttaacttttcggataagagaaaaaaaatttacatctgtttctccccgccttagcggattggcgaatccaaaatttcgaaatttggcttgcaaaattgtctgttcgagctcacaagttcctgcaccttgtttatagaggtttcaagaaaaatccataggccgacatatcttactccgattgacgctgtaacttggagtgtgtgcgctattttcgctgttctgaaaaaagaaaaaaatatcaaaaaaaataaaagaaaaaaaagaaaagttgatttccactagtacattgagctcacgacgcgctccattgagcttatctgccagtacggttatgtactttttgctgaaactcgccgaagcttgcctgccagtccttcttggctgtttactagtgtcatattctttgagccatctttgttatcactactgtctaggacacgagtagtccagtaactaagggcaagtgacttgggatttttattcagcattactatctgtcattggattgtgtaccactcatattcgtatatttggccttcctagctccacttattacttctggacagcacaggttcttgatccctgcaatcactgactacgccttccaggtatcctttgctttgctggtaagaaccttataagagcttggttaggaactccatattgctgagaatcgttgaaaggcaccactacacctgcgtagtggattattagggataaccttcaccgttttgtttctgttttggtgtttcaatgtcaggtaacgaaggtgagaagagtccctaggattttgctgactgtgtcagccaagagcaactacgaactctccaacaaaatactcaaaaggacatcacggaggccgttgcaaagtctgtccaagatgccttcactaaaatcggcttcctgaaccacatggagaggttggacaagcggatatccacgctaactgatcgggtcgccgcgttggagacaccttccaatgaggaagtggtgagtggtgatgacgatgctcatccggaagacacggtgtatgattccagtggctatattgacgcaccggctacaaggcaagcacagctacgacgtcgcctacgcacaaactgcataggtatgggtggcactcgccaccaacaaggtaataataataatcgtgtgtccgatgatccttatgctaaggttaagtttaaaataccatctttttcgggatattatgatgctgagaaataccttgattgggagatgacagtagaacaaaagtttaatgcccaccttgtacccgagcaacatagagttagacaagccagtagtgagttcaaggattttgctattatgtggtgggttgggttaactgctgagggggtactacctactacttgggaagaacttaaggtagctatgcgcaataggtttgttcctccatcttatcatagagatttgcgcaagaaactgatgcgtttggaacaaggggataaatctgtacaggattactatggtgagctacaaaagggtgtgagacgctgtggcatagtggagggggtcgaggatgctatttgtcgtttttattctggtttgaggaaggaattcaaacattgttgattataaggatttactcctgtcaccagttgtttcggtttgctatgcttgcagagaaggaattacaggggcgcgaccatcagggcaagagcaaggcaagcacatacactccgcgcacgacgccatctgcggcactgccaaggccgtctcttttcgggtgtcctcccagccagcgggcaagcgaccagctgcatccggagcttctgcggcaccaaaaccatctccaccaccacgaccagcagagtcaggtaaaggttccacgcaggtacccgccaagagtgcctcatctgtcgcctcgacgggacgcattcagtgccaccgttgccaagggtttgggcatgtgcagaaagattgccctagtcaacgggcctatgttgctacagaagatggctacatcaccacctccgacatggaagaggaagagggggaagaagaagttgaggatgaggatggcgaagtctttggtcgtgatgacacaacggactacaggaccaacattgtgcagtgggtgctcagcatgcaggtacagcagcatgacaggttgcaacgccataatttgtttcagatttttttcgtcatcaacaaccgtcgtgcacgtgtgatcattgatggaggtagctgcaacacacttggtgagttctgatttggtcgagaagcttggcttgactacacttacacatccacacccttaccatattcagtggttaaacgattccggaagagcaaaggtaacactggtttgtagggtttcgttttccattggctaatatgcagattctgttgattgtgatgtggatcctatgcaagcttgttcacttttgctgggccgtccttggaacatgataatgatgctacacaccatggtaggagtaataaatacacctttgtgcataatgggaagaaaattactttgctacctttgacccctgctgaaattgtagaagctgataaagagcgagc

SEQ ID NO: 14815 - DNA, 630 bp, Oryza sativa
  unsure (1)..(630): unsure at all n locations
cagagtatcatcatctcagatacaagctgcattgctgggttggattggtcttcaacatatagattaatgtttggttcaggatcatcaggatttgccaccttgatacgtgggtctatcatagcagtatcaatcgaaccctgtgaacttcagagtgtcaattttgtcaaataacaaatgcatcgtagtactgatgtaatacttcaaaaagattttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacaggtgcatttcattctgctttcatttgctaatcacagatgactcataaaaagacaatgtattgataacttttgaaattgttttaatacaaccttttcccccaggncttattggggggggcgagggaatactaggctctttgaatggttcacatggctcctataaataaagtccaatgatatttgaactacacttgagaacatgcttgatggtgacattgacaagaagccaactttcgtttatgacttg

SEQ ID NO: 14816 - DNA, 833 bp, Oryza sativa
ttttgtcccgtgatgcagcatcaaccagctgatcggctacgggcattggatattcatccctcggtgtagctttatccagatctcgaaatcaatgcacacctgacccttcccatttttcttgataactggaactatgctagaaacccatccagcgtatcgccaaggacgaataaaatcagcatcatacaatcgtttaatctcagctttgacaggttcaagcatatcggctttacatctcctcggaggttgctggtgtggcctaacccctggtttgataggtaaccgatgttcaacaatcgatcggctgagtccaggcatctcataatactcccaagcgaagcaatctctaaactcttttaagagttctatcagcttggttctaaactccggagataagttcttactaataaatgtcggccttggccgatcgcctggacctatgtctatttcttccaaatcatcggccgacatgaaaccttgaccttgcttgtcatcgagatcatctactgtatccttagggtagacgactgaaccccccacgacgccctcaaaataatagcttgggttctccatcttcaattggttgtatatcagaatcggatacttttagaaaatctctatcccagacttttccagataaacaatcaaggctatccatctcccaaagagctaaatcagcactggcaacattaactgacctgtcgactggcacgatctctatcttgtcgccttgccattgaatcaaacattgatgcatagttgaaggaatgcaacaattatgatgaatccaatcccttccaagcaacaagctgtaagaacccttcccatcgatg

SEQ ID NO: 14817 - DNA, 432 bp, Oryza sativa
tgaattggcaatagctaaaccacattaggcagcaacttctcagttcgctcacctgcaattgtaaattctaaagtgcgctcaggtgagtaagcataccacatgaagaaaaagaaaccggtgacaagagcagggtatctctctgcaaatcccacaggctttgcttccctgtaaagtgtaatagcaatttctcagttcccgaaattgaagttacatatacagggtggtgagaagaattggaattagttcaaatagagaatgatcacttaaaagtttggcacggttcttttgtttaggaggcgttgtccaactagtgaaaaagttaccggattcatagcttgtccctaattgctgcaaacctatcttcctagctcttaactttccattaatgaaagagcatgctagcctattgattcaaaaagaaaatgcatatct

SEQ ID NO: 14818 - DNA, 166 bp, Oryza sativa
agtagcggacgagagcggcaagcggagcggtgagcgagagcgatagcagagtgactggcgagcgaagctagccgtggacggcgggcgagatcggtggcgctcatcatgctccagctcttcattgcctgcgtcgtcatcgtgttggttgacctccatgagcgcagca

SEQ ID NO: 14819 - DNA, 8521 bp, Oryza sativa
  unsure (1)..(8521): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagagagctcccccggatactagctgatgctgagcggcatagtggtgtgcactgctggtggcagtttaagttttctttgtttctcgatgcaaatggcacatgcacttcaccacgtcttctgcatttcatgactgtttctaaccggaagaaattttataagtgccatgtcttgactgacgatcatagtgactgaatttgctaaccaactgagaaaattcagaagagggcagtacaactctacgagtacactagtacactgctgcttaggtcaaagtaagacgtgattcaactgagaaattcgatttggctcggccaactggttgcaaaactcaggtctcatatgttggttcagatgcaaactgatgggttgtctgggatcagattctcaggatcctcgtttttatttttccacaagtactagcgtgtacgattaacctatcatcctgaattactgatgagcactagtagaaaacctactggcattgtagccagggccggtcctatgattttgagggtcctaggcgaattcatcacgatgggtcctctaagctatataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaagatacttctcgagcatttcttgatgcaaaatcatcaagaacaagtcgacgatgttgtgcgcttgtgcggttgtgccctgtgcgatgcgatgtcgtctgccgagttgccgacgacgctacaactcctatcgtctctcggacgtttctgcttccagatagacaataggcaggtactagactactagtattaggtgttggcccctccaccatcataggcccccgaccatcatgggcccccggcggtcgcctcggctgcatagccctagggccggccctgatcgtagcaaggtacactcacgaacaacagtagaggagagcaaaaaggccacgcgttttttttaagaaaaatgatgacactgaaacgcacgtatgactcgctcaccgggcttggaaaatttggagtgagcacaacaggcgtggcggacctctcagtagacctctcgcgaatacttgctacagtaaagttttccacttccctactcctctctctttcctccggcctaaggtggcttctcgccgatgaagaccgggaaaggggtcaagtccctcttctcctattgattcaggtttttcccgtggtctttttccttttggttctcgaggtggttgttggcgttggccgtccttgtcccggcatctgggtgagcgttgtcgggcttcttctcagaggcgatttactccatcgctgggactcttctcctgggtactacctagggcgcctccagatatgtacaaagagaggtatcgcctgcctacataaacatctccggcaaggtctttctaaggaaggggccttatgcttgatccctggcgacgaattttcacttggtggctaaaattttcaggttgcgccaagggggcctcaaccgggtacgcctcctgcctttttcacggtgaaatacatctggctgtgatctttggaatagttatggttttttaccgatttctctcaagaacaatggtgtaaatcttaattggtgttgctaatatttcattttgctcgtcaacgtcgtaacctccacgtgtgggaggcctcttcagggatcgagtaatggcgccacctcatgcaactcacctgatttcacactccaccggaagtgagctccaaatattttccatcggtgacgaagaccaaagaagaaggatttgattgttttttcaattctttttaagttttttttttgcaaattgttgggcaaaagtgtaatttgcccattcacaaggggcttcttttcaaaactggaagtgtcccagtagcactgtaacaactcatgtattttatgtttctaatctactttatataaataaatgcatgagttttaaaaaggaaaaaaatgactcgctcgccaggccttgttgcgatcatgctccatcttttcttttgctttcatgttcgtgatggccgttactcctattttctcagtggaattgtatttaggactggtgcagtagcatacacttatgttgagtctggacccacgtatcagccactgatcaatagcctacatcctattttatatggacattattgggagggtgggagtgggtggctgtgggtatggagggaagaatctctctcgcacagcgccacccaagttgaaagcttgggacaggtgcagccgcatgggtcgcgctctccgccactacgaaggagaggagtgatcaacctcagctacaccgttcaggtgctgcaaaaagcggcgtaacgtccctgcttcttgtactggctacgctgcaataattctgtactataaccacttgtcttagatctgataagatcgcgaggcctttatcactttgatctctggtcgtcatctgtcagcgacttttttctctctctctctcttttcatcttcttttctctcggaaagaccaggcttgatcaattcatgtgcatgtcttctttgcaggatagcggtccaggacattctgatattttagtgaacagaagaaagggccagttgcaaattttcccacacttaatgtattttgattttgcggggaaaaggtattttaagaaggcttttcatcactagttcactacaggaaaccagcagaaacatatcagacagtgaacggcacgaactagtagtagactataatatcttgtgcataagctcggcacatgattagtctttattttagtaacatgattgaggagccctctagctgtctggcatgcaaaagaactccagaaatgatggagatctgaaggaatctttcgtgctgtttttaaaatccatcaacttctgtacaaagcagaaataataaacctttttttccccctcacactttctgattgtcgacaaatttttgtcaggcagatggctgcctggccacttgtctgctctttcctgtggatcacagagtaaccgatccatgtgaaactcttcagtcctaaaatgtcgtttggtctcttgctgatggaaagtttataagctgcatctggtcgaatagctcgatgttagctgcattgatgtctcttttgttattctctttgggaagcatatgagcaacttcatacagatacgttggtattatctgttcagatcttcctcaaaatgtactactactactactatttagacgtctgcacatatgctgaagacaatagttaattctaagcattgctggtatcggcagttttcagcaaggaacacgaattagtcgctatctcaatacacaatttcccttcctcaatcccaaccccaagctgaaagcctgaaactcctggatagaactaagcaaacactgaaaagcaaacctttaaatggtccatcgcatatttcagatgtgagactagtgagcactagacttttgcgatgttttggcttcagtttggtctagcttctagcaattgcaatttcttccagaatcagaatctctcacaaacagtttagcttttaatctagattatgaaaaactgtagttatagaattcagaaaatgaattacttaaaagttagaaggtgagaaacctaaccttttcaaattctcagaaactaactaccgactagttatttctcataattttaaccttcacaaacagacccctagtacccataggccatatcgcgtgcatcaggagaagcaatgccaatgcagtgattgttaggttcgcgtcgtcgtcgtgcgtgcatgcgtgctcgcgtaaccgcgggacagatacatcgcccaaatcaagccttgtgtcttttcgccatgaccggcaaaccgacgacaaaacatgtgacgatctgtaaatatgtgtgcattgtctaacaactagtcgatcgatggtggatggttggatgccgcaacaataaccaccctaaaaagtctaggcgtcaacaaataagcgtgcctcctttctgcccggcctctcttttatttcctcatctgagaagtactgcgatgaagaacacgacgcgttactttctttttgtggctacaaaatccttagatgattggttttaaaaaatgttgtacgattgcacttttcgaaggagctagaagtacccgttgaaaatctagctggtgagactaggaaaatatgattttgatttcgagtttatttttcacattgtataactataaccttttaaaatctgaaaaaaaatctatttggaagagcttttagttataggagaacccaaacatgcctatatctgtttttcttccaaaaatctactagactttgtgaagtctgcccatccttggaaagatatctagaggtatcatattttctagtataaaattttggtacctctaggtactacgtatcttaaggtatcaaaaatttttagtataaaatttagttacctaaaaatacattttcaggactgtaaaattccactttacggaaagacattttggcccatctattattaaattactaggaaaaggagcctccacgtgcgctctcacgggctagaaattctcatattaatcggataaaaaaacagagtccatatataaatacaattttaaaatagctgaaattcgaaattaaaaaataaggaatattaaaacatgatactagagtccattccggtatacaatttagaaccaatgaaaattccgtattattttttaaaaaaagataaaagtagatgttagagttcatatagaaatacaatttagaaataactaaaattcggaattaagaaagggaatattgaaagaagagtatagagttaatatagaaatacaatttagaaatcactgaaattcggaatgaaaaaataaagaatattagaagaagagtatagagtccatctaggattacaattaagaaataaccgaaattcggaataaaagaaagaaatactagaagaagagtatagagtccatacagtaatttataattaactaaaatttagaataaaaataataaaattaaaagtagagtttagagtccatatagaaatacaattaaaaataataaaaattcaaaataaaaaaataaatattagaagaaaagcctagaggggtctagagtccacataggagtattatttagaaataactgaaattctgatttctaaaataagaaatatatgaataaattttatatgtaacaaaaaatcagaattaaaaaaatgagtattggaagatgagactaaagtcaatacaatttagaaagaactaaattcaatattaaaaataattaataactatcacgtacatacaatacaatatgaatattacatattgatagtttggtaaaattagtacaaaaatttaaattatgttatcattttaatatattgtaataataaaagaagaaaaaaatactattatagaagagaaaatatagggatgctagctaagttcaatatgaagcgtgcagagtggactagtggaaactgataaggcaaattgcgggcaataatttcaccatagtcatggcctccctttcgtcctccgtcagccaagacttcactaagttcagtagaactgtagatgagcaggaatcttgtagcctagctccttgtcaagttatccggagcggtaaattattggttaactagcactttagaagtggacaagttcggtccatctgtctcttttcgaataacttatcgcatgcaacaacaaaatgaccttcaactaaaaaaacaaacaaatgaaccgtcgccggatgtctcatcgattgacgtctcaagagtgttcttgtagaagatgctttgctctatggaaagtccgcttctgaagagaactcagctactacaagggaactcgccgtcgccggccgagtttgatttctgttggggatttggccctggtgctgggacttgggaggctggggccgtcgaattgggtcgcgtagcgtgaaggtgtgcgggccttgagccctgttgcttctccatcactgcccattgtacttgttactgggccattgtttgagtggatcagttttttggtccaaactcgagccccacagaaaaaaaaatcttcaacatttactctgactaaggacattcgtaaaatatctgcaacactcagtgtcgaagtcgactacctgtcaaactcaaatcagaaaaaaaaagatcacctatgattaaaacaaaaatcacttgagagcacgaacaaattgtgagagcacagccgcctcaaaacatgcatcattccattccaatgaaacacttcaagttgatgaagcagtacaccttccaatcccttaaccaattaaaccatgcaatgatcgatgcaacaatgcagataagtttcaaaaagcacgacgggttcgtccactcatgaagatatcaacttccactccactccactccactctacgctcactcactctcaccttcacgctcagcggcctccagaatggacgccgaaaaagtcgtagaacggaggcgcctcgctgctggggctgtccgagctctccgactcccacgagaacgacgcggacgcggacggcgtcgtcggggacacggcggcgcaggcgctcccggcgcggagcggcttgtgatccggcagcacgaaggtgggctgcagggggaacagctggagggtctcgcgcccaccggcgccgccgccgcggcggccatggccttccgcttccgccgcgccgcggccagccgccgccgcgaggtgtgcgctgctcggcggtgcctgcaggtacatggtggtggtggccggtggctgcgccgtggacttgtcgtgcggacacacttccatccctgggtacagcaacggcgtctgctgctgcgggtagtagctggcgttatttgtcgcgaccggcatgaagcttggcgtcctgaacatcactgcaaggatcgaaagtgtgcatggatcagtgcagaacatggagtgaagaattggcatttaagaattgaaatgcaaacacaagctgtagtaaaaatagaatctaataaacgcgcgcattatgatcaaatggatggtcatgctaagaacaacagatcaaacatgccaatgtcaacaacgatactcgaagctggattggatgacacgtgcaccgaccactcatgggacacattttcatgtcccaacattatgagatggaagggcagcatttcttggatgggaaaggaagcagctaaaggatgatgtggaaggttgtgtctggccgttttggccctagctaggaggatggtcatttccttctaccctcggtcatgcacagcatgacagcagcacagtgcacagaagattaatggagctacaaaagggtagcagcagaagctacataggcaggcaggcaacgttaaatcgtgtgaccatgaataggcagtctctctgttccactggcactgtatataggggggcagaggagaaaagacaggtgatacgaaacaatggaagaaatggaagaaaaaacggacggatttacagtaggagacatgaacaaggcatgcacatcgtgacagaatagtgatagctagctaagcaagcgtaatgcgattgcatgcaacgcaacgcgtgcatgcagaggataagtacaaatagacaactagcggcagtactactaccgtgttatacatcatgccgttgtgcaacaaagcggtcaaggtcaactgtgaagaatggatgttctacgccaagtatacttgtcatgccagccatgcatgtacaaaacgatttcgtatagatttattggcccatgcatgaaaaatgcaagaactgaaacgacagcacgagaactttgacctccatacgcatgaataccacgaaaaatgaatggatgccaggtgcatgacacccatgtgtaaagctaattaagcaagacatgccaaagagaagatttaatacgtgacatttaaagcacgagaaaaggtttggcttaccaccaccggcgttgcatgcggccgtcgtcgtcgtcgccggcggcggcggcggcggtggcatcgccgtcggcgccatggcgagagggaagggccgcgcgagtggcctgtggagcacgggcagcggcggcgggcggcggaacagcttgctgaagtagtcgaagccttgctgcttctgcttctgccgctgccgggccttgtggttctggaaccagtagaacacgttcttgccctcaatgtggccgtgctcccggagcctcgccgtgatctgctgtatctgctcggcggtcggcgtgcgcagcccctgccggtacagcccct

SEQ ID NO: 14820 - DNA, 9130 bp, Oryza sativa
gcccgccgccgccgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcgtgtgcgcgcgcgcgggcggcagggggaggcgtagctagcgtggggatcgtgtcgcgttgcggtcaaggggagcgtacgtttcgacgttttcgtgaggacgggaggagtcgcgtgccgcccctgtgccgtgcgccgcgtagatcaccacggcgagtggcgtgatccatccatgcgtgcatgcatcgtcgtcggtactccaatcgatggatcaagggcgtacgtgcccattgtgaagtgaaatgaaaagcaatttttcactcgtgaaaagggccttttccttcgtgtacgcgttttttttgcccagctggccgcatcgatcggaaaaaggagagagtaaagtgtgcgtgcgtgctgttcgacgtgggctctgaaaacaatgggggaagaggaaggaaaggaggctgcggagcggagcgcatgcaatgcacgcagctagcgcgcggccgcacagtgaatgcgtgccaacttgcctttccagaagagaagtagagtagcctagtcgatctagtgtaggaggcgcaagccgtacgaagcatctcctctcctcgtagtcgtcctcgggaatgatgggaattatttgctcgtggcaacagatttttcgttttacgggcgagatctcgtgtgtttagcccctttcggtagaggactagctagcatccatcgcgtcgctctattcatcgcgtacgtacatgtagcctctgcacgtactatgcgctgtactctgcgtccccgtataggctacttttgcaatgtccaagttagatcgatcagattcaatgcatgcacgagtttgggagtgaattgaagcttgcttgactgcttgaggccaaagtagatcgagttgttacatcgcattgcatgctttgactactacgcgatcagatcagagtgccttcaggataaacggatcaagcattttttttgttgggaaatgctcgtatcgtggttttgcgcccaaacttcagtctattgtcacagaaaatgttcgccgcggttctaaagacatcaatgcaggagattcatatcgatctcgcgcattccgttctgtgaaagcttaattcagtatacatcggtgtaaagcaattggttgcaggcttgcagcatgctgcatgcagctgaaatttttcgagttactggttgccgcatgcgtgcccgaacaaggatctctgaaatgataaatcaggtttattttgcaataacaaaagatcaaaccagcaagatacttcctccatctaaatataagtgcaactttagtacagatatgatataaggtgtatttaattctttgggtgtaaagtttttgaagtatacggacgcacatttgaaatattaaacgtagactaataacaaaacaaattacagagtccgcctataaactgcgagacgaatttattaagcctaattaatccgtcattagcaaatgtttactgtagcatcacattgtcaaatcatgacataattaggctcaaaagattcgtctcgcaatttacatataaactgtgcaattgttttttccccacatttaatgttccatacatgtatcaaacatttgatgtgacctttttgaccaaatttttttgagatctaaacaaggccatactccaatctaggaatacaaatctgaaaagtaaggcccgtttagttcgcgaaatgaaaatttttgggtgtcacatcgaacgtttgaccagatgtcggaaggggttttcggacacgaatgaaaaaactaatttcataactcgcatagaaaccgcgagacgaatcttttgagcataattaatccgtcattagcacatgtgggttactgtagcacttatggttaatcatagactaattaggctcaaaagattcgtctcgcaatttctcccctaactatgcaattagtttttatttttatctatatttaatgtttcatgcatgtattcaaagattcgatgttatgtttttgaaaaaaactttctggaaactaaacagggtctaagaagtatgctgtgtgcatgcaaacggaaagttttaaagacaactttactgcttgtctacatgttgtgtgcatggtaatcagctatcacgagctcacaaacaatgaagaggagagagaggccgggacctgaatgatcaatattgggacagagggacgccggccatggcttttactccctcaactggagacggcagctaggctgccataggtagggattgaaatggcgaggcacattgggaaatggagatagaggctgaggctgataccaaagcaggctagtgtagggcgatagatgagacgacgaacactgtatgcatgcatgcatgcgttgtgtttgggacatgcatgcaacgcacggcaatgggagagggcagaccggacggttcaggagtcggattttgagattatcgcttcccgtttccccgtaacgtgatgtgagagaagccgagacgctgcacgcctgcgtcgcattactcctcacgagctaagctagagactagagaggcagggacgaagggagaggcagacgagagggggaggaggagagaacggatcggagacgctgcaaattggcgcttgctggtgctgcgcgcattgggaaatgccatgcgtagctagaggctaaccacgcgcgactcgcctcacccaatcgggctccggtgagcagtggcagcgtgagcgtcgtcgtcgtcgggtgtccctgactagataggacatggattgactttgatcggcgacaaatcttcaagagagatccgaatacccggaaaaccgttcgccctgatccgacttaaaaacttcgacggccggccggttgggcaaatcaaaacaccggagcaggttaaccgcgagcgagccaacgctagcgcgaaaccacaaagatccaaagcccgtgctggttagttgccgtggtgcagtgcaggcgcaggtagacgccggtggaaggcgacgcgagacatccgcgtcaaagaaatcctagaattccgggcacgtagcgcaacggtgcgtgtgccatgatcaggagattgtcaaaaaaaaaaaaaaagacaacacttgagagctgttgagcagctgctggaacagacattctgaacggataaaaataataacgggcacgagaagcatgagtacaacgaagttttctgggcccaacatatattttttccttggttgattagcaccgtgaaatagtgcatagaggatcgatcagaaaaaaacaggccagtgcaaatgtgtgcatgttgttggtatgcatgctcaacagggatgcaagtgggtaatccactacccgtataaaaactcgcttgttagtatatttttcgtatgatagtttaaaatttagaagaaaaaattaactaaaagtgagataagcgggaaaaaaagcgcgcttgcccgccccacttgcatccctaatgctcaaggattctagaggtgaaaattagggatgacaattgtgcccgtttgcccgtttatccatgggtaaaaaccctattagggttgggtttgttctccattttatacccatgggtatcttattgggtcaaaagctatgcccgatgggtaaattggcatgggaatgggtaatcactacccatgcccgctttgcccatttacccgcaaaatctaacttacatgtaggctaggagcaaaatccactagaatacataagccacgtttttattttctacggtttcccttttatttcccttattatttctctccctttactctatcgccgctagaagagagacgacaccgaggcggagaatatttgatgttttaagttcaattcgaacttagaagcttgtagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcacttggggtagttcttccttcactccgaaggtggtgaactccaaaccactcacaaacggtgccgggcctcctccacaatctcctcggagaggtcaccgggcaacacctccacaagctgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttatgaggccggtcagaccggactactttgtaacggctagaaaactagccgttacagggcaatcattgagcccactcaacctggccggtctgaccgcagtgtaggggccggtcagaccgccgtcggctcggtctgaccagttgcggctctggcggctctgtatcgccaccaaaaaccagaccagtgcaatagactagtggggccggtcagactggccttaccacgccggtcagaccggctaacagacccggtcagaccggcctaaggcccacggtcagaccgtaggtcacttttcagctcaaccgactgttagtaaaacggtgatatctcttgactcgggtatcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcataagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcctttgtcaagactttattctcattacaagcttgacttcattcttgccaacatgacgatgtccttggcttggtgaccactaacccatggtgtcattcattagcctcatcataatgggacctattccttttcacacctcaaaggagaacattagtctcaacaaatcggttgtcatccttcacttgatgaccaaccggttgcatatgaaagatatagatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagactaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagaaagaaatcttataataaacaaaatatagaataagctccccctcaagatgtgcatacatatggatatgaaggaacgcatatgcacataatcaataaagatcaaataggaagctcacactatattttggatccacaagagagaccaagttagaatgtgtgaagtttaatacatacctctcatcatttttactttcatatccaaatgagactagtcaaagaaaggctcataaaaatgttagtctcatataattaaatttgtcattaatcaccgaaacagaattaaggcacttgaacttatagtaatgggtatacccacgggcacaaataatctcacgggcatgggtatgggtaggaactacccgtgcccgtcgcgcccgattgccatccctagtgaaaattctttattttgaaacacttgaaccggtgtaccgtccatcctctcccaccttcgtgtgacctctcgccatgtccacaatggcttcaccgacgaccctatttggcgattaaccctcaaggcctcgaatacgaaggagccatcgtggaggtgctgtatgggacaaatagggtctgtttgggagagcttattctgaaaagtagcaagtgagaatctagagaaattgagaaactcatttctggattctacaactgtagattctcataatctaaatgaaaaactgaactgtatggaggagctcgcagctagagattatagaagaaactgcagttgtcagaaactcccctaacagacccataagctatattgggaacaatgtgggcaaggaggatgtgggggttgagcttaacacgggcatgtagtgacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaaaacccgcgatttttctttgcttctacttcttgtggtacaggatcaataactggatgctagcacacccgaggcgagctttggacctgcactggagttaagcagatctccaggcctcgtgtttt

SEQ ID NO: 14821 - DNA, 2927 bp, Oryza sativa
aaagatgctgaagttgggattgactgacgtcaatgaagaaaacgtcgtgccgatcgatccagaaaaattcacacttgagcagaagaaagagtttgaagcaatgttgcggcaagcacgggatcagttcttgaactcattcatgcagacccgcaaggggacacttgttcagaagtacaaaataaaagttgttgctgatgatcctggaaccagttcttctaaggatggagatgggaaacaagctctagacggctccgctcagccgagtatcaaaggtgctgccgatggctctctaggaaatcaaggcaacaattctcaaggggtccatggaggacaaggtgacggggtgcatggagttcaaggtgacggtgctcaggggctgcagggaggaaatcttaatagtgacgtggcacaggactttttcaataacttccaagatcaggttgattacgctgtacatcatgctttgatcaatcagtctggggtgatagtcaataccctgtcaaacatgatgaagtcaatagccgatggttcaatagctgaacatcaggctgcaggcccgatctatttgcaaggaggtgtttttccaaattatcggtctttgattaccgacgttcagtcatctactcaggcagttccctccgttacacccacaactcagccgacggcaccggcaacaactcccctacctgctacatcagctatggcgccaggccagccaatgaatcctcagctgttaatgagagagcatccatagcatagtgggcaggttgcgaatcggccaacccaagatcaggttgctgctatgtttttgccgcctcaacatgcggttgatctaatacagtagcagccgattcagcaacagccgattcagcagacaccccaaattcagcaggttgtgcaaccaatccagcaacaggtcatgcaaccagcacaaccaatccagcaacaggtcatacaaccagttcagcaaacaccaccaaggcagcagtctctgcagccgatttagcaaacgccgttgagacagcagatcgtctagccgatccagcaccaaggtttagtgagcgcatcggccgggtttgcaacgcctggtggtcagcctgtacaacaacttttaaaccaagttgtcccagaacatttggttcaccacgtacagccggatggcatagtaatgcctcaggttgttcttgagcacttgctgtgcaatatccagccggaccctcacaattaccaagggggtaacctaaattatcaatatcaacctccttccccacaagcccaatatcggccagggggattggctcaacctcagtttgcatcgcaatatggtcagttcgagcccatgcagcaacagtcacaaggcgcaactcagcaacgaccgtgggccgatgtaattgctgacgtaatgagggaacagtttgggcttaaaccaaaagagatcggaagcttgtatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagatgaagttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattcaaaaaagccgatgaaggtcgatggtaatccttttcctgttaatatggggcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgat

SEQ ID NO: 14822 - DNA, 37987 bp, Oryza sativa
gggttaggccacaccagcaacctccgaggagatgtaaagccgatatgcttgaacctgtcaaagctgagattaaacgattgtatgatgctgattttattcgtccttgccgatacgctgaatgggtttctagcatagttccagttatcaagaagaatggcaaggtcagggtgtgcattgatttccgagatctgaataaagctacaccgaaggatgaatatccaatgccagtagccgatcagctggttgatgctgcatcagggaacaaaattttgagttttatggatgggaacgcgggatacaatcaaatctttatggctgaagaagacattcataagacagcttttgagtgtcctggtgcaatcggcttatttgaatgggttgtcatgactttcggcttgaagagtgctggagctacatatcaaagagccatgaattacatatatcatgatctaatcggctagttggttgaagtctacatcgatgatgtggttgttaagtctaaagaaataggggaccatatagccgatttgaggaaggttttcgagagaactagaaaatatgacctaaagatgaatccgacaaaatgtgcttttggtgtatcggctggccagtttttgggatttcttgtgcatgaaagggggattgaggtaactcaaaggagtgttaatgcgattaagaagattcagcctccggagaataagacagaattacaggagatgatcggcaagataaattttgttaggaggtttatttctaatttgtctggaagattagaaccttttataccattgttgagattgaaagctgatcagtaatttacttgggaggcagagcagcaaaaggctttggatgatattaaggagtatcttagctctcctcctgttttgattcctccacagaaaggaataccgtttaggttatatttatcggccggtgagaagtcaatcggctcagttttgattcaggagttggaaggaaaggaacgagtcgtattttatcttagtcgtcggctcttggatgctgaaactcggtactcccctatggagaagttatgcttgtgtctgtatttttcgtgtacaaggttgaggcattatctactatctaacgagtgtactgttatatgtaaagccgacgtagtcaaatacatgctatcggctccaatattgaaaggaatggttgaaaagtggatattttccttaacccaaagtgatcttccggatgagtcaccggaacgcagattgacgagaccaatctatgatcgcgattgtattagtggaacatacgtgatagattcaatagggctcgagtgcaaatagtacgcgtggactctattctttgatggatcagagtgtactcatggctgaagtatcggcttaatcataatctaccctaagagggcatgctcccagttcgcttatccattaaaccatatgcgactaataatcaagctgactatgaggcatcgctcaaatggttgcaactactcaaagaatgtgaagcctataccattgacatcatgaaggtatctctgttaggaatcagtcaatgggcaggagaatatgaatgcaagaatgatacattgatggtttataatgagaagtgccaagaactaatgaaagagtttcggctggttactttaaagcatgtttctcgagagcaaaatattgaagctaatgatttagctcaaggggcatcgggatataagccgatgatcaaagatgttaaagttgaaattgcagcaatgatagctgatgattggaggtatgatgtacatcgatatttgagtaatccgtctcaatcagcttctaggaaattaagatataaggcattaaagtatactctgttggatgatgaactttattaccgaacgattgatggagtattacttaagtgcttgagtgctgattaggctaaggttgcaatcggcgaagttcatgaaggaatttgtggtactcatcaatcggctcataagatgaagtggttgcttcggcgcgcagggtacttttggccgacaatgctggaagattgtttcagatattataaggggtgtcaagattgtcagaagtttggagcaattcagcaagcaccggcgtcggctatgaatcctattattaagccatggccgtttagaggatggggcattgatatgatcggtatgataaacccaccatcgagtaaaggacataagtttatattggtggtaactgattatttcaccaagtgggtggaggcgattcctttgaagaaagttgattctggggatgccattcaattcgttcaggaatatataatctaccgatttggtattcctcaaactattactactgatcagggttcaatcttcgtgtctgatgagtttgttcagtttgccgatagcatgggtatcaagttgttgaattcttcaccttattatgcacaagctaacgggcaagccgaggcatctaataaaagtttgatcaaattgattaagcggaaaatttctgattatccgcggcaatggcacactcggttggccgaagcgttgtggtcttatagtatggcttgtcatggatcgatccaagtccctccttacaaaattgtttatggacatgaggctgttttgccatgggaggttagaatcagctctcgaagaacagaattacaaaacgatttaacggccgatgagtattacaaccttatggccgatgagagggaggatctggttcagtcacgattgcgtgcccttgcaaaggttaccaaggataaggaacgtgttgctcggcactgtaataagaaagtggtacctaaagatttttcggaaggagaacttgtatggaagttgattttgccgattggtactcgtgatggtaaatttgacaagtggtcgccgaattgggaaggaccgtttcaaattataaggttgtatctaaaggagcgtatatgttgcaagggcttgatggtgaagtctatgagcgagcgctcaatggcaagtatttgaagaaatattacccaagtgtttgggttaacgcataatcggctagtattgccgatgcatgacagccgatgtgtttccatcgccttgagatggccgatatggttatatcacccttagttgtttttttttcctggtgtaatcggttgtggtttgccgatgtacaatggccgatatggttatatcgcccttagttgttttttcatggtataatcgattgtggtttctataattttatcaatgcttttgacattgtaaaattagggggcacatatgtatcaaaatgaaatttttttgagcaaatttcgaagtcatattaatcggcacaaaggattgtcaagacagtaaagtactagagcatcttagccgattacaaagatttctaagtcctattacataaaagttattgagacaagtattgctggatagccgaaatagctttttgcctaatttgttcaacttcctcaatagcttgggcaccttgagcatcagttccaggaatgatcttcaaagacttagtcagatcagcaacattcttgatagccgatttaagtcttgctttttgttcttcgacagaccgcgggagatcggctagtttcttgtgctccagatctaattcggcattgcattcctgaagttgtgccaggagctcaatcttgcgagcctcgagccgatcaatgttggatttgatcggaccttctgaaagctgatcaagtttggattttttcctcatgcacaagttgccgattagcttggattgtagcttcaatgtctttacgttctcgccgttcggtcagtcttaacttggctttctccaatttgaattgatgttgctcaagataaacggctggagtaaggatatcgactaactcatctgggatcagagcttgaatttcatgtagctgagtcctaattgaggcgcaatcaactaccaagctatctagtgatgatgcctctagccgatgagaaatattttccagagttttcttcacgtcatcggataaaggggctaaggctttgcttatggtgtcttcttctccttcatcaagataatctttgatgtcaaaagaaaaaagatcggctaagacctgcagcgacgatttaaagagagttaggggtcaaataggcatagccgatctgaatgttttttgtcaaaagaaaacctactgggatagtaggaacagttggttgaatttcttcttctatatggtgacttcctacagctgatggagtctggtcacttgttgattgctgtacagaaggagaaggaggaggaggaggcttaaaaagaaacaagtgttaggcaaaatcggctgagagttaattaatggaaaattgaggttatcttactggtggagctggtttagatgttgtcgcagccaatttctttttcacagcagtcttctttttctgcaattattaaatctttaagtaatcggtcataagatacaatgattataaaagggattaaagggagctatttactcttgaaaagtggactggagcagaaggagttggaggggtttgtttgggtgaagccgatggtgttcgttctgtatcgcttacttcggctgcggcctcgtcaatgtcatcttcaataatttcttcatccagagcttgttcaatggatggatctagagcagatagatcatcagctggtgtggtcttctttgtcttagtcttcttctttggagctggggctgaaatatttatagccgatgatctggtctttcttttcttgcgggcatcagctggttctctgataagcccttggagaagagctgaagacttgggggcattatagccgatgacggggggagatggcccacctccgttggggatcagtcctggggcatactcgatatccctgccgctgttgctttggtgatggggagaagattctgttgtctgtaaatcaggaggaaagttagctaagggctaatcaaccaagtagttattcaaataaaatcaagtgagttaggacttacttgagggacaatatctggaaagagatctatcatatacttggaagccgattgatggaataagtgtagcttccattcaccccaccatctgtcaaataatttgctcctaaaggttgccagctttatggtgtcaatgctgcctagaggaggtccttggagattgagcagccgatccatcattaaagatgatgagatttctcctcggcattggatcttatcggcaaagaataagccaattgggagttggcccattccaaattgtctggcagaactcattggatgataaaactcgtaggaaacttggatggttctcccttgatgaatgccgactggaaggatgcatggggtgattgcagataagaagatttctctgggcttctgatatctgtcattgttgatgtcttcgaatttgaagtcccatggattttctagaagtgttgagtctccatagagaaaccaaactcgagcatccttttggaacccctcataaaagctacaaaaccaatctttgagcagctcggccgatagctttgctcctgcatcagttggggtagaggcgtactctccatatgatgtgcatctccgatgagtgagttcctctccgtcatcgttaacagtcggctctaatcttgggaattcagtttctgttacagatggccgatcgacgaacctcatgactaccaagtttagccaggattgcagcagccaccatggtccacccgctccgactactgagccgacaattagcttagccgatgcattatttagcatttggtacaagtagccgaggaggattttgcctaaaggaaattgtctttttgtctccaaggcttcggctacgaactgccaattggttgtaggaccgcagctagacccacaaaagagaaacttttctaaccacattaataggaaagccacatgttctcgaggggtaactggaccctggcctatatatgctgctacatagcctgaccagccgcctatgctcttggtcttgaagtcatattggttctttgtattcaaactcatagggttggccgatgaggtgacatccagacccgtgatcatgctgatatctatgagagttgggatcatcggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagatctcccaggcctcgtgttttctgtcaacagacaccctccgaatgcctgcatgtcgtcgtgcgcgccgcattctgtgctgtccacccacgcccaccgcccgtcctcgccatgcacgcagcatgtgcgagagagaggaagaggggaagtggagtatgatgactggattgccacgcgtgcgccacgttggacaaaaccaatcttaatttggtctagggggttaatttgtccggtatggaaagttcaggatagggtttagggggctatcaaattttagttatttctaaattatatttctatacaaactctatactccacttccaatgttctttattttttaattatgaattttcattatttataagttttactcctatatttcttattttaaattcaaaacttcagttatttctaaattatactcctatatgaactctagacacttcttttaatattgcttattttttttaatttgtgaattttcattatttctaattgtatttctatatgcactctaaactcatcattcgatattatttatttttaatttatgaattacagttacttctaaattgtatttttatggactctagactattgttccaataattttcataatttctaattttagttatttgtaaattgtatttctatatttactctaaactcaacttttaattttattgtttttattttgaattttaattaattctagattcctatatggactatatactcttattctaatattcattattttaattcctaatttctattaagtctaaataggctataaacttacctttcaatatttctttttttatactccttccatccacaaaagttacacctattacttttgtcgccaagaccaaggaaaaattgaatcatcttgaatgttacaaaatcaatgagtgaatgcaagcatgcaactaatgagtatttagatgactccttggattgtactccctctggttctatattaattgacgttttggacaaggttgaggttaaacttttataactttgaccatctataactttaaaaatattaagtttaaagaaactagaaaaacatatatagatttgtctttcaaaacactataataaaagtaaacatgcatttatttattttatatattataatagagaaataaggtcaaagatatatcttgtagagcgtatcattatccaaagcgtcaatcaaaataaaaccagagggagtaatcaaacatttaatttatctcctcaatcatcttgaatgttacaaaattaaggagtgaatgcaagcatgcaaccaatgagtatgtagatgactccttggattgtaatcaaacatttaatttatctcctcatttaagtctttttttttataattacacagtacaacgcatacactcacaacgcacgcgcacacagccttatgaaggcacgcacgcaaaccctacccctatgagcatcttcgaagactaagccggcaaatccttgagattgatgaagtcaaacgcacgctcattcacacctatgaacgcacgcacgcaaaccctacccctatgagcatcctcgaagactaggccggcaaatccttaagattgacgaaatcatcacaggcgcctcgctaccacttaaagcacaacactgttaaatcgtagaaaattcgcttccatggagagtcgaacccaggacctcagatgctactgagactcttgtaactactataggctacaggcattttcgctcctcattaagtattgaatgcaaaaagactacaaaacttatttggaaaaactcaaatgtaaaatatgtctaacttttatggatggggggagtaattccgaatttcaattatttttaaattgtatttctatatggactctatattcttcttccaatatttattattttttaatttcaaattttcattatttctaaattgtatttttatatggactctaacctctacttttaatttttcttatttttttaattccaaatttccattagttatattgtatacccgtataaacttcagtcttccttttctatattcattatttttaatttcaaatttcatatatttttgaattgcatttatatatagacttttttttattaatatgagaattttcagaccatagagcgaacgtggaggcttttttctattccttaaataagttaataaattctatagttttatagtcctccaattaccaaagtgggtggtaggatttgtgggaccaatgaatatacaaagcttattgtgcatcaaccactcgatgagatgagagagagaataatatgtttgtaaacatcagcgcccgatattttggcaagagcattattttggatattcctaaaatatctgtaggatttatggaagccagttcatgtgttctgaatggccatatagaaatttgttcttagtattttctacaaaaagtatcgtcgtccgattatattcccttcaagacccttaaagaaaaaaaaaagcatgagaccacacctcgcgaacgtctgttttaaaatcttccagggttccaacgtaaaccaatgcacatgacacattgacaccatattcttgcattttcccaatcccattttggataatccaaatctaatgcacatgacaccatatttcttacattttcctaatctcattttggataatcctgtgtttcagaggattagcatccacaaatttttggttaatcgttgggccatttcgccattggaaaccaaatagctcccaatcttacagcccaatagaccgttacgatcacgtcaggacacaataggcaagaacagtttcaaggacaaaactccacagaatcaagggcaatagaaccctgagaaattgtgacaaaaccgatgtatcgaaacatgtgccaaaatttcaatgctcctcaatagcattgcaatgttctcaacggcaatacagcacctcgatctagagcttactataggtccatataaatgaattacaataaggattgcaaaaagatcttcaacttgaaacttctatttcttcttgtcagtagtaccagcagacctgcacaacaagagaagggatttagtttgcaaattctctttgtcaaaggtaagaattggccagaaaatgaaaaatgaaacaaaacttacatacaactgaggtaccaaaacaacggagaaaatcatttgtactgctttgaattataaagctataataaataacagaacagaagtatagggacacaagttgggcggacaagcgggattattttatttttcccggttatcccacttatagttcactttttcttccaaaatttgtgctaccatgtgggaaatgaactagcaagaaggtatttatgcaaatagtggtattgtccacttgcacccctacatagctacagaaaaaggaccaagttaatttagagacaagtccaatatttgcagaatgcctcttatatacttgggagtacttacacaaataaatctcacaacaatgttaccgataaagtgctactccctccggttccataattcttgacgttttggacagagtgtagtcaaacttttataactttaactatcaactttaaaagtatttagtttaaaagaattagaatagcatatatggattcatctttcaaagttctataataaaagtaaacatgcatttatttattttgtatattataatagaaaaacaaggtcaaagatatattttgaataccgtgtcattgttcaaaaagtcaaaaattatgaaaccagagggagtagaacccattctacaatacgcacggaaaaaaaatagcaactaaaaaacagagaacatcaacaatgaaattgcagaatgcagtagtaaagacacacacctcatcttcctgatgacacccgccatctcctctctcttcttctttgctctcttgtgggtaccgagctttctcttagcgaccttcagtgcacgcttgtcctttccaaccttcagaagctcagtgattcgtttctcatatggagcaaatcccacaacctccctaatcaagcccctgacaaaattcactctcttggtacttttctgcaataagacaagaaaacatattaatgaaagaatataaataggaagcagctatggtgtatggccgtattcatcaggaagacagcaaaagaaatctctggtcatagactcgagaagcagctatggtggagattgtagttctcctcagtaaagtgaatttttttttcacgtcataggctcaagagatcacaagatcaactaatggtaattcagaattttctatttgacatgaggtgacaaagcatcacttcatcgttcatttgtcatttcaaaatattgaagctgtggaagttaaaaaatagattttaacagaacatcatttttatttgcttttatagctttgctcagaaaggtaaaccaaagatccacacaactgcacaagcaaaaaacattcaatttttgtttacattgcacagaaaccgaatctacattactggataataaaaaacaaaaaacattaaaatatttagaacaagacaaaacagaggtaaatttagtgagatattttagaaacaaaatcatgaggtgattaagcttccacgttagactcaccaaataaatatatgcctccaggactagcaattttggagttgtgttttctccaaattgccaaaggtgagacgaggcacaaagacatcagtgtgcatacacatctaagccattcaaatgcaattttgatgtacagaaaacgataacccattgctgatacttgccattaacacgccaccatttcaggcaaataaattaataaattaaacacaccattcttagtccattataatcaaattgccaggaaggtgattaagcaagcacaagccaccacgcacttactcatgtccaatggtaatttagacaaccatataattttatgccgacataatatataatttaacaaaaaaacagcagtcgctgctccgatgtctagtacgacgaaacgaaattagctagcaaatacagtaactgtaccatatagatctaatcaaacagatgacatgcccatgttgctacgatacgagatgagcaaggatagagaagggaggaaacaaattacccccttgcggtcggacgggcgaggtggcagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaatcttcggaactaccaaatgttggtaggatggtgttgttaaggtagtgtttagtttttttcccaattaaaatttggtaacactaaaatttggttatgttgaaagtagcggtaaagtggcacatgccctgtatgtcaaagaagagcgtttttttctttttagagatgcaagcccttatacataggtacattcaccctttagcctttgtaaaggcgaatccgaacaccttatcctctatggatacgtttaaaaattggtgtatattttgaggcgaacgaaagtcaccataaacgtcgtcatctatctatctatctatctatctattatctatctatctattatatactaaaagtccataaaacttcctacagacgttctcaagccaccacgtggcgctctaataaaatagagaaaatcctagaaattctaagaaaaaagcaaaacatctatcccttgattttaaattaaattggcggggtccaatattacacaccgttagataaaattgatcttaaaacaaactaaatactatgggtcccacctatcctcctcccgcacattggcaggtggattatatacgtgcgtactgtacatacgattcctccccttttttttcctttttttcttcttttttcaatttatatatataatggatatattttttaaataataataattttacaaacaaagaatctaccatcatataatttaaaccggtgtactctttactttgtactattattttcaaataatgcactattttaaaataaattttacacaattatatcgtgtacctatcaaataaacaatatctatattaacaaatttatacgtgcacttaaactgatggccctattatataaattatcggatctactttttacattggtctattattctcaggtaatgcactgtttcaaaataaggtctactattattaactaattaactaatttaaattctatattaactaatttacacttacactagaactggtggacatattattataatcattggatctattgtttgctaataaataaagcgtccgaaattctctttttgcatgctgcacagcgcacgtctgcaccttggcctttcgcacgtgtgacaaagcgtagtgtctgagacatctaaggtgatcacaaccgctctagcactaccgctttgccacatatcaaatcataaatcatatatgaagatgattaattttgttaataacatgaaaagaaaattaaaggtgatgcaacgagagaataattaagcaccatgggttgtgtttttctcaacactaattagctctgtttaagttgaaaccgagagttgattacataataattataatgtatttgtgttatgtcgtatttggattttgtactatttatctgtacaggtgaaatgaatcattatgttataaatgcgagtacaatattgacgaatatcaatagaactcttagtacgacaagggtgataataggagcttaaggccctctctttttttcccgattccatattttggatttttttttgcacgctttccaagtttctaaatggtgtcttctttaaacaacattctaactttttagaagtcaattcattcgtttataccctcaaatagctatcacataaattatataattcatcaatttcagctatcctaaaccttaagtactacatatttttttcatgcgagtcatggtgatcagtaaattggtgatcaacgaatcatcgaagttgtaagatgaatatgtaagagttactctgaacaattgtaaataggtgttaaaattaattgctattaatcagacatttaatggcttgctagccacaaaattaatttctctctacatatatataaacatagacgaagttggaataaatattaccatacgtcccatacatatatattgcgcagttaatattctaattagtcatttaaaattccttaaaatgctctcaagctgccacgttgtgctctaataaattagggcaaatattagaaattctaagaaaaaaataaagtatccgttacttgattttcacttaaatcggtaggtccaatattataaaccgttagattaaattgatcttagaacaaactaaatactacgaggtcccacctcagcataggtatgcacctacgtgcatgggtacgtacgcctcccctcccttttttatttttctctttcttctttttttcccatgcatatgcttccctccttttattaccatatcatgcgtctttatgagacgatttaatcaaaagaattttgagtatcatgcactcatatttttcatttgtggccatactacacgtatgtatatatagatggactgtatgataattaactagcaatatttttttatttactcgagaaaaaaaacatgattcaaaagttataagtacttaatccatctcctattcaaaagtttatgaatggttttctaaaataccttaagaaaaatagaacccttaatttattataaaataacatcatccaaactttagtttgccctaaatttatgaggcaaaatttctgaacaaacaataatcttacctttcaaaaatatgcccgcgcatacgcgcgggccaccatcctagttcactaaaaaagtaattagctgtaaacataaacacccgtcccaaattagagactaaccagccgagtaaatcgctttccatcaaccggtttcggattgacagcgtcgtataggttacacaatgctgaaaggattcctttcaatggcgcacacgattcaatgccacttaaatcaccgcgtgtggtaagaagaggggaaaaaacgcaaattgatcggttaaccttcgcaagctgttttcgtctcctcgttgggatgacgcgttgctcttccatccatgtacgctcgaatcaacaaaaactgataaagaacttgtctatttttttatcggcaaatgttttactcggcaaagacaaacgtagcagagatcaatgtgaagaatcatgaaagattcgacaatgacccgggttctctggaaaatgagaagaatcgaaatgcaacgcgaaaccgatcaaactcgagcatctctagccatggttccccatgagaatatgagatcataagctacaacgagctgctgcttgctctcctctccatctcgaggaattgcccgagcgacggcgcggcgcggccgttctccaggtggctccggaggcagagcgacagcagcagcgccctgaccttgccgctcttgctcgtcgccctcgcgctccggcgccgccggctacggctctccatggcgtccaccaggccgatcaggctcgccagcgtcatcccgccgccggcgccgccgcctccacggcgggacaatgaccatgccgactgcgacaaaaaacatacttatatataaacgtacgttacgatcagatccagatgtaatctgcctgcactactgttccattgccgcattgcgaatttgcgatacagattatgttcgaactgacctctgtgtcgaaatcacaagaagtgaaggaagacgaagcgcagtgagacgaagtgaaggccgtgctgaaggaggccgagccagaaagatccacgcttctcgtcactccagctcttgcattcatggcgcccagtccaagaggccacccatcctgcaccatctccccaaacaaaccacaagcttgccatgatcaattggtgcgctaaaacagactgagaaaaagcatgtgagattagagctacaattaggcgaaattaagattggcgcacctcatgggccatgatctctcagagccgagcttgccgatcccacgggggacaagagcactaccagagtctagaaagcaggggtaactgactgatgaggagtggacaggcgtgaaggcttatatggtggagtcgaaagcgggcaacacgtgaaaaagccaagcatttgtcagtaaaattatctgacaaacctgcttgttttgcctcgagggttggaaagttgcaggcggataaacaaagtgcctaattgccaacactactacatggattagattcagccttggttagcatcaccatcacgagctcatgagatgtcgtcagtgctgctgctgctgcgtgagctcttgtgcgcgcattttacaagcccattgtggccaaagcacagatcgggaggaggctgcttacagtaagataatggaggaaaagccttgaaagacggtgcgaatcgttggcggtgtatgcggacaaatgtgcgcccgagaccgcggaaagctcgctagctccgccgctgcacgcctgcagcgcatcccgcgcatcctccgttctccctcggtccctcgagtttttcagttaccgggggacttcagtagagttaattgggatcactttccgggctgactgcattgttggttgggcttccggcgaaattctctactccgtcacgggcctaatgtctggcccagatcgttttcgacggggaaaaagtacaccgaagggccctcaacttgtcatcgggatacaaaatcgtcccccaactgtaaaaccagatatccgacatcccttaactatacaaaaccagtcacaatatgtctctcggcggtttttatcccggttttatcctacgtgactgctgtctcagcgtgggacccacgtgggccccacatgtcagcctcttaatatttctctctcttgccctttccactctcctttccacgggcgaccggcgtgcgcgcttgcgcgggacggagaggctgggcacggcgcggccggcggcggcggcaggggaggagctgggcgcgagggcggtcgctggggagccgcgctatcctcgcctcctgcgcgcacacgccgcacacacgcgctccgcggcgtgcgcctcgccgcgcccccgccgcctaccgcgcgtttggcgcgctcgcggctgccactggcgagcaaggcgaagtggccaggctcggctactgactacagatttccaaggagagagtacactctcatgctagctttgcttaaattaggccttgccatggtggtgatgtggttaattagctggctgagcaagctaacctcttcgagcatggggtaaatgtaaatcttgcccttgagccgctgcagctcgcccccgtccatggactggatctgcgtcggcgcggtccacgacgacgagcctccgccaccgacggcgtcttcttgcgcctgcttgggtgccttgcttgccgacgatgggctggtggtgctcttcatggggaggctgcagaactcctgcaagagctgctgcgtcgggaggaggaacctttagccgcggagatgccacgcgccttgctgcagctgccatgtcgacgccgcgcccgccgccggcgacggctggtggtggtggttgtgctgctacatcagcagcgacatcgccgcctccggcctgtgaagcgagagggacagcggcgcttggctctgcggtgttggtggtggtaagctcgccgagcccgccgaagtggaccgtcggcagtcgcgcctccatcatcgacgccgccgccgccgagcgcgcccacacccttactttgctcgtgcgcgtgcgccaccgtcgctggcatgagccccctcacccatctttggccgccgcagagcttcaccgggctaccgccgtgcttccccactgcggccgctgccgtcggccgccatcgcggcgccgccctcctcctctcccgcctcgccccggcggcctcctccccaatccccagccgccggccggcttgcgatttgcgaagagaaaggaagagaagagaagagaagaggaggaggaagggagagagatgacgtggcatcctggtggggcccacgtgggtcccacgctgagtcagcagccacataggacaaaatcgggatcaaaatcaccgaggcactattgtgaccggttttgtatagttaagagatcatcggtatctggttttgcggttggggacgattttatatcccgatgacaagttaagggaccttcggtgtactttttccttttcgacggtgagcatatggcccgtgaaaattctggcaggctaccatgagggagttgccgcgtgccgatggacatatcggtacggtcgtaattcgtaaagacgttaagtaaacgacattgataaggtcgttaccgttttcaccccggtgtcagtgtcatgctcacgctgtcgatggtgaggctctctcgacctgactgtcgtgcatcctgttggggcggctgctccatcacttgtcgacgctgagcacgcagtttgcaagtagcgatacgtgactcgtcacgacgaaagtgaaggctgcgattaagaggatgaggaaaaaaaatagagaagatactgtcgacgagtgatactcatgtatcggaagaatagagtattgggttacgtcggaatagggatctacgtagtacgacattaaaacagacaaaagacaaggattgtactgtttcaggccctttatcaggtaatagccctagtccagtttatatgggattgctgatgatgagaacagattacaaagcgcaaaatctaaatcgagagcgctcttgatttagtcataacgagcgacgctagccattgtccagatacgattagccattgtccagatatgtgtcttgaagaatcttactttactatagtactaattgatcaagcaagtagaaaaaatattcctaccatttatgcttcaaatataattttctcttaaactattcatccgatctacgatccgattacactgttgtgttcataacaattaaatctttacaacaagatctcacatgattatattttgataaaaaatcataaattacttttataatatatctaaattacttttagatttcactaagttaaatatataaaagtaaattcaataaagttttaaagtaattaacatatattatagaagttactttctttttttataagttacttctatagtatatgtaaattacttttaggctttattgaattacttttatatgtctaagaagtaacttagtgaaatctaaaagtaatttagatatattataaaagtaatttatattttttttcatcaaaatataatcgtgtgagttcttgttataaagatttaattgttacgaacacaacggtgtaatcggattgtagatcggatgagcagttttagagaaaattgtatttgaaatataggtggatagtgtctatcatatatgagacaaaccagctaccattagctgtgtagttacgtccattacagagagagtaaccgaacaggtgataccgacaagatcgtagtcgagggatttgacgagatctcccggcgagttggctccgtgtactccggcttcgtaaactttggtgggtgtgttggcgatgagatgcgatgcccttagcctctccctaggggtcccttttatatcgtgggataccttgactctcaagtaagacttggagattatgtaaaccgacatgatatactagagattttacccttttcgagtagtacttcggtaatcccttaactcgtagagatatctcccataatttgaggtgaatttctaacggcgtatacggaaaccaaccgtatacgtatacgtgagagtataccttattgatatattccataagtcataggacagaggttatccttatccgtaaccctgacagatacacgcgatgaactgaaccattaacccgtaatcaattgggtaatattttttaaaacttgtaacgaatttaaagtaacttttctataaaattattttcaaaaatacattgtttaacaactcagaaaaagcatatatgacgagaatttattctctctctggtccgaacgaacgtagcttacgactggacaaggtggcacgtagaaaagcccgtggaccgtgacacattttaacacagacatcgtctcaatgaaaaagttaaaaaatgtagatgaaatcctttcttttctggttctcctacttcttccacgctttcaccggtgacgcccgtcgactcaccttgggacgctaggaacaatcttgcactgtactccctccgttccaaaaaaaaaagataaatcctgggttagtgtccaatatttaactgtccgtcttatttaaaaaaaatatgaaaaaaattaaaaagacaagtcatgtataaagtattaatcatgttttaatcatctagcaacaataaaaatactaattataaaaaaatttcgtaaaagacggatagttaaacgttgcacacaaatttagggttagtctttttttttttaagtaagtctaacaaaagcgggtcaaatcccttccaacctccacctgccaaacgtcgtaggagtatggctccagaacacttccgtagaaaaaccgagaaaagaaatcaaagtcatcgttctcgaaagcgactactactgccactaccactaccactaccactaccaccaccacaccggttgtccctgacgtcgctgggcgatcgatcgtgcgatatggagtgtactcctatacgcttcggggcacaggcgcacagcgcgaatgtgcgtcgcacagagaatttcagcacgggcaccacctgccccccatctgggccgtcctcgccacggggcgcacgccacgcgtacgtaggccggaccacgtgacctcagccgcgacgcaccacggcggccacccctctagctagtactagcgcctgcgctgccctggctgcgccacgggatgcgggtttcaaaattcaaaactcgcccacccgtctaatagtaccaaacaccagttgacaatcttgtcgcctcgctgcactaggccactagcacagcgtagcgtcgtcccgtccacttttgaacgcttcaaaggggtgatgacaaagagatcgaccggggcgcgcacttctttcccctccaaataagctcgtccagtccaagcacacaagccattccaccgctcgccgtcgctgtctcccatcccatcccatgcatcactagcggatttgtggagtggttgcgccccctgcgagcgagctctgttcgtaccgcgcgctccggtgcggagtggttgctggccggcgaggcgggcggacggacgcgtcgatgcgcgtggcagtagctgcgtgcgggtgacgaagcaggggcacttgctatatccgtcgcctcttggcggatgtgcgggattctgcgcgcagtacgcggcggccatggacgcgtcctcgcccttcagcttccacgagctcaggcggcaggcctcgtcctacctcaccgacaagatccgctccgcgcggctcgcgctcaccgatgttaccccgacgcagctgtgagtggctccttcctcgatcgatccttcccccgtcttgttgttcggatagatgtcaccgatccgttgttccatcgtgttcttgatgctgaggtttttgttggtatggtccaggatgacggaggaggcgacgagcggggacgcatcgccgccgaacgtgaagacgatgagcctcatcgcgcggcaggcgttcgagatcgacgagtacgtcaggatctccgacatcctccacaagaggtgagcgatggacgtgcctagcttgcctctcttaacgaagccacccacacgcacgctgcgtttgtgatctgctcgtttgttggctgatcgattgattcgggggcgggaaatcttacaggttcgcgaggttcgacaggcggcagtggcgtgaggcgtacaaggccctcctcctcctcgagcacctcctgacgcacggcccccgtagcgtcgcgttggagttccagagggatcgggaggtcatcgagcagatggtctccttccagcacatcgacgagaaagggtccgtttcaattcttcgtcccgactcgatcatatcttctcctgatgttctctcgcccttctttctcatcaccgatggtttcttcttgaatccgagttgcagtttcaactgggggatgacggtgaagagcaagtcggagcgcgtgctgaggctgctggagcggggccccttcctggaggatgagcgtgagcgtgcgcgcaagatagcgcacgagatcaagggattcggcagcttcaacctcagcagcgcgcatgcgtcggggtcggcggcggcagccctccgcgcgggggcgatggagcaccagtgctacggccggagcaactcgcggtacgagggcaggtggaggagggaggcctgcgtggacgacggcgacaaggagaacctgctggtggtgtcgatggccgaggcgaaggccgaggcggcggcggaggagccgcaccactaccaccacccgttctacggcttcgggcagcagcggccggaggcgatgctgctcctgagccagtagtgatcgtttgggtggatggttcttcgtcgatcgcatcgttcgttggtttgtgatgcgtgagaaaaaatcctgtaaagtcagtggcttgctggcatcctctttgtgatgacccttttgtaatcgtcgtccttaatttcagttctgatttctgaaactctaaaaatgcctgattccctgagctcataaacacacgaagaaaggaaattttgagaagttggaagcttcaagctggcaattgcaggcaaatacacctgacatgaatccggacaggtacaaggatcgtgaaaagacatgcgaatggatgaaccgatgcagtgaaattctctctgctatactccagagtccagaatgtgatatgctgaactgatcagaatcagacctaggcctggtttaggtcgtgtttgggaaaagtttgggaagaagttgatagtttggaaaaaaaaagttaggagttatatgtgcgtaggaaagttttggatgtgatgtgatgtaatggaaagttgggatttggagggaagtttggtgtccttaggctgtgtttagatcctaactttggattcaaacttccaactttttatatcacatcaacctgtcatacacacacaaattttcagtcacatcgtaccaatttcaacccaaacttctaactttggaaggaactaaacacagcctaagttcccaactttttcttcaaacttctaactttttcatcacatcaaaacttttctactcacacaaacttccaacttttccgtcacatcgtttcatttttaaccaaactttcaatttgtaaaatcaatgtgtgttttgattcttattctgtgataaacaattggcatatgtgattattggttttgatatttggagattatcgtcgaagtggttttggagataatcaattttcaggtgatgatcggattcactgttatttcatgtgaccggtccgaccgggcggtgtatgccggtcagaccggtggtgatcgagcggttagaccggccggcccgcggtctgaccggccgacgctgtgtcggtttcggtttcgagttgtttctttggatatccgtgattgtttcatagttatggcttctagatggatattatacgtatgtaatactgttgtttgctactaatgagtcaagttggggatagcttggtctcgaaatatggtttctttgtttgtttcatgtgtaggtgactcgatgcctcgagagagtatttgcggtgatggaccgggagtcggcttggtggtaagacgatgtccgtggtggtcagatatcatgcgggatactaaggctagagttgatgcacatgattggtgaagattccatatggcatacaatggaggtattatgtgcgtatgggatgcggagtcgaatttggaaggagtccaaatttggtacgattggttatgtaaagtttctttcttatactagagggtttcctaaggtgtttaggactcttagtatgagtttggttcgtggctttaggctgcctacctcatgtataaatagagggggagcgtgaggcttcccggtatcgcttttgagagcaattgagttgctagtttagttagggtttcgagtttagtcgaaatttttttaaggagtgctgttggtatactttgtaaacacagagagaagcaataaagttgtgcttcgatttgtgtttcaccgggttttggcagtctaaccggcgactcaccggcggcaaggcggcggtcagaccggctagggcgaggcggtcagaccggcggcgacttcacacgcggcaggcaatcttcaggcggttgaaccgagtgatcaacatcggtcagaccgacagcgcgagcgcggtcagaccggcggatcaacttcggttagaccgatctacatcgaatttaagggtaacttttatttccgctaaaagtttgggtttttgggtataccaaccattcaccccctctggttggcttagttactttgtttcgatcctacacaattttagcgtgagttaaactcacccctaagcttgctgattaatctgtgacatacgagtatcagaaaactctggttcgtgccggacagttcggcgttcgtgttccattgcattttctttggcccaagtcccactcttaattttattctaacctagtaacatcatgcaaatacttaaactcttcactaaacacatatctacagcttaccttttctctgtcacttttacatgtaaactgttcgtcattaccacttgactagttgactttaccataccatcaaatattccaacaattatcagtgtattcaacgctacatactagcactctatctggaaaaaaaaacactacagagcactctagttattacttcctatgtcccataaaaaaacgaatctagtattacatgtgacatattctagtacgatgaatctggacagatgtatatccagattcatagtactaaaatatatcacatctgatactaggttggttttttatgagacggagggagtactccagctacttgcaaatagaaaggagggcacaaaagctcgcggcagaaggcagctgcggtctataggtaacgcgtagcaagatgacatgaatagattcctccagtgcgtgcatcattcccaactactgtacatccctttttgactctgctatcatgcactgtttaatctgttatcatatcttatcctaccccacaggggcccttcgaccggcaggataggaaaaatataataatagtaaaaacgtaggaattgaagtaatatgattcttcaatcccgttggaataaaaaacacaggaaaagatgaaatgtgccctttgatagtgctataggaaaaaacacatgatttctcttccaaagaggtcagacctttttcttttttttcctgtgaaaatgaactaaaggtatgtaatccttgaatgtttcctttcatttcctatgaatcagaggcatccataggaaataatccataggattgtgaatcctacaaaaatcaaaatcctatactgatcctttgattaccgatcctttgaatcaaagagccctaattactggaaaatggcgtagagagtgtatgcctgaattatgcgatgttctgtacaagatcctaccatgggagtactagatttccctcacaagtacagaattcaaacctaaggttcaataacagacttttcatgtcatggtcaccaaaactctacagcgccacaatagcacgcgatggaacgtactggagcttagcattttacctccgacatcacaatagtgctgtgaaaaccggctatgtaaaacaccgaccctattggttaatatcgtcaatcctcacaagtgttcaatatccacacaattgtttaaaagaaatgaaatgaacgtgccacaaggattcattggtaactcacctattgaaggaaccaggcaaacttctacttccttccgaaacagctactccagtaaatggattttcctcggctggtcccatttatatcattaacaagggctaagaaagaaataggaaaaaataaatcaagcagaaatatcagttctttgaaccctcccacaaaaaataacccctaatataaagatcaccggaagcaggtcacctcatgtacagatcttgctgcagcatggcaaggccattctacttgtacattttcactttgtaaccatcatacaaaaatagacagtacaataatatgcctgcaaccatgtgaccacgaactaaattccactgttgtatcaatgaagagcctctgacatcaaacatgtcctaccaatttggatcatctgaagttgctccatgcttttgctttacctaagaattttaacatgtggcatgtctaagacatctactttcacatcttttcaagtcaatcaaattcacagtacaacaaatctcacaaaaactgtaactgctaatccaacaagaaaacagaagcaactttcagttttctctatgaacatagagttctagactactgaatcagcacattcttgacctaagaagattggaattaatggctagatagcatgttacactacagtcacctgatcttcatttcgacatttagggcatgtaaaaagagagggggaggaggctactatatccactaagaacacttatgtcagctacccttgtattattgatcaaaatttgcagattgaaagaacctcataataactatgcatatcttcttcctttttttttctttttgttgataaaagtacaggtaatcaggaattttagatgcacaatcctttgatggagtatgtataagaagttcagaactccattaagctcatttgcaggaataggttacaagaacttacagaaaagaacattgcatattcctactctaggatttaagttacagagataggttaaatgatcttacagaaaagatgaagcttcagacaaggagcatgagaacaaaaatcaaaaggtaaaaaatattaaaatagatgggcaccttccatttattcattattgctgaaattcagtctcaagactgtacccatccccccccccccaaaaaaaaaaaaactgtagcacaataggtgacaagtgcatgctgcagcgcacaacaaagaacaagatattggtgttacactgttttctacagcatatgccggtatttttctgacaagacttcagaatgtgaaattgaaaacatagatacaaatgcctcttgatttcactgtaggctatagatggacaagtccgcaacaataaactaaaccagtaatttgccactaatccaacatacctatatgcattattgctaaatcttatcttgcccaagaacctaggtgttccaaacgactcattactttgatctttcataaatatcacctcatttgttttcatgacatgaagacactcgagacatatgataaatattgaactttttttagtataaatattctccgcaatctgaacagtatatttcagataggcagggttttctattctgcattcatttcttcactcttcagtggtacagaggatacacttttactgaagtagttacaagtttaatgaatagttacaagtctatgacaaacacatcgcatccagtattaatgctgaatttccaagacgctagtttacaaagaaagcagaaaatgtgcacgtcattatttagaaagtttgacatttcaaccatggctcatctcatggatattattcagaaaagaacttgatgggtcccatggctcatgtaaagtacgcatgagctggcacatgaccaaacgggtccagaaactaatcgaataaagatgggcaacctcaataggtccactttcatggactctagtgaaactacatacaaaagtttcatgcacagtggtccctccccaaaaacccaccagccattatgaacatgaaacaccacagaatgttaggaatagccgcacatataaacggtagctaccagaggcatatacaagttacaacaactcatgtttttggtcgacatgtttggataactgacagactatttggatatgtttagacgttagactagcaatgcatgacaatagcacctagaatttcaaactctttattgggatggtttaaattccctcaaatctctaccaaacacaacaatatacaactacctaacttgcatgaaatgagcaatacctgataggtagtcacaagaatcagaacacctacctatcagtaaattcgcaacctggtatacaatgctgctaaacttcttctcttcagatcttagggctgctaaagttcatataggaagcttttggagctggggcataagctatttaatttaactgcaaaccaacttatcagatttcagttcacacgctacgaaactagccaaatgatcagcaaggagtacgtggtaggccaccctatatggttagataaaaaaagggataattgagcatatgccaccctaaatggttggtttatgtcctcaacagaaatttaacggtggaaaatcctgaccaatcagctaaagggtggacatgtgttcaatttgtcttcagggaatagtaacagcaagcgcaactagagtccgcgtcattagcaggaaagaggagtgagaatcaaaaacaggggtagacaaccaggccacctccaagctggccagctcattcctcacgcttaccacctatctatcaatctccagaaccctgactccaagacttcaggtccttgataaacaaaataccaggcaaatgcatgtcttcaaattcttctgcaccttaccttaatacaaaagacacacaaatcgattccccagtaatcctcagttcctcacaccaattccccagtaatgctagccccaattggacttcagttcaaacacaaactgacctgattagaacaactatgaacatgctgctgttcgttttggaacaagtaggtttcataggtctctctacacatgatattatttcgttaaaactaataaagaaactagacaaattgctactgcttttgcccctataaaattctctacccatcacattcccgtagtacacattctaaaatggggaaaatagtaacagaagaacaaaaattgagcaaaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctccgcagcatctggcgccatcgcgtccggcggcggcgccatgacgtcgctatcagcaccgccccgaccgaacattttcttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcggggaggtcggcgaaggcgtcgtcggtgggcacgaagacggtgatgccggcgccgcgctcgtctgccgtgaactcgtccgcgacgcccgatgcctccagcatggaggcagcaacgttgaacccccgcgcgtccgcgaggacgtgggtgatgttgacgccaccggccgggcggctgtcggaggccgcgacgtcgagcccggaggggacgatgaggccacccaccgcgagcacgctgaggttgtaaggcacagcggtgacggcgccgaggacagtggcgctcgaccccgggaaaggcgccggcgaccggaccacgacggtggagtttcccccgacggtgaggttgacggcgccgagatcggagggcgcgcgcccggtggtctggaacagcgtcgtcacgagcttcccggaggcggggaggcgcgcgaggtcagaaggggagaggtactcaagcaggacgtggtaccgcagcacatcggcgatgtcggcgccggaggccgccgcgaacgccgagggcgagcgcggcaggttgttgttcggcacggccagcagcgtcagcgacgaccgcgccgccagctccccggccaccgggctcgactccagaagccgcgcgaagtcggcgaagctgggaaaagccgcgagcgcggccgtcacgttcaccccggccgcccgggacggcagcacggcgagaactagaagcagcaccaccccgagcgcgaggccgcctggcaccggaagggctcccgctccgccccgcatctcgccagcggggggagcaactggggtggtgggtgggggactgaggagtaagcgaggagaagaggtgcccgaggaggaaggagacggggaagaaaaatattttgcgcgtgattttggttttagattacggggatttttttgctgtcgaaatgcgatagtttacgcctttctttaaacggtggacttgttttgggtgtggaattaaatggtggcgtcgcagcgttgatgggacgatgtggactcctgctagtctactacgccagccagctctttcccactctccgctaccaggcgcttttgccaactttgtaccatgatgcacgtcgcatcacgtgtgccttggtcctattcgacagaatggtgcggattgaggcgtcattctaccaaccaaacaattaaatacggactttgctcttaaaatacttcgaatcaaaggattaactatatgaactagtccattactgtaaatttcaaaaaaaaaaaactagtccattactgtaccctcaattcaggatcaaaaatatttcgaaactaatggtcttaagattcgacattgttttggtcctgggcggtgtttactctgttgtgtgaaaatggggcacgtgaagggcgtagtgaaatggcaccgggtacctttccctgggtggaaatgtagtgtgtgtattacactcaacctgaccagaacagcaagatatggccgaactttcctcaggtgaggtatcgtcttccggaccactacgatagcacggtatgttgtgacgcctgtttgagaagccttgattcattcagtaccaaaaggcacctggccaaaaatgggtaactgaaacaatgaacgggcaaaaaggcgaatctaaatccgtcagagagatttcacgagatgctcgactcaccagcttcctttcacaagttattgtcgtttaacggggatgatgcgagcggcgtacataagctacaaatggggcatgtgacccgcctcgagcccccattgacgacctgcaactgacgccggtgaatgcttgtactcgataagctgaaagcaagacggccgtggaaaacgtaccggttttcctttaccatcacattcttcatcggactgataatctctcatactggacactttggttttgaaagattgccaactgcaatttcagaaatatcctgcttctcagatggcaacatgaagaaccagaactgggaatagaatttccaacttttagctgtttgcctgtttctgactcaaactgaaattggcaaattgtacaaatgaaagaagaaggaaaacctccctcccttgatacaataatcaaaagaatagttagacaaagagctagctttcagatgaaaggatcaataaattatatcagaataagcattgttcctcttctcaaaatttgtatgacaaatttcttcctagctgagaaatgtacaagggaactactattacatcaagcggactggcactacattgtcagggtattagacctagaaacggttagacacatctattgagactcagatcggtgtattgttagccccaggattagcttagctaatatgaatctaatatatccgcaaaatccacctggggagtgtaatagatgagcaatgctgcagtagggtgcttggagaccggacagacatcacaccaccagacggcaagcaaagaatgagcacatgctatggtaccaaaaagaatcaaggtcagtcaatcaagtcaagactagtagatgctatctagcctggatggatttagagtgttctgatttgtttgagcggcacatgcagtcggggcatggaaaggtgtatatagattcatttgctcttttcatttcaatacccttggcatcgctgtgtgttctcatattcaccaactgacgtttcagtgacttccatctgcacaaatgcaactaaaattttaacaaaacgaaaatttgctagttttaacaacgaataatgcaagaacgtccaagatttccagagccagaaggtaatttaatactgagttcatgagccacagtaatagcatacccgatacgtggactatcgaagagtatggctaatcttcttttatcaggcttaattgtcttcgaatgaccaccataaatgtatctcctatgaccaagaaggaaatgaggaaaatttccaccttgggtagtcacgaaaacttcactatgaacacatactgtgtaatcgatagctgccatccttgaagagaaattctggcagatattgcattatgtcagatcatacttgaaaagcaaagaaacttttgcagacaccatttgtatataccttgaatggagcaagttcttcatctgatgccaatgtttcttttgtctgcaagagaggaaacatttcaaggagaggtgccatgttcttctctgatttatatatcctcccagaagccaaatagatcgcggtgttattgctgaaacccatcccgcgaagcattaacccaacctaagcacagaacataaatatgtaaacctatggtgcaacaatcttaagcaatggctattaattaaatcagtgtaaacttgatggaaatatttagacactagaatacacctccaaaggtgtaagtggacatttcccattcatccttattgctccaggccttattacacgtcctggcctagtaaactttcctctccaacccctctccctggctgcatccagttccttcttctccttttcacccccgtcgaagacacaacaagagaatgcaaccatatcctgcaaaagaaaaatcaattggttgacaattctcttgtctgagaaacaggggattcggaccccattattattttggacagaatcagcacccaaaggtatcatgaatagtccagaacgatttgttaacagaagaaagactaacctcttcaaaacggagatgcaccgctacatatttcccattgttttcggcacttttttctctcattcgagatactaaaatgtcagataaagttgtgatcggcttagaaaactttaaggcttcaaaattagccagacatctcaaccgttgaacagctgatggagcatcaaaggacagtcggtttgcaaaaggtgatatccttataagcctataatgtacagataaaagcaataaaatatcatatatcacagtcggtttgtgaaatttactctatcatatatcacaagtcaacattcttacattcttcagaactacaataacaaaattggctttaacctacctttcttcgatcaacttaggaagaacagcttctttgtagtatcggatagaagaccaagcctttatcttgaaattaaacacattactcaaattgtgaccaaacctctccataataaactcaggcaccttgtcaactactcggacatcatttttcaatcgttggacgaagtgttcctcatcataaatatcactaaatttgctgtatcaagaaaaagaaatgttaataacttgatttttttatgttgtaataaatcctcaaagaagcctctctcatccaaacacaaacatagaaccttgtcagtatggcagttaacatagtacagtgttgcagcatgcaaaaaaaggaacattttcatacttcactactaccatttggtatcttttttatgtgacacctttgaacaaaatcatttctcattaactcatacacatatttcataaaaaatggcataagtagagttaatgcaaacaaacttctggttgtttcaaaagaaattcaacttcgtcagagagagagggggagagagagagagagagacctaggatccctccaaatgctgtgatagtggaagtttgggatcacaagagttgcatttagaaaaccagcaaccgcaacagcattgcatatctgcaaaaaaaaaagggggggggggcgggaacaaaaaaaattgtagaaactcatgatgtgtttgtggacagaaatgataaaaatacaaaaacaaaaagggttcattgaaggtaggtaacaaccgatgccctttgctgattcaaaccaccattcgcctccacgtatatgtagccatttaattcaggcaaatctaacataaatatttaactttattagataattccatcaagacataggcgcatcatgcaaaatggtattgctgttttactaagtaactgaaaaaggagtatgcatatagcataaacaagtatggcaaatgcacataagtaaacgacttccagtaaaaaaaacaaagtgccctaggcctaggatgtacagtcaaactattattttactttgaccaataatagcttcatggtagttatattggcacaaaggtgccttatgccatgtcccacaaatatatcggtagatttatcttaaaacatacttccaataatattacaaatttcccggcctttacaaatacatcacaacaaaagtgcaatgtagaaagtgcaccacatatcactcatatgcaaatgacaagtggaatcatttgcatgtaaatgtgatttatctttcctttagatttttgtgcaaaaaggatgtaccaggaagcagcaagccaatggaaggaattaaatgtctgtttgttcagagatacacaattaaccatcagagatgtcatatttggaaactgtgaagaaataataagcattgttcataaaaatcctttatgggcatgtccacatgtgcctgattctaccaataaatgtaaccctgaccaacatgcatatgtagtggtatagtttcacctaaatcacttgtaaagttttgatattttctttcacaaaatggaacttcaaatattacacgtggacaaaggaagaaactaggctgcattggaattcatccaagtcatatcatattaataggaacagttctggcctttgaaatgaatatataaacaaatataagaactgtttgaaactcattagtaaaaaaggaaaggtaggaatggcataccatatgtaatattgtttatgcaaggtcgccaaatgccacccttgtaagcatgtctccatacagttgctagctacaaaaatgtagtaatatgagattataaacatacatcgaaaacatgcataagtgaacttagaaggacaagataaagggtgatagcatgagggaaataataaaccctcaaaccacagaacaatatggatctgtaacatataacatgaaatggtactaggcaacactaaaaattatgtcatataactacattaaagctaatggacacaatagaaggaaaatggtattgataaatcaatcctccattatgttatgagcacacaaagatctatatatgaaaatagcacatattccatctttgataaattcagtgcaaaagaatgccccacagtgctatagcaagcaggtggcaacagttgtacagtacatcttattgtttgctaccaagcaaggtcattttcactgatcaaaaggacaatgcgagctatcacaccaggaaacaggcccataaaacttgaaaggccatcggatacacagaagtttcattaatttgaattaaaaaaaattacctgtaatcatctaaaatgaaattcttttttgcagtcatcatccatatcgagtgcaataattcattaaggaagaaccaactaaggcatttacttaatgtgccacaattcataatcattgtggacaaaaagatacaaatgaggtgtatttcttaaactcccagcaggcagtcacaataaacacaaacatgatagctttttgacccaatgtacaaacccaacaggcttattggcttattgcttgcagcagttgaactgataaattctcacattccaacactctagttctgaccaagcaaccccattgtctgctaatgcccaactggctaatattataggacacccacaaatccacaaatatgaagtaggtttcaaccggtgaaacaccactagtctgccctctaatccaccccgcacatgcagcaagtacaccaaaaacattaactgatacatcacacgcatttctataattttattgcaattccccaacaactgtaagaatacctaacccaaatccaacccagtcagaataaactaaataatctaatcgtttattggccgctagccacagacacagttcactgttgctacagatgcgctaaacttagtacacaatcacccagtaatccaagtaccaccgccagacctaagacatctcaagcaccaagtaaactcgctcagcggtcatcacaaaaaacgaccaaatattttcatcgcaaatataaatttctagtgcaacagacccaggctgcggatgagcaggtgggagacactcaccgcgtcagtggcgttgtcggcgtccatgtcggcgcgcaggcgggcgtagagctgcgggctgcggtacagcgaaccaggcgccgggcgcgagatgatgcggggcacgctgtcgagagagatggagcccatgtagagcagcatcgccgcgacgtacagcagcggagcgaagaggaagaccgcctgccgccgcagcagcgcggcgagcaccaccctc

SEQ ID NO: 14823 - DNA, 14404 bp, Oryza sativa
ctcccgcgcgatcgatcgcgcgccgcgccgccacgcggcgggagagcgagacaacaccaatgcggcggcggcggcggcggcggagaggaggaggttgcgagccggagcggagggggaaggggcgccgcacggcatgtgtccggcgcgtgaccccgcgcgcgcgcgtgcgtggccgcgtgggtgccggtccgagcgcggcgctagtggccgcgcgctggtggtggactggtgacctcccctaatcggtcgcgctcggattcccagaagttttttcgtgcgcgtttcaggcgcggcgcggcgcggattatggtttggctttggctttggccgtcgctgaccggggattcggatttttctggtctctctgatgtggtgcggccggtgggcgcgcggcacgccaatccagcacgggagtcgggatagattgattgatgtgggaatgaacggaatggaaggtctaatgttcaagattgggagtatggaactagtcggattatctttctatcctcgcgtgggtggtggtggacatttgggtttggggagagattcgtaatgcgatccgatctttgcctcatgatcgtgatggggaagtgaggttgacagcatcaggaggccaggaatgggctcggtaatgaccctttttattcgttagggcatgccaaatgtatctggctcaagtgggcattagcataggcccatgtaacaggaggtagcagtgacatagagagttcactatgtatattttgtctgccagaggtagtaaggtggggccactgaaaaaactatacattttctatataacataattgcttaccccatgaaaatgttgcacatctattatttttttattttcttgctaccggtagtagtactaaaaccggatagcagttgttaccccttgccacaatgtttattacccgataatagagatgtatttatgtcttattacctacttttcaaccatattgtggttgtagtgagtagtgacggctattgatcagagtcatcaggctgtgcttcctgtagtaccgcatggtgactgtgacttttaacacgaggataggatgcaagttgggagtgtacagacagacagaaatgctaccagtattattactaccggtttattaccacgtcatcggtttaggccatgtgagtatgtgacacgcggagcatgtagagagacaaaccgaagacacgcttccttctattccggatctttcaaagaaaactgcaagctgtactcagcattgatctctttcctcgtttcctaagcttccacagctagtactagtagtactacgcaagttttgtgcatgacaaccgaatttcttccagaagatactgcatatgccagtgtgaagccaagtagtagcacaaaattgtttttctgctcttctccgatctgtcaaactctggtagccgtgcatagttggcgatggatattattttcgtctcaagctccccctttttcacacggacagaacttatattgggccataacaccatctttcaagtggttttggtttggtgtggtatttatgccacttaaatactatgccaaataatgcggtacatttcccacgggttattataaatggaattgctatatgttattcgaatgaaatttagagatgaaatcttatagattttagactattggatctatgccaagattcgtacatcggcttctctcctctaactccgccgggctcccttccttttcgggcgctggcgacaccccccaacttcggtagggagcatacgggttagaatttggagttggggtcagagtagaaggggggttagggaggggaaagaggggttttcctcggggcttagagagatgtccgtaggaggcagagaaatggcagtgggtggtggtcggtggacttcagcgggcggcaaggcagcggcggcgccgcagaagccacagtgatgaaggagggtggtgggccggcatcggcggcgggggcaaagcaagcgtgtggttaggagacagcggtgatggttgcagattcggcgatggggagccatcggagacggggaagacggcagggcgggggcagggggctcgctgagggagcctcactagcaccgttgactatttccaactagccaacgaggcgggcggcggcacagtgggacggtgatggcaggggatcgcacgagggacggaaggaggagtggtggcagcgcgatctgaacggggggaggaggagaggagttgttgagaatataggcatataatgatttaatatattccataaataaatcatgacattacagatgtatacgggcgagctgtcgcggacgaacaaggagcagtcgcgcgaaacgcttcccaaaaaccttattgccgccttctccggtgcaggacgtcgaaggcgataagtcgcgcgtaacttatccggactccactacgcgaagcgcttcccaaaaaccttattgtcgccttctcccggtgcaggacgtcgaaggcataagtcgcgcgtaacttatccgactccattgcatctgcgaagggtgaggagccaattttgtgaatcattcgacgcgtacgtctgccagaccaggccagcgagcgcgcgcgtgtgttccccctcttctctccaccacacatgcttcaagtggctaggagggcatcctcccctttaaggatgtccccctctcctagaataagcaaggtggtactaaactccacatgcatgccatcccatgaggtgggcttttgtgattttccaaagaattaatcttcgaataggccttagcccatctattaattccaacagaagttagggttaagagctccgcacaaatcttgaagcatatccaatggtccaaaattcgaataatatgatgtgggattttctgtcacaaaggacctgttcagattgtagccaaaataaaccttacaataccaaaaatttggcaatttaataatattaccaagttttggcaggattttttatttatttactagagtttgataagtaactaaatggatgcacgtatttcacaactttgcaaaaaaaaaggtttgaaatggcatcaatctaaacaagcccaaaatatgtagacatccccatttataaacatttttcagatgtcctgtatttattttctggaagctccatcacctgattttaaacataatgtatttgttatagcatgactgtatatgctacagtttgcaccaaagtaattgcatctttgatcaatcctatcaaaaggctataaagaattaagattgtgtgatctatgacatgttgattacggattgatcatccaaagcttaattaaagtaggttgatatggtttcagaaaagaagaaaaagaataactagtagtaagaattatttaaggccagatacagttaagatggtgcagctatatcattacctaccattaatggtggggagcattacgatccgactgataaatttagttttttttttgccttaaatagttccgatcatacaaaaacaaagaccaaagtgcattgatttttttctagaaaaaaagagtgttgttattttggcatgcggtcatgacaaaagaaataacagttccaagggatgaagaaaatcacaaaagcaacagaggactaggaggaagaaagaggaggaagccaagcgctacatcagccagccacattgccatctacaaccagcgatctatataacaatggagagaccagagtggaggaagcaacgaccataagagactcgaagttgagaaggagaccctcgacgtggtcaccattcgtcgaagtggacgaggatacgcagccatcagagacaattaggaggaatgtggctttatctcagcagtatgggcgttgggtggacagtatacgcgcgagatgtggcgtgtgagtggctaggtgtgggactatggtctatgggaatggcgagtgggtgactgcttggataagaggcacctagcttactcaagaaccataacaattactatattgacagaaaaaaaaactagaagatatgcataatttgaccacgttgaatataggctttaacgatgtaggtgtactgatatagttgtgtttatgaaaatggaagaaagggttgaatctcaaatacaatttgttttaaaagaatctaactttgcatcaagttatgctggaaaatacattagcttgtgtcgaagaaagtaaaagaaactaaatcattcccatctttttttctgaatggataggtttattatgttaaatttggaagttttgagaactgtaccaacaaagcccgtctagctcagtcggtagagcgcaaggctcttaaccttgtggtcgtgggttcgagccccacggtgggcgcatttcatttttttcctgttaaagtcctttcctgtgatccagcacatgacacccagctaatgctttctggcactctagatacaggatttttttttttgccgaagatggagaagctgatgaatgcggtagcaaatcgccgatcatctcatcaatattcatcaggtgacaactgacaactcaagaatcccacttagacaagccattctagttccctgtgtggttggttccttatatcattggatatttaattcatggatgagactcccgactttctgtggtttgtagttttgccattgacatgtgggccatatcaaaaataggacccacatgtcagtggcacaaccttaattcagttacctcttttagcacagcctgcacctgcaatgtcgtcgaaaacacagcgcactagcgagcagttcatgctgatacttaacgaccgattgagtgaggatacaacctccgttattaagaaaagaaaccttctagatatggcttctttgccaattttttttattatacgaatgcgtatttgaagtattgaacgtaaactaataacaaaataaattacagattccgtctataaactgcgagacgaatttattaagcctaattaatccgtcattagcaaatgtttgttgtagcatcacattgtcaaatcatggcacaattaggctcaaaaagtttcatctcgcaatttacatgcaaactgtgaaattgtttttttcgtccacatttaatgctacatgcgtgtgtccaaatatttaatgtgacatttttggccaaaaatttttgggatctaaacgcaccctatgtcgaaatatataactagaatttaggactgttttggtttgctgcaaaaatttcctctaacaaatagttggcacttaaaatagtaccttgtagatgtttggattgatgccaaaatttaccaaaggcaatataactcctataattcaactctactaaaaatattggcaatgccaaatcttgcccataatttgacactaccaatgatttggtagggcaccaaaccaaatgagccctcattatctttttaaaaaagagggagtaggcaaaactattggtagttcatatgtaacggggtaagtgtagcgtcttgcttgaaaaaaaaaaacaggtggaagtgacctaaatatatgcagacccgaaatgactagtactaccacaataaacaagatgcgacatatttcgtattttattttttatgggacgaatatagagaactccctctgtccttaaaaaaaaaggcaaacttaaatttccatgccaacgtttgactgtccgtcttatataaatttttttttataattagtattttcattgttgttggatgataaaatatgattaatactttaagtgacttatctttttaatttttttcataagttttttaaataagatggacggtcaaatgttggacacggaaaacagagtttgtctttttttttttgggacggaaggagtacatgctaaggcgcgctatatagtctctagtgttaacaatgattgatttaaggtatggtggtaggtgacaacattcaaccacatatcctgattcctgacattaaacaggagctatttttccaactagactgaatgagctgccggttgaacacgtctagtttcttcatagctccatttcaccaagtacatgaaacggtagagatggtcggttggtcacgttgatctgaaaaaattagcacgagtgggattattcaaggtcctagagatggtcagttgagcgccggctgcgcgcggccaccgcccggaggtcattccatgccggcacttggacgtatatattacacgagtaccccgtatttacaccatcatcgtgtatacacgagggggagggggaactccgatgtggggaacaacagccgcagcagcgcgccgtctctgcgcggccggcgacgtccgctcggtgctcgcgatgctcgcctgcagggcgaaggcgggggacacggcgctggacatgaccgcgtgcgccgcgcttgtccggaccacgggttctgcaagggcggcgatgtggcggaagcccggagggtgttcgatctaatgccgctcttgggggtggcgcctaatgaggtcacctacaccgctttgatgcacggctacttcatccatggccagagggagaatggtttgtccttgttcgaggagatgagaattgaggagggctggagtcgagccaagcctctacacctaaaactgcttgatcgcagagtggtgcacaagggaattcgagcgcgctcgtaactagttcgacgaaatgcctgcaagggtcatagtacgcaatattattagctctcattgccgcctacgcaggcatggcaagctgtggggtaccgccaagctattggaaatgatgcggagggacagtactcgtctgagataaacatcattacctatagcctccttgttgatggctacggcaaagctgggaagatgtccaatgctttgcatttcttcagcctgatgaaggcggccagtttccaaccagtgcaatgacatacaatatgcttattgccggtttctgtcgtgctaggggcaaatagggctttatctgacatgaaggaacgaggcttggaaccgaccaaagtgacatacacaatactaattgattatttgattcatttgccagagaaaatgacatgaataaggctttttagatgcttgcatgggagaaggcaggtctagaggtggatgtgcgcacttatggtgttctggttcatgcactcttcatggaagggcatatgaaggatgccaggaagctgtttcagtcaatggaccagaaaggtgttgaaccgggcaatgtgatctatgacatgatgatttatggctatggaagagaagggagttgatacaaggctctgaagttgatcatggaaatgaggcagaagggtttggttccaaattccgtaaggtatgccttgatgatgacgatttgttttctttgcaatgatgataaatgtcaggaagctgaggctctgctcgatgacatggtccgtgctggtctgcaaacaagtgaaccaatctgccagtttactgaatgccaaggcaagattgagaggttctactgatggctcttttgtgtaagtaggaattcatttcttttcatgttatagtgaattatcctgattcatgagaaattagaaagatattgcacaaggaaatctacgtattgaattacaatataagaaactgtaagttcatttgctgggcatcacagagaactccattgcaagcgacaaagataggcagcaaaatgccgaagataaatgcacccagcacttgctgcaaaataaaggtcagtgcttattgggatcctgtgctttcatgctcgtcctgcacgccggaggctttgccaggtgaaacttggtttgagcaaaacccttttcagatgttatttcatgattcctagtacaagataacctaccttcatactcaggtattagataagaaaactagagatatatagcttcaactattttgtgtccgtaccatatactccgcccatagcgcctgttcatatcagtcaagtagaattaggttttattgtttcttgtttgtcagggggtcaaccatgagtccttgacaatgctgtatgagttcctgctatatgatagatcagcagtcgtcattttcctcaggcaatataaaacctagctttatattcttgctcttatttgcttcataaacgcttgactttaagttataacccatgtttatcatgcacacgcaagttcccagcactctcctacattattaaattggggtgtgtttagttccatgccagaattggaagtttgaagaaattagaacgatgtgacagaaaaattggaagtttgaatgtgtaggaaagttcgatgtgacggaaaagttaaaaatttaaagaaaaaagttgactcttcagggatggagaccccttccatacaaagaaataagaatgtcggcgttctctataggctactgacaaagctatgctacatgagttcccttgcacccccttttcataatataagagattttaggtagatgtgacacatcctaatacaacgaatctggacagaccgtttgtctagattcattatactagaatgtgttatatctacccaaaatctcttatattatgggacgtagggagtaattaatagctctatatggtttaaggaaatgagtaccctatccaaatttctacacctgggcctcctcgtccttttctgattgctatgtgataccggttcccacttgctaagttgccttaacaccgcactttgcaatttttctgataggagaatcaagagtgaccgatccttttcagattcttttgcaggtacttttcagttcatcttgtgtttatgacgaaatgctctttaattcttttgagctcatgaataagtgtcttaaaagaagagctcatgaacaagaataatttaattgttactaatactagtaacaaattactgcatatttactctctcttttgtttttacttgttagtttggacatcaacatagtctacttaattatatttatatatacaaaagaatgctgaaaacatacttcctccgtcccacaataattcaactcctggattcccaatgcaaacttagtacaaccatgaaaataccgaaatgccctcaacaacaacattacacaggattgtactgggttctctgcactgtcctcactgaaaaaaaaggtttaactgggttctttgcacccatcgattacactggtatccagcaaaaaaatgaagttttaaaccgaatatgctaacaaaaattaagaacctctagtctgaaaaaagaaatcataaaaaaaatactactccacaatctgcaagatggtttgcatccataatctgtcaaaaaaatacttctccacaatctgcaaggagtatgaattaatctgcaagaactagaaagaacaaagaaaggtgtttgcatccaccaaggtggcctgtagtcatgtgtgtatttatctagattgaccatgcaaaaagtcatcatcaaaatccaagaacttagtatagttaacaaggtgaaatggcagaaataaacaccagagaagaaagagtgatgaaaaataagtagtagaaaagagtacctgggttcattctaatggcaaagcttctcgaaccacctcagcgctaggagacacaaaatcgttggctccttcatcagatccgccattgcaaaagcttgtgcatcaggctccctgcaacagatccactggcgctggagaccataggcttgcgccttcgccgccgtagtcgagcagcacctacacgttgcgttcgccttctcctgcatcacaatcgcaagcccctacctctgccgccgtgctgctagtgcctcatccgagccatctcaatccgccggggccggcgctgcccccgccgacctgtcgcatccatgacatcacgggaggtcgcagggagggagagatggatggagcgtggagggaggggaagcgactcatcgccgtcgagggatgggcgaaggtcgtgaggagagggaggagatgagaccggcggtggtggttttttttagcgcggctgtgtggtgggcgagaggagagagacgggcagggataaggatcattgaatatttctcgggtgttgcgcaggagttgattttttctgggacaaatcctcacccccagaaatcgcttctttctgagacggagggagtaaataattgaagtacttctgacgacaagtctcttgatgctattttcatgtactccttccgtcccataatataaggtattttgagtttttacttatactctttgaccactcgtcttattcaaaaaatttatgcaaatataaaaaacaaaaagttgtgcttaaagtactttaaataataagggcaaaaaaagtaaataataattccaatttttttttaataaaacgagtggtcaaacagtactaataaaaactcaaaatcccttatattataggacggagggagtaacaaacatttatcttttacgaatgggtaaattggaatcatgccattataattttgtaaagtttgagatctatcggtatctcaatgacacgtaggacccacatgagtcaatgacatgtgggtcaggatgacatatctcaaattttgtaaaattataatgacatggttccaattttccgttacgaattgatgtcaatgttcttggaatgttcactacagcaagtactagcgctgaagcagtacagcataacgacgactataggactatttacctgttcattactcgtcgtaatgtcgtggactcgtggtacgccgcgtacgcttctgcacgctgaccgctcgccatgggccatggcaaatgtgaagccgtgaagcatcggcccagcagaatcacccgtacacaggatcgattaccaacggcgcagatgacctggaggagaccggacgcggccggatgcggaagtgtattccccttcgcaccgcacggtcgcacgcacgcaccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcgatggtggagcaggaggggtgcgtcgagaaccggcagcccctggcggcgtcgagctcgtcagtttccgacggaagcagctatggcggcggcggcggcgggctcgcgcagatgtcgccgccggtgtctagctcggcgaattccatctccggtcttaggtaaggaagttctttgcccgattcccctcagttgggatcctattatgggagggatctaggaaggtccgttggttagtacctaagttcgtgtggtagttgagaaaaatggggccttcgtggatggctccccgatggttgtgtggttttatcgctggcaatttgccctgtctgtgattccacgagcggttgtttgtgcgtttgagaaaaaatcttgccacgaggagtgctaccttggcggatatgtggcaccgagagtgttgtggtggctgtttgagtgataaatttggtgtttttttggtatccatttgatgagatacttttttatattcagacatgactttgagtgtgttatgatggatatactgatatgaaggcgttttccttttgggatggctgttgatgttttcatttctgtaattaatttgcttgccttactttaaagtgtgtatattgatgtaatttggataaaaatatgttcacttggaacactaaattggtccggttacatgcagcagtagttgtttaaactggaaatgtgttttttatgccatgacccaaggttttattagatttaatatgcttgggctacagcattggagataccatttacttgtaaccttgatgtgtatattttttgttctgactgctgcgctaaaatatggtactggtgcactatagaaatagttgttttaatgaataaacagtatttttttgttaggccctgtttggaacgtttaccctttgtgtaagattcctgagttcaaaacagggcctgaatagttgcagttacaactaaccgccatttttgtttcccacttttaatttcttgatgatgaattgaatggtgttagtagggttaagcagtatttttttcatggaaatctttcttgttcatgaaaggctccacacatgggaaatttacattgtcgaactatagccttaatgttcttccctatgtaggtctctcaaccaacaattgctgtttttttgggtcatcttatgctagtgtatttagatataccttgtgccttctcggacctaatatgctattgtgccctgaacagaaaatctttcactttatttttgctgataatctttatcttatgttaggcggacaagcgggccaataaggagagcaaagggtggctggacaccagaggaggtcaacacctcactctctattgtacttcataaatactccataagtcctattaaatgcaatacatacctacatttgttacacatatatgctagtttggtttgtatatgtattttggcatattcagtggtaatatcatgcactggaaaagttcttagttaatctttttccattcctgtttttctaaggttcttattttatccgattttatttcatatatgtttttattgttattcatggtctgaccattgattttttgtttgaatcaaatcttctattttcctgcttgaacgacatttccatgttgattcagttacacaatcactgttactaattggtcttaacttatcgcaacaggacgagacattgaggaaggcagttgaggcttataagggtagaaactggaagaaaataggtccggctctcaattccactgcaccagtgtataacttgggcagtcagttatccttgagatgatgctatcattttgttgaaaacaacctgtcaggaggattgcaaatgcctaatggtttgattccattaatatcggcccatttgcatataaatatgcgtatacaaatatgatctcagcaaactaatacatttttgcgtagattatatttgtataaatatatataagtatgcaacctatagtaatattggtgatcttgtagttgaaatagctgtttttttacctttttaatgttgtagtacttcattatatcagttgctccacgtgtactggcatacagcatgccatattatttttccatatctgtatgccaa

SEQ ID NO: 14824 - DNA, 8155 bp, Oryza sativa
  unsure (1)..(8155): unsure at all n locations
ccagttatttttttcacatatgcatttatttccctttacatgagacattaggaaacttttgtaattgcaagaaagaactttaaattttaggatgctcatagttgctacaaaagctcaggatcccgtctattatgaaatatgaattaattaaggccttgttcggttaatccctgtgatggagggattggaggggatttatttcncacctattggcgtgtggaattattccccctcaatgcccttcaatcctcttcaactctaaaccgaacaaggcctaagaaatgcactacttactgaaagaactgtgaaaataattggctaataattatgctacagtatctcatagctgaattcaaactgttgtccgcatataatttactttctttatggcttcaatagtatttgttatgaaaaaagtgcttaagtttggcatgatacaatacattatacggagctaagtatgaagtcatacaatcttaggtggcacaatcatctaaatccagaaataaggaaagatgcttggactactgaggaggaacaggcactcataaatgctcatcggatttatgggaataaatgggcagagatagcaaaagttcttcctggaaggtacgtttataaagcttacttccctcggaattttttgctttcattagttcatcgagctaggtcaaaatcacgctgccctcgatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatgttgctttttccaggactgataattctataaagaatcattggaatagttctctcagaaagaagcaagatatgtacaataccagcaataatatggtagttccgaaactgcttgttcatgataagttcaaggataaaccaaagctgatggctatggagggtcatcttgatttgaacaaggcacccattatcaattcaaaagaccaacctggaacagctcatcggtctaattgctcagggtttctatctcgttcctcattaccaactgctcagccacttacttcccgtgaggcatctgtagttgatggttccgctgtcactttagtggcgcaagctctggaaagtgattctgtccgtggtaagggcttggaaattgattctgttcatgagaaaggtcttgaggttaactcggcacctgatcataccgggaactcttggaccattcaactagaagctgcaccatccaaaggtgaagcagaattatctttgaagaatgaggcacgctctcttggtccactttgttaccagatccctaacatggaagatgtagtccctgtgagttcctcactcttttctgaccatcttactgggaaccatacatctgaacattgtggggatgatatattgtcacctgctggctgcactactccccctccaacaaagggaaaattaacaagccagcttagtgttgattcaattttgaagagtgctgctaacagttttccaggtactccttcaatattaaaaagaagaaaacgggataaatcaacacctgtttcagctagtgagatgaagatcagtggatcaaatactgatagattttacactcccatggggatggaacctgctacagctacaccagagtcattcaaaactacatcttttttgtcattgggttctcttgatggttctgtaaagagctttgatgtttcaccacaataccgggcaaggtcaaaaagaatggctctcacgaaaacagttgagaaacagctggatttttcatcagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggatgtaacctaatcttggaaaatgcaggtatgctgttacaaaaatcttgaaaacccctgctttacaattgagatgcattatacttttcatagccagtctacaaattctacctggtttatctgatccatgttggtagttgggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatgatatgattcagctgtattactggccctgtttgggtgagcttaatttagagaaactggaatatgtttctagattctaattctatatctatagtaactatacatatcagaatatgtatgaaaaattagactatgtaagaagggtgtgttcacactaaaattggaagtttggttaaaattggaacgatgtgatggaaaaattggaagtttgtgtgtgtaagagttttgatgtgatgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactccacgaaaaccctctgcctccttcgctcgctgcaccctcgtctcggcgatccatccatggctgccaggaagttcttcgtcggcggcaactggaaatgcgtaagtattccccccagcactagtcgtctcacaatccagattccggatgagccggagacgctgctgatgagtgatgaggcttgggttttatcgatgcgctgcgctgttgctgcgtgcagaatgggacaggggaggacgtgaagaagatcgtcaccgtcctcaacgaggccgaggtgccctccgaggacgtcgtcggtgagccgtcgtcccctcccgagggcgttgtttggagttggatcgattcatgaatcgatctggtgctgatctgtgggtttgtttatttattttaattttttttgggtgcagaggtggtggtgagcccgccgttcgtgttcctgccgcaggtgaagggtttgctccggccggacttctccgtcgccgcgcagaattgctgggtgcgcaagggcggcgccttcactggcgagatcaggtgagcgtcctcccccactcccctgctctgtttcccttccccttttgttttgagagagatgattagtgatttatttggcattgggtgaacaactcggccttacagcgcaatctgagtgtttatcacgagagcgtcgattttagtacggattgttcgaaccgcgagtattgttagtcgattataagcagctctagttccacgaaatctgacttgattataggcatgaatggatttgtgggacagctgaataatgaggcatgagtatgctgctgctgctctattgtggttatcggtgatgttctgcagactgcagtgctattatattaaggggtgaatgacagcagaatgtggaatgctttaagagcaatcctttgccaattcactgacgtatgcttcatatttgcagtgccgagatgttggtgaacctgcaggtgccttgggtgattctgggacactctgagcggagagcgctgatgggcgaatcaagtgatgtgagttctttctacattgtctagaaacataggattttttttcatgtcagctttatagcaactagaatgcgggcagctactggtttagcaaggccaggaacttgccaagaatatctagacaatggtcctattttaaggtcaatctgcaccgtccctaagctagcataaaagactgttgagttactctgttgagttttagccaagttagacctataaattgggttatttcatcaagctgctggaaattctgtttgaagctcatgggattttgatttactatgttgttactaacagttcttttcaccattcatgacagtttgttgctgacaaaattgcgtacgcactttcccaaggtatcaaggtaattgcttgcattggtgagacccttgaacagagagaagcaggaacaacgatggaagttgttgcagcgcaaactaaagctattgcaggtaatttcacttgctattcttcaagttaatttcttataaagttggaacttcacccctaatgttggaacaactgaataagtgcttccttccttccttatgaagtaccttgtgctgttgataaatccagttcttccaccttgaaagctgttaaacaggaatgctagtttatatttgcagaatagaatactgtgattgcttttaccctgctaaatatccaaaaggtatctgtagcttgtgtacaggtttatgatgataacggtgtggtcaaattattaaatgatctatcatttgaactaggaattatgtcatacaagaaacacatactttactactatgagccttttagttattgaagaaaacacatcctgttttgattagtcacatccattttcgtttcatttgttctttatggcttttgtggtccattgtactgtgctgacatagaagtcttctcatttctccacccctaactttttgtcttttttactcgtcatatttttcagagaagatatccgattggaccaatgttgttttggcatatgaaccagtttgggccattggaaccggcaaggttgcaacccctgctcaggctcaggaggtattccttctaacatagagcaattacatcacgattagcatgttcccttcacatttatctgcctcataaaccaatatgggttttttcctatatctaatgtctttcttgaccgatgcctggtacctgattctgcaattctgttcattcgaattatttgaaatatgcatgacattaggttcatgatggtctgagaaagtggcttgtgactaatgttagtcctgcagttgctgaatcaaccaggattatttacagaggtatacctttataactataggactatgaattgaaatgtaaccaagattttgtttagtagtgatgccaattgctaatgtacaaaactctccccacttccctacgattaacctgatcccttgtcttcgcatatttgtcttctacaggctccgtaaatggagcaaactgcaaagaacttgctgctaaacctgatgttgatggattccttgttggaggagcttcattgaaggtcatattcctattcctttattatcctctccatgatattgatagtagcatgtagaacataagcctagttaaacaaaacaccatttgaccagtacaatccttgtgcggttgtgcctagtagcatgccaaatatttgaatttaactctatacattctcacataacatttcaggctttaccgttgtgtatattactgatgattactttttttttctgcagcctgaatttgtggacatcatcaagtctgctaccgtcaagtcttctgcttagtgttctgggttgcaaccagatgatcgtaggagttaatgctgccaattttaagttatgacatgtttgaccagcttgctttgttatatctcgaagtcagtgaactccatatcgttccatagagcatgcagccacctgtggttgctttttttctttttgactttttctcccgagaggatcagatgaactgaaagtgccgttaatgtctgtattatcagaagtttgttgatggcttgatgctataatagttgaacctgatacttcctgagtgaagtactgtcctttgcatgtttgattgatgattacttgttttcgtagtcaaacgggctatcatgaaggatatactacatgtttgttaagtttgttacttcgtgatttaagcaattgttgattaatgcagaataataaccgggtcattcgcttgttactctattacattgtcatgtaaactagttagtgactgaatccatctgtgacgtactgtcctccctcttcctttcttgaatgtacactcccttaaaagcgttttctgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcagatcagaggatgtgtattctgaatagatcctttactgccagtgcccccttgcattgttccaattctttaagagaaaatcgagcatgatccggcataagttgaacacctttgtgctacggcgtttgtcaatcacagaagccgtacaagctgcggcaatggcccccggccggccactcgacgacgagtttaacttcactggtgagtggtcccctgaggacgcctaagcggcgaacccagaaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcgagttgccggcggcagccggcaggccggcagcggcgtagggtgtaacgccggctcgttcctacttcctccgtttcacaatgtaagtcattctagcatttctcacatatatattgatgttaatatatatatagattcattaacatcataatgttagaatgacttatattgtgaaacggagggagtagaaggcaacatgtcaagaaggcaggaaggcaatcgagggcggcgcggaggacatcgctgaggcagaggcgcagaagagcacgccgtccggggatgctcgtcggtgaggtcaggggctcagggcggcc

SEQ ID NO: 14825 - DNA, 12625 bp, Oryza sativa
accaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaattctctgtctgctttcatttttctctgtctgaggatttcaacttttggattactgcgacactgatccatgctttgttctttaattagttatgtgttgcgcgagctatcgacttcaaaataatatgctttttttttgtgatcgactgatcgccatatacctgtacgtaatgtgagacgaaaccactattcaattttgcagctgacgttgtgatgttgatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaaagatggcggggagcggtgtcctggaggtgcatctcgtcgacgccaagggcctcaccggcaacgacttcctaggtgagataggtgcgtcctacctcgatccgcggccgagcgccgttagaagaagacgaggccgatcgagctcgatctcatccgcgttcttgtcctgtgcaggcaagatagacccgtacgtggtggtgcagtaccggagccaggagcgcaagagcagcgtcgccagaggtcagctaatactgctccgtgcagattactgcaaacttcttggtttttcgtttcagaattcggattattgttagacgaggcattgacgaacgttctgggctctgacctgaaaatgcagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgtgagtgccattatatgctctcaccaaaacaaaaagccaacaaccatggcagctagcttagtcatagcaaacgctaaacactaaagtaattttccagttcttaaaggagatattaaggaggtaccaaatttacactaaaatttttggaatttctcgaggactataaaatttctctgaacactactataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagaacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaaattaaaggtagagttttgagtctgtataaaaatacaatttacaaataactaaaattcgaaattaagaaaaacacgtgaagaagagtttaaagtcaacatagaaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacatatataaaatacaatatgaatatttcacatttgtagtttcgtaaagttattgcaaaatttaaaattatgatgttattttaatatatttgaataatataatgagaaaacatatatgctattatatgagagaaaatataatgatgctagccgtataatctgcgcgggccaccatgctagttaacataacagtagaaaatgcatccaactatacagttatccccaaaagtccgcgtttgaacctgaacatagcaaaggtcctacttaactcaaatgaccagatctgttccttcacctgattgtctcggactcaaaatggatgtacaagttagactactggtacctgttaaaagattcaaaatgtgaccatacccctgaactgtactcgtttggtccaagcaatatggacttcgtagttgtaaactgaagaagatggtctcgaagtggagatcgttgcctcaggtgcataggtaacaagtcacctcttgcatttacatcagaatcaatttcttcataccttcactatagaggaaacgacaggtgcaattctgctccttggcaagaccaaatagcaaagctatgtttcctaggtgcacaaagttgctgcagtagtactgtagtattgtccaaggttctaagttcagatcgtgaggcagtttgcataaacaagggattgcatttttactcatcttaaacttctgtaatctctgtgactgataagatgtcatcacgtggatgggctgcttccacaacgacactaacttcatctcccactttcccagttgaaaccacggctgtagcttggatcccaacctgcgaagtatcaccagaattggaatgtaataccccaatgacgatattgagaaagtgatcctacttcaaggaacccaaatatgccattggagaataattgtgacgaactagtgtagtggcaaagtagtctagtacagcagacatattaattagctgtgactgccagtaatcctatatatctgcaccactagcagcgattagtgctattttctcctgtgtaatgaaaccacatcatctatgttttacacagccggaggtctccatctagtaatacaataagattagctctagtcgtttctagcatgatcactgatcacattgttccatgtccagataaaatttttaccagtctggacaaatttagctgctataaaagttgggagttggtgctggtgggccatctaaccctctttcacctcactaaaaaaaaagccgcagaaagaaaacgttgctcttgttccaacaactccctctcttaaaaatttgaccagagtaccagacatggcatcatagctcacactcacggtgtaggatgagcattgcagggtcggtgcaatgctgacatagggtaaagctcagttgatgcagtggattactatgagattcaaactgtagcaaagcatgtgtattcaaactgttcctttgaatgctaagatatttgaatacttaaaatacaaaataaaacaactattgtcctggctaactgctttgcctggttcaatttgtttatacatgaaccatcaagcaattgacttgcatatgttttaccaagccttatccctattccatgtcatgtagattttgtttaacctgagtcaaggtaaaacctggtttaagataatacaaaagcattgaaatcagctacaaaaatagttttttaaataaaaaaccgtgaataggattgaattatcctaagtcatctgggattggtcatactcgggaataaacaattaaaatgaagtgaatacacaataagatggtttttatactgactaggatttgataaactttcccaagccaggttacactggttttccaagccctgggcaagaccactaatatctacagaggtgctcttgctccaaatacaatcccataaaagcaacaagaatactctcatcttatatatatcaaataaaaatgtactggatgaagcatgtttgtgtacctctataacaagcaaagttgccaaacgatccttaataaacttaagaatcagggctttatacttctttccctttggttgtcttctcaagtattccaacaaccagtaacgtaagttgttgctatggagtctcctggcaactttaacatgcatgcttgcaataaaggtcattccttctaggtcaccagctgaatagggtggagattcacctctaagaaaagcctttatctgcaatttaatacatcttccatcagcactcaaatttaagtagaccataagtacgacgctcggatcaagatacaatgaaactagactgcactcataacataaaacacaaggtgggaaattgataataggaaagctctttgtaaattgtaaccatcatgttcctggaaactgttaaagttctccctattagcaggaataacagaggcatatttacctgataatgagctagcagatcaacatatcttcgaataggggaggtgaactgtacataaccaggaataccgaggacaccatgtggtacaggtttttggaaatccatttctgcagcacggagcacactgatgttggcaaaactcctggcaggcccttcagggagatgagtaaatgctgacacagctgtgttagactggggatgccctctgtatggcaaagcaatattgttgtcagaaccaaaagcagccacggcctccccacagagtatcatcatctcagatacaagctgcattgctgggttggattggtcttcaacatatagattaatgtttggttcaggatcatcaggatttgccaccttgatacgtggttctatcatagcagtatcaatcgaaccctgtgaacttcagagtgtcaattttgtcaaataacaaatgcatcgtagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacaatgtattgataacttttgaatgtttatcactcccagctaggcaagggaatactaggctctttgaatggttcacatggctcctataaataaagtccaatgatatttgaactacacttgagaacatgctggatggtgacattgacaaggaggcaacttccgcttatgacttgctaagtcctgctgatggaggagcacaagtcatttggctctcctggtgcataatagattttctagtcaacacaggctagagtgtttaacattctcttctctacaaatgacccattctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctatacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtcagtaggcacagctgctaaattataaccagtctcttgggatagatgcaatggcagaaggaacagaaacatgcctcatcagcttcatccacatcaatagcatacactttcaaagttgagagatccttcctgatatcctggaaagatgaattgaatgagattttgaattagtatacatcttttaagggaagacagtgagggagaggcttgctgtcagtacaaatcaacttaggctgtgcactatacttgtaaaaaaacaaaaaacaatacaaagggcatcagtatttggtagtagactaatagctgacatattaatttatagttgtacagctaaacttacataaagggaaaaacacaatatgaagaacatcaatatttggtagtaattaaaactaccttgtctgagtcaggacagtctaccagaagttcctctgcagctgacaaaacttcctcagtgtacctgatgcgaacatcatacctgtaaagatcaagattgacatgcacagggaagtatccaatatttataaggatctttagagcagctgatgaagtctttgaaaagcccatagccttgagaatctgcaattacattaataatcacacaggtaaacatcagctacaagggaaaacttaattatttccttcaatgaagaattatgttacactacaaaaacatttggttcaaactttttaaaggacatgatactttatgatggtaaacaaggattatggttattcagtaaaccaacactagtgtaaacaaatatttacttatttattatgcatgacaaaataatagtagtggtatagaatatgttacgtttcctgccgttctcctttgttcatcatcacatgcatcaactgcatatgcctgaagtgactcaatttttcgcttaactttctcctccatcaaccatgaatcttttgaaggtttagcatctagaggcaatgctttggcagacttgattaactggacaaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtaaagcttaatataggaaaaaatacttcccactcagacactagatactaatagaaaaatgacgagaatatgtgaagtcaagcattctttagttgaccatcaagatatttaataaaatatctagattgatcacatcaatttgatattattgtatatgctactcacaatacaatagacttagcagtaactgtggcaccttggagactacatcgattagcaaaacgacctatattttgtgaaagaaagagtgaaaggcaggtaatttagagtgtgtatcgtgagatgaaaatcatgggtatatttaggaaatatacctgagcaggtgggcgaggttggtacacagaagaatcccggctttcgaccttgacaaaatagactatgtcccttgataacaagaagtgtgcacagtagctttccagagactccttgctaccataaactatctgagaaaacaaaagattagagttacatctgaatatggaaatacaagatagaaaatcagatggaataagggagcttctgacctctgcgaactcctctactgttactgatttatcattctcagaaagctccatccaagcacactccaaaacagtagggtcctaaaaaaaaaacaaattatgcacatgtatctatggtgcagatacatatcatgattcgtgcaacacatcttaccaaaagatcttgtgctttcttgataaattcatctattcttgaatgattgtaattgatgataccaggtataacatatgtaacctgctggggttttatagaagacaatataccattctgtacaaatagaatagctatgtcaatgaaagaaatcatagacaaatagacaatgacaaacatatgctaagaaacatactcattatcaatgtttactctattgaatatagacaaaactacagtaattgtttcttttgatacctggtcagtcaccttccagtttttctttccatcgggcctttctacaacagcaagcaaaaatctctcagaatctttctgaaattcaagaagcaggcctttctgcaatgttctcttatctatcttattgtcagacagttcctttgtcccctgcaatcctatcctgaaaaagggattccaacagcaatctttagtatattgtcaaatggttaaatcaaacaattaattattaaaactaaacatctgtatgcaaaattttcagaactagccattaacaccttgtgataagctaaaagaaaggaagaaagaaaaaaaggaaacactcatttatcagaaaaggccagtgcagcagtgtcacactaatatagacatcacaatcacaatatactaaatggttgtaaatttggacaataaatggctgaatatctacaagtatatatgttaacggattttccgcattacagtataaatttcactcaacacatttaccaataaaaaatcgtgcaaacattatttcaccttcccagaagcacattatatagaaacagctccttgagtaaattatttgattacttttgttggtacataaatagttcacagcaacagctcataagaaaactatgctcacctacttgcatcaataaagaatatactatggccactggtcaccgctcaacggtagaaatgtcaattcctaagaagtttatcataaccctatagtctgtttggtttgatactgatgattgccattgtttgtcttaccaacttttggtaccattgactggatttggccagcatttggtttgctaaaagtgttcggaggattccttccattagctccctagttcattccttaccaaactttggcaaggagtgctatggaaaatttggcacaaactaccaaaccaaacacctctggggcttactcactaggcaccaaccgatgaagttttactaaggaatcaaaactcccttgtgcacaatttaatgaggaaatacatgcggattagtaactcagtgtaatgtataacttggtagctactgccaatcagctccaagtgcacacgcatacaccaaccattacaactcaagcatgcaaattatgggttcaaaatgcataggcaattcagtctagagaatgacaagggcgcgttactttgccgaaacccgaccacgcctctgtgatcggagctcctccaggacggagtcgacgaggccatggacctggcgtccccggcatccgccgtacagggagaagtgccagccggcgcgagcggagtccgggcggacggcgcggccgaggggacggaggcggaagaaggcgagcgtcgccgccgccgccgtggagcagccacccgccgcccgcaccgccatgggcgacggcctcatcgaacccgccgccacgaagctgccgccggggaggagagggtttttggcgataagagcctcccgcgagtggaaggcgaggattcaacggtgcatcgagaggttagcaagagggacaaaaatcccacgaccgcaatatgagccgccggtttcgtgtgctggtcccattatggaataagttcaccagagggtacctcaacttaacagcaaaattattttgagatcccttaaccacaacaccagaaatatgtacccctaaattcactcaaactgtttaaaggaggtcccatggaagtatatatgggtggtttcactgacgtggcatcctaggctgtgttcgttacttctggatgggagcaaatccctcccacatagaaaacggggcggtacattaacacgtgattaattaagtattagcaaattatttttttcaaaaatggatcaatgtgattttttaagcaactttcgtatagaaactttttgcaaaaaacacaccgtttagtagtttgaaaagcgtgcgtacaaaatatgagggagagaggttgggaacctaggttgccgaacacactcctagtcatccaaaaatattaaaaaaaatacgggggcccacatgtcagccaccctctcctctcttcttctcctctactcttttctcacttctctctgcttttcttcggtg

SEQ ID NO: 14826 - DNA, 17688 bp, Oryza sativa
  unsure (1)..(17688): unsure at all n locations
ccccgcgtgtcgccgcgcccgctccgccccggccgccacgcgcgctacccattgccggcctccctcaccaaagaagagcagagaagtgagaaaagataagaggagaaaagaggagaggacggctgacatgtgggtcccacatattttttattttttttactgactaggatgccacgtcagcgaaaccacctatatatactgtcatgggacctcttttgaactatttgagtgagtttaggtgtacacatttctggttttgtggttaatggacctcaaaaaatctcgttgtcaagttgagagacctgcggtgaacttattccgttagcttctggaagattcgtgattgggcctcaacgggaaggacgggctgattgggccatatgtgggccgtcactggtaacatttgaatttgctgcgggaattcgagcttgtgtatcgagggtgtgactcgtttgttatacgatctactgcccagattttcgtagaaattgaagtgctctacaaaatggctgtaaagttcaaacgaaaattcactaatcttgatgtaatgtgattgagaaggtccgaattgagttttataccacagtacagagacaaatgcaaaccattggatcctcagggctccatcggtcctgaacctgaactgtggtcaatgctgtaaatttgttcattaattaagtttatgttttccaatgtcaggattaactttcatgtttcagctctcgagctccttgggttccttctaatggcacatgtccccaatagcctcatcggttattcggttaatataatcaagagctgattatatggcacacagctttattagtgattgaaaaataatttaaaaattttatatatatgtgtttttaacgacttaaaaataaatgttaaaagagatattatattaaaaataccataaaatcaattttaaattttaagttttaactgtagctgaatttatttatttggtaaacgatgaggcttcttttgggtggcagccagagcaccgaatcaatctgggatccatggccgttattagcaattaatttgcatccacgggatctggacaacacgtagaccttctagaagataaacatgtgctacgacagctacgtactgtcattgcaaggacgaagacgctttgtgtgtcccctaccgccctgtcagagaattgctatacagaacttgcaatgcgcgaaggctgtaatgcacaatctaaagtagtgaaagaactctaaagataatttcaaacgaagctgcttgattcataaatttgactataaagataattaccaagtgactcaatgaagtgtgcaattaacagtactgttgacgctctttcagcatagcagtataatagtattatctccgtcccaaaataattgtaactctaaattatttagcgtatattaaggtttgagaaagaaaaaagtattgtactctaaatgatgtataggatatagcgaaagaataattatgtagaatactaggaagaaaattaaatgagaagtgattgataggacaattagtactttattgtgacatttattttaggataaatttaaataatagtagaaatacagttaccatgaataagagtgtacaattgagactaattcagttaatcatttttttataaagaaagctttattaatcttagacaattatatcaaagtgatacaattactctaaaatcaattatgacttctgcatagctagaatgcacgctgcctacaataaaaaaataaataaattgcttcaaaattaaaaaggatgacatgacagcaaatattatatcgcagcaaactgcacccaaaagtactttaagctcacgtcgagataatttaggtgcctagtttattctcagtaaaaagttgtcttttttcttttcaaatttggtcctatttggctggggaatagtgtattaccacctccgtaaaaaaaatacaattctaacaatacacctagtattaagggaaaattaatgatgtcataattaaagaacagtgcgaatgcaactgatgtccttgtattatgtcatcaaggcaacatgtcatggtcaaacccaactcttctcccaaactgatcaagaaaattttcgttatctgctcgagctacgtgccccggacaactccgagaccgaagctgcaggaaagccaagtcaaaggcgacatctccaagccccatctaacctcgctcgtggtcaatatgctactttctgctatccccaggaaaaaaaaattgcaaagcaaagcacccttaaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaataattatataaattaaagaggaattttcaaaggcgtgcagtttttctcgtgttaaaattgctgacagtgaagtgttgacggtttgtatcggaccacgtattttacaacaaacttctacggtaacagctagagctagctgtccatgtagatatccaactagccaataagcgccgtgtgtcaattatctgaattataccctatttgtcgtggcatacatggagtgatctgaccaaaaaaaatgccgaaagctagggtgtgtttagttcacaccaaaattagaagtttgattgaaattagaacgatgtgatgaaaaagttgaaagtttgtgtgtgtagaaaagttttgatgtgatggaaaattagaagttcgaagaaaaagtttgaaactaaactcagccctagtagtattaattagctagctttgtctactactccttctgtctcaaaacaaaaaaatgtagagttatatgatacatattttaaaattacatacacatttatagttctagcatatgtcatattcagttaaaggtttttatattttaaagagtaaattacactttggttcatgttttattacctaagttgcacattaggctaggcattagcaaaacttttcactttagacaagattttatcaccaaattttgcaagttggaccagtggcccacgcgtcaaccactgatgtcttcttcctcaatcctcaatcccctacgtgcttccctgctccctcccgattcaatcgaatccactgtgagctcctatggttaatcccttcgagcacgcggacctccactggtgagctctttctagccttacaaactcaccactcatcactgcgccaaagcagacctgcttgagcatataccctgtgccctacatgcagtgaggagtgagaagcccccacatatcccatgattatagctcaagctagccattgccggtaggtaggctccctgacctgagttagcgctagagctcaagatcaaactctaacagagctgaccccgtacgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattgttcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacagatgaagcaatcgtaactgctactgtactagtactatacgtacgattaatgcatactgtacgtgatgatgaatgacacgattgtttatgtccgattgtccatgatcacacataaaaagatcaacttgctatatataaacaccaaaagaagattgccccatgaattaaaaaaaccttaaaaacaaaagaaaagcctgaagcccctccaaaatatagtactaacatcctcatgttgatccgaaaagattcccacctgtcagtgttgttggtcttgtggctcaggtccaatgtaccaagaccttctagaaggaatctatgggggctcgctccacttgcatctgcatgcatgtgacgcagctcgcatggagtatataggagtaaactaacgagtctcaagaaaactaatcatcgccatataccgagattttgagaaaactaatgaacaaccaggtttatttggttatgggatataatcgcttcttaatttgctcaaagcctgcaatctaaccaaactgcgagaaggtctttgccacacctgggacccgtttggttgacaatcataagttgctatcaaactgtcaaactcaaattaagattatgtgctcaaaatctaattagcacaccttagcaagattaagataatcttgtcatcttttcggagtcattagtaatagtatgtactgtctaattcgctagaaggaataaaaatcatgatatttaaacttgattaatcttaggtgtgacaaaatcatgagaaattgcgtccggcaatcaaacagacccttgaccacatcagcctcttgaataaaagtatttcttcttatttattggatttattagactttatcttcttatttgttgaaattgtttagttgcttgtaataaatgatgggagaatggcaaatataccactacttaattttacctcctaacttggaatagccattaaaaaaactgcaaatttaccactagaatagcttccatttaccattgttgtttgatgtgtgcaattaagaggctaaaaataattcataaaacaaatgtgaaaaatcaagggaataataagaccgattccctatctgcctctcttcaaaccctggcagcactcatttgttccctttgcccatcccctcctctcttccttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagccgcaggcgcagcagctaactatggtgatagcagatgagcagcatggactacatcaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcagatagtctaggttcatactgtattttaatggcaatgcaatcacatttttcttaatggcagattcacaataacaattcaaaccaataacaaatatgcaattggcccataaaaaacgaacctagtaccgaatgtaacacatcatagtacttgtccatagtactaggatgtgtcacatccagtactattggttttttatgggatagaggaagtaagggggtgtttgggaaggagagactaaacttcagtgattgagcaaataccacccaagtaattgagcaaataacagaactcgtttcattgtaaaaaaaaaatgcggcggtatgtggtggtaaccactggcactgttccccgggcctcgctcgtggtagacgacggatgccgctcagctgggtgcacgacgtactccacggtgtaattcatgtgccgtttcagatgcgtgagtgcgtgacgccgtgaccccgctcatcctggacgcgtcctgtctgtccttcgtgcgtaataaagtgcgtgtgtccacatgccgacgtggaggaagggccccgcagccccgctgcgacgcaccacgccgtctgctgatgtgtcgctcgcgctgcctcgggccagcgtgcggccggcgtgcgggagcggcgtgtctggctcgggaccaccacgtggggccgtgggggaacttggtggccaaggcaattctgtgtccgtggccttcggtgaacccggcccatgcgccgtatagtataatccacacatgacacagcgcaccgcgccaatcacagtccaggaaccgcgagaatttttttatttttaacttggcgagatttctcgctgacacggtcaatcggccactgcacacgggagtgtacaggaccaagcgggtcaattacggctaatcctaaatacagcgacgacgggcggttcgtgggtactacgtactagtagcatatatccatcttagagtaccatctaaatctatgcttctaatttatagtactctggatattttctcacggtaatcatagaaataaaacgcataaggtaaccaaatataacttaaaacagatgaagtttaaaagtcgcaccaaaaagtccaaactttaggagacatcaccttctgcatccctcgacccttctcttcctcactcaagtctacttttccttttgtgttctgtctgtacatatctaatgctcttgagctgtgttatttcttatggcttcccaacctatctctatcattttttcatatgcacgcttttcaaactgctaaacggcacatgttttgaaaaagtttatataagaaagttgctttaaaaatcatatcaatccatttttcaaatttttatagctaatacttaattaagcacgtgttaatttatcgctctgttttccgtgtggtggggaggggttccaaaagaatacagccaagtgtgtaaagcgatatactcaagtactcaaccctagtacaaaggtatgcgctttacaaattatagaaaagaattaaaacagttgaaatttagaaactccccaaatttaaaatgttcacgttaataaaaaaaacaaattatcaaccctagtataaagatatatacacgctatttgcgtattccagaaataaaattaaaacaactgaaatttagaaactccccaaataaaaaaatgttcatattaataaagaaaatcaaattaccaccatgagttaagaatactactatacttgatgtagatgtagctcgtgcatgcaggcactatatgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagggaacagcgaattgatcatcgaccaaatacttggttatttgctagctactcaaatacactcaatacttgatcacaacgtacgtctacacttgtactcttcgtctacgctcgtctcccgagtttatagtgcagacaactaagtttcaaaaaaaaaaaaaaaccaagttcgtctagaattggcctttcgatgtgtaaaataaatatgcgcatgacctatatacttcaacctgaacgtgtcagaaagaacatagattgaacacgcaagctagtgggtgttaatggcgtgcatatttcatcaaattcagtgaggctatccattttacatttccccgctaaaaaagataagggtatgaatagagttacaaagtctagcattttagcgacccacttactctctcctagaataattagatattttattactaaaaccaaggagaaataaaacttcgaccgtaagctacttggttgcatacatgtacgtgggttgctctcgctattattaacgacacgacgaaattaaatgctgcatgcatgtcctccattcaattaaacaccgcatgtatattttcccattcgtaagatgctcttttttttctccttatacactcatcatccttgtatagacttaaaaaggttaacaattcttaccctaccaatcatctgttagactatttggctctgtaggttgggatcttctactcactcgtttttcacagacacatttctcgaacggttaaatgatatgtgttttgcaaatattttctataggaaagttgttctaaaaattatattagtccattttcaaggttttttttcttcaaatacttgattaattatgggctaccttatttttcgtgcagaagaaataggttgaacacactttcgaacacaaccttaattttgaatagtacctgctacctatatgaattgaaaccaattcttgccaattcgatagagttgaaacaatacaacactaccaaaattttgatagtaccaaaacttatttaaaatttagtgcggcaagtttttgatacaacttcaaaccaaaaacaaccctttctatcaaactgatgccaaatttgatatgtttgcagctgcacgctgctatcacacccatctggctagagtcaccaagctgctcaatcagtcaaaccgtcaaagtatcgaccaccacaacaaacgtccccggtgatgatgtggatcaccacaacaacaaaatacttctggcccaagtcggccagtaatcaacaatccggtctacggacacggtccaccccccgcacccagctctcggcccaggaggccgctcgcgctcgttccacgaaccttccccacggcgcaacccctctccgtgaacccgcccgcatcccacctccgcggccgtggaccaggcgcagggaaggtgtcgacacttcggctgcgcgagcgcatagcctcggttttaatagtcggcgaacggctcgggccaggccaacctgcgcctctcgaaaacactggtccgcctccgttcccctctcctctcggctctcttatctcacccttcgtttcgctcgtctccctcccgccgcagcaggtacgcgacgcgagctctcgtcggctgcgatgttgtgcgtgctgtttacgggtgacgggtcggactagccggcgcgtgggctcgacgaggcgctgctccttcgtcgccgcgggtttctgatttttgttttaattttcgtggtgttttttttggcgcatttgctaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctttctcggatatcgtcctggggtacatcaaccgcatgctcatggccgaggacatcgacgagaagttcgagcactacccggtgaacgccgatgatctgctcgccgccgagaagccgttcctcgagatcctcgccgaccagtcgccgtactcgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattactttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggagaaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcttatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacatccacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgctcccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataatttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataagattataccccaagaatggtcctccgctggagtttgaggcagtattgcctccgtaggtctcttggtccatgtacatgtgtgaacctgtaatgcagagttaccatttatcttggaaatcatccatatcttcaatcaattctctcctagtagtttcaaggcggttcaaaaaaaaaaacaagtgaaatccacatatttatctagtttggaacaaagtgcacaaccatgaaattgagaggttccatccacctgtactattttatttattccctcacctcagattagactcatgctgtaactaaggtatttgacatctacaaatggagcctttcaaagttaatttctactacctgtaaagactgttgtcaggaaaaaaattcaggtttaaaaaaataggaaaaagattcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcggccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatcgtctctgcacctcgtccccttcctcgccagcgccgagcacaaccaacctctgacagtgtggtcattgcgcaaagtgtaagctattcacttcgcgtgaaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14827 - DNA, 983 bp, Oryza sativa
atagcacaagcccggaggtgttggtaacagccagcctcgccgtatgggtggtgattgggttgtcgcggttggcgacccacacataggtgcgctccgggatgttgttgtaccatatgccaaggtagagcaggcttggggttgagttggtggtggtcagggagaagaagccgacagcaaagacgccgccatccgagatgagcttgtcgccgccggggaagatgagtggctttgccggtgttaggcggtcatcggattggcagaaactaatcaagaacatgaagatgactacatgcagtctggtcatattctcttgtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgtaaaagagtggtttcgctggaatgctatcccttcaaactgattcattaaaatgctattctaaattgaaggtgttcaccaaaatgctattttcgtttttttaggtaaatagaaatgttttttctcaattataacttttttccggaccaaaatacccctgatgcgggcccacctgtcatactccctctactctctcctcctcttcatctctctcgagggagcgccggtggttggaagcgagcagtggccgacagcgccgttgaagctcggtgtcgggctgtacgacagcgcccgcgactcgtcaccggcgtacgacggcgcggtgctcggcggctgcgatggcccgccgaggcgccgctgctcgtggtacagcacctgcaccatcctctgcaccggccacataagcatttagtggagtgattaacgaaggatttagccatttttta

SEQ ID NO: 14828 - DNA, 2330 bp, Oryza sativa
  unsure (1)..(2330): unsure at all n locations
tgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccaaaacaaattcggcccaccagtccgcgaccggaactgtgagattcgtgggccgtgaaagtgctcgtgatgggctattgggcctaggtcgattgatctgtggacgaagacgaacgtgcttcgggtacttcgccgccggagtggtggttggccgccgtggggggcggtgaaccgccgacggtcggcaccgcacgtcgaagcgcccggcgtccgcggtctgccgctcccggtggagctcggccaggtggccgaggcgtttcagcctaggagaggaagcgctcggttaagncggtgnacgncgaagtaacggcgcccgtggggcaaggtgccggcgccaccgccaccgcagccggcttagcggaagagacggcgggcttaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatag

SEQ ID NO: 14829 - DNA, 1770 bp, Oryza sativa
tgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgtttttctttccaactgcagaaatgtacacctcagatgttagtgttatggcatggagcataacttggaaagttaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgctgtcaagtgtgaggcgtgtgtagatggagctgtcggagacagtgtatgagtagtagagcttgttccctgagtcgatgagtgtttgatacatgaataagctgctgttactcggatactgggcgccggacaccgtcacgctggttctgacgccgttacggcagtatggcttggtcccgttccaggtcatgccctggaggtccgagctggggtcgaggctgaaggagaaatctccagtggatgggtcatcatggctcctccacgcagtgaggcgtccgatgatctcggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatgtggccttgggagtccgacagca

SEQ ID NO: 14830 - DNA, 12799 bp, Oryza sativa
  unsure (1)..(12799): unsure at all n locations
gctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataattgagtccacaaatttctctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatatgtgtcagacttgacagagaagatgccttccattgcatattcaggagacatgtaaccactgtttgaatcgtgccaccaataacaagaagtgtgggtaatttgaaagtatccaagtatataaaatttagtattttaatcataagtagtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatccccagtccagagcaagcaccttgactgatcggacatggtgtcggctttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccaggacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgtccaaaaggtgtggccttctaaatctgacaatacaaagttagaactattgctgatggcgagcatcgcagatgaaggggcagtgatcggcttgtcacggttggcaatccaaacgtatgtgcgctctgggatgttgttgtaccatatgccgaggaataagctctggttggaagttgctggggagaagaagccgagtgcgaaaaccccgttctgggagacgagcacgtcgccagggtagagtttctttgcttgtgtcagctgatcatcgcacttgcagaatgagaagatgaaaagagggaagcaagccataccattcatttggtcttgttcttagctttgcctagttgcctgcaaagcgtagagaaatagcacacacacatatgggtgtttaattatctgatgcatacatgattctcctgagtcttgactcttgactcttgaggagcacgcggttggaccaaaggaagcagcgtaataacgaatggccgagactattctgtccgtcgagataaagttttgctacgaattcaaactgaactgtggggagactacggtgaagtggcctgacgagagcataagcgtagctggtattagtactcagtgttgtgatgctaacttgtgcagcttgtggctggctggctggctcggtggcaccgggacaacctcgcaactagaaatatcgacgcttgaacgcttgtgcacaacagaaaacttactacaactatttctgtagacgacaacatgaaggttggaggatcaacgatttatgctcaagaacaattgatggagactactgaaggatcaaggaagttgtttgcgttacgcaaggagacgacagggattaccccaagagactttccttcttttttttttttgtaaaccattgaaaatgaaccatacacccacaaagcaatcatattcctaggttcttgcacaattgatcaagtggtgaattctacagccagctaaatctgaaattaaacatctaacgtccttgtagtgtggtaagacttatactgttcacagacttgttggcatcctctcttgcccctcctgccatgcaattccttggcacaaaatatgcaggttgcttaggagtaggaagtgttgtggcttcattctcgagcatggccacaactgatgacatgagtggtctagcatttgggtcttcctgaacgcataacagtcctacatggatacagagcaaaaactcattaagtgaatatatctgcagaataattgagtccacgagatcctctgcctttccattcttccacaagctccatgcctgaaccaagggaacaaagttcctaattagtgcaaaatcctagctattgaaactttatgcattttgatatttcttagaacttacacacttacacaggctataagatttggaaaacccattataagatgaggagagcttatcttagagccgcttataagttccaaaactaaaacaccaaagctgtaggtgtcagacttgacagagaagatgccttccattgcatatcaggagacatgtaaccactatatgaatcatgtcaccaacgagtgtaagttatttaagtgttttccaagtatataaaagttagtattgtaatcataagtagtgcaatagttactcactatgtcccgactacatgtctagtgtttgcttgatgctggttgccaccaaagatccttgtcatgccaaaatctgatattttggggctcatcccctcatccaataaaatgttgctcgctttgagatctctgtgaattattgtcatcctcgaatcttggtggagataaacaagtcctctagctactcctttgattatgttgaaccgtgtttgccagtcaagcatagacttttttgaatcatctaccgtgaacaatataaaacgatacttatagttgttcacacatggccttttggtaacagtcttccaccaaacgtggaaaaagaaaaggtaaaaaaggaatatatgattaggacataccaaaaaggaagtaatccaagcttttgttgggcaagtattcatatatgagaagcttttcctctccgtgaatgcagcaaccaagaagcctgactagatttttgtgctgcaatttggcaataaggaccacttcatttctgaactcttctactccttgtccagaatgcttgctaagccttttaatggccacttctttgttaccgcctagcatgccctgcacaatttaatcactttaatttttattaagaaagttcatcgggatatacacttgttcacacagtatcatggatgtatggtttcacccctgaggttctatatttgattcttaacacaatcatacattcttctcaattatttaacaccaagtttgttggaacaaaatccaataagcatggcaagggcttcccttcaatgggagggaggccaagcttggtcctgtgaggagatgagaggaagaggatgaaggatgagagccctttcctcgaatggttcctgtgtcatctagttcaattctgccagaacaaatacggcccgctaatgcccacaaggacgccaagcccatgttgacaagaacccgatttcaagtcgagatcaatgggttacgggtgtgtcttcttaactcgtttccggtgcgatggctcaaagtttgggtaccgaggaacaaaatcgatggtaaataatcaattttatcatcacaaaaaatgcaattgtatgccacatatgttacggtcctactcctctccaaatatcaattatacatgtttcaccatgtgctcctaaaggaagcacttagcgtgcagaaaaataacataaacacctaccgtccctctaataagctgatgctattttcacctgtttgtctgccttcaaaggccctatgtgcaaaatacacaggctgtataggagctgaaagcgttgtggtctcgttctccaacatggacacaaccgaagacatgagtggtctattatttggattatcttgcacgcacaatagacctatttggatacatagtaaaacttcagttggtgagcaactcttagaaatggatgagtccatcaaatccatcgccctgtcgttcttccacaagttccatgcctgaaacagtggaatcaagtccatataaaattagtacaattaatctgaattgtagagataaagcattccaccatacttacataagctaacaaattggggaagtccgtcagccgaggcaagctaatcttcaggcaacttacaatctctaagagtataacaccaaagctatatgtgtcggatttgactgaaaaggcgccatccattgcatattcaggagacatgtaaccgctgcttaatgatttagcagtaagtaaagattcgagcaaataaacattgtgaacattaatgcatgaatgactcactatgttccaacaactctgttagtatttgcttcatgctggttgcctccaaagattcttgccataccaaaatctgatatcttaggactcatatcaacatccaataagatattgcttggtttgagatctctatgaattacagttaaccttgaatcttggtggagataaagaagtcctctagctactcctttgattatcttgaaccttgttggccaatcaagaacatatttatttgcatgatctataagaatggtaaactatgttattattaagtatgcagccaagtttctttggatcatatgataagtttatgcaatactgtagtatataaatctgaacagtaccaaaaatgaaagcatccaagcttttgtttggcaagtattcgtaaattagcagcttctcatctccgtatatacaataaccaagaagtctaacgaggtttctatgctgcagtttggcaattagaacaacttcatttctgaactcttctgctccttggccagaacccttgctaagccttttaattgcgacttctttgccgtcatctagcattccctgcataatttaatcactttattttttttattaagaaggctgttcatttgtaaatgagtggttttacagttcctaaagactgaagtctgaaaaggtactacagtcttaatgttaatttgaggtacctccatatttgggatggtaaaaatctctctgctaatttatcagtacactgcaggggcattcctacttcctagttccttttttttttgacatgctacttcctagttcctagttcctacagcatactatacggggtcacgagaccctaggtaaaatttcaatctctagttgttttagcctatattaactatattattagttaaaaattatagtattatatatgttagtttttgtccctattgtaattctcaagatagaacttattttgtaccttgtaaaccttcccgaagcccccttgtccgagcatgttgtcatcagaaaaattgtttgtggcagcagcaatttctccaaaactaacaaacgggagctctaaattttcatctccaagttcatttgatgcactcaagtatcctagaatccctctcttctggacaaccttattctgatgacgtttgcctgacaggactacaaatatatatagtgtgttaatattagctctagtaggagtagaggatataagctgcgagtattacctctgcacttgtataaccatacaaggaatatgctcatcagcagaagcaaacatgctgctgtaagtgggagcataatttttaccacagtcctcttcttattgttaactgaatgggaagaaaattttcaccgagaaaaccataaagtaattaattgctgaacccattagtttcaggcaaatgaatgcacatgcgtgcaattttgtgatagtcatgtgtacctagttcagactttgccaatctcacatgcaagtcctgccctttgtccacataacgaacatcaaccatgtcgccgatccacatgacgcagccgcggccgctgatgtccgcggcggcgtaggcgacgcaggaacagttggccaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttccttcggcacccaccggaggtatccctcatggaccaccgcgagggggacaccgggctgaaccccgccatgcagctgcagaagagcgtcgacgcggtgtcctcgttgcacagcccgaacgcgccgcacttggcgtagtcgtcgcacacgccgcgcggtgccttcatgtacgggatccacaccttgctgctgggatcccacacgaggcgctcggtcacgccggcctcgtccagcacgaggcgggagaagggggagccggcggcggcggcggcggtgaaaacgtaagcgatctcgtcgggcgtgaccaccacctggctcgagaagatggattcgtacgacgccatctcgggacgccgttgaaccactgcccgttccatggccccgtccggtacttcttggcgccgccgcaccacgtgacgcagtccgggagccccctcgtgtccagcacgcggcggcagtctcccgtcgccgggtcgtcgtgcgcgcgccacgacgagaggaaccacgcgtcgccggtctgccggttgttgccgagcctcatgccggcgatcagtgtgttcgacgggtgatcgaacgactgccagatgaagacaccggtgttcagctggtcgcgctcgcgcacgacgaggtttccggactccagcagctgcgccgccgtcgctgatgaagacttgccagtcgtgttcgacgaccaggcggccctgccggagccgtcgagtaggacgagcccgcccgcgccattgttaaccagtacgccggcggtgtcgttcagtgggctgtcacggttggccacccagacggcgtccgcggactcggagaaccatatcgcgaggtatctcctgtttggcaagccgagtgagaagaagcccagagtgaaggagccaccggccgacacgagcgtgttgccgtcagtgaggttgcggccattgctcagagtgtccgatgcaacgccggcggcagatgttccgagagtaaggaggaccatgaagaagaaggtgaggctaaggtggaaaatgttggcggttgctgcttccataacgggtgagtttttcttgcacgtccttgcccagaattgttcacggactacagtgcacgggaacaggttggcctcacaagtatcatacatacacggaatctagtgcccgtgtaggaggaattcaaacgcgttctaacttccaacacagtaattaatatcccacgattgactagctagctagatgcatgagtccatacggataagttgcaaagcagcggaaactgtagagaagaaagatgcatgagtccatacggataagttgcaaagcagcggagtttattgcatgtcagttagatagttatgaaaaatttttaaaaaaattgacaagatagatcaatatgtattatatcactccataaacatacaagtttaaattcaacttctacaagctgtaacaaaaataacaaatttaattgtaaatatatatgtaataatttgagttttgtttgttatttttgttacaatttgtagaagttgaattttatcttgcatgtttgtggattgatatattacatattgatctatcttgttcatatttttttaatttttttcataaccatttagatgacatgcaataaacatccattcgagctgttaaaacagttttccctatttaacgccttggaaagtgcgcccatggtaatttgattctgaatataacgtactagccaagttactatgatagtgcacacatttaagggtgttcaaactactcacaaaatcaaccttttcaaaagttggtaataccaaaactttgataagttgacaatattattaaattttcatatgcattaccaatgttccgtaacaaactaaatgaatccatatatttatcgaatttacctgatatgaattaaaatggcatcaatataaataaacccttacacgtatgattggtttcaaagtttatagtatatttatgtattatctctacttaatttgtttttcaacctcaaatggaaaatctgattatttgatggaaactgtggctttcctggtgtcagccgatcatcagttcggcgaccgagaccagccgcaggagatgagaaaagtagaccataatgaaccttaggatttctgattcgtttgattgtcacgactcatgagtcaaattatatcataaattcataatgcagatatgaaactgacttgtgtagttagagtttaattccattgctatcaacacctttggggattggaagaaatgaagctgtttaagtcttgattcagaccaatggaaatagacggtgaagggactagtcgaaagctgaatatctcatggccagttcaactgatcatgataaagttttctttttttaaaaaaaaaaactggtcatgatacttccaagtcttgtgacaacgctgcacgaaaaaagaacgccatgaccacgaatttaggttggactttggagggagcgggcagagcaggcgaaagccaaacctcgcgtctgtcccatggcgtggcgggttctcctaccagcgttgggtagtacttcctccgtattaggttacacaagtcgtttaaatttgttgtcaaaattaaactatttcaaatttaattaagctcatagaaaaaaatagaaacattttcaacccaagacaaaatatattatgaaaagatattcaattatcgatttgacgaatcgaatttggtgtcgtaaatattatactatatttgtctacaaacttatttaatcttgaagcagcttgactttgatcaaagtcaaaacgatttataatctggatggagtagtaagggcatgctcaatgtataaggtctacttggataataaggtaggacccggtattagttatagtgtttgctacaatgtatatgataagagaagacattagcctgggtcccactggtcccactcaattgcatggcatgtgagagagaagatgagagagagaagagaaagtattgctattttattcttatgggtgggcattatgcatatgggtagctcatgttaaagactactatatggactactatcacaatgttgtcatggttatggataccacatacctaataatagttgactaaatctcggcatgacccaccacataccatgtcctatacggaaaccgacttcagatatggagggagttccggataaggaaagacaactagagttctacatggaaacgacaaggactactcggattgtatccatattggtttccctagttctacttggacaagaggacacctatgggtataaatacaagcccccctaggaggacaggggggacacccaccatgagacgatcaacacgatcaccacgatcgggacgaccacctcatcaacgcccaacacaatccacatacaagcctatatacgccaagacacgctgccggatatcgacttcagggataggcatggctattcccctacggtatctccggataccgtcaggagatacgaaagcgctatctctgatctcgccgggcacggattcgaggaggaagactaccttgttgtcgactatgagtcagactttcagaccaacatgtcgataacagttagataggctgcccacatattgtactggtgtgattatggtgaataagagcaataccggcttcggccaacaggatgtagggttattacctgacaactcaggggcccgaacctgtataaaaatccctgtctccatctcttttacctcagtctcgcatatatcctagcaccaacgatccccatactgtccaaataccgtagtcgagacatcaaacgtcgacagtggcacgccaggtagggggattttggtgctctaggatttcgacgagatgggttcaaacgatggattctccgacaacaagttactcgacaacttcggctctgggagatccaacctgtccaaatacatcttccgacgagatcagaatcatcaccatcgactattcgatcaggcgagatcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14831 - DNA, 639 bp, Oryza sativa
agaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttaca

SEQ ID NO: 14832 - DNA, 6259 bp, Oryza sativa
  unsure (1)..(6259): unsure at all n locations
tatattgcgcaataattaattaaggactttttctttattagtgaaaacacagtaaatcttctaaaattcataactaattcatccgagctccgtttaagtccattcaagtctcagtaaatcaagaaaaatgtgtagaatccattaaaaatggttttgtttcctgtttcagtagtcttatagcatgttttgcttgtgtgctttgtttgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctatggtttggtaaaagtttatttggagtttatttgacagtcagttgggaatttatcgggtgatatgcattaggtcgtgtctatgttcgatggggcaattttatgcgcatcattttccatgcaacangtttatgcattaagctatggtttagtcagtcgcattagtgtctttatccgggtttcatgaaaatgttctatgcataaaaatcatcatgctcggcgaagtacttagtcatttgttgctttatttaatttggtttgagcatgtgttggttcctatccctctgtactctttagatgtcagacctgttcttcgatcgcaagcgccgctccaagcttcagagtcgccgcccttagctttatccgcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgatttcttcctttctcttatttctacctatcccctccagatggtgaagacaaggaatgatccccgtgactccagcgacgccaggggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgcccctgaggacgtgcgcaccgatgctgagaagcaggagaagtttttgtttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgattacaacggtggcagtcacaacaacagtaagcagcgcaaccacaactcgactccacccccactaatggcaccagctcagtcagatccgccaactgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggggaagatcacctttcgttccccagcgtcgcagaagtccgtagcgagtctgaatcaggctgctattgagggtcagacagaaacagtggagaaaagtcccacgaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaggggggttttttttttaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatataccgaagtcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagaaatagccgaattcgtcgcactctgcgatgtttgtcagcgagtcaaagcagagcatcagaggcccgcaggactgctacaaccccttcagatcccggaatggaaatgggaagaaatcggaatggatttcataacaggtttgcccagaacgtcgtcggggcacgattcaatctgggtggtcgtggatcgactcaccaaagttgctcattttattccagtacacactacctatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataa

SEQ ID NO: 14833 - DNA, 471 bp, Oryza sativa
tcctgcagccccacccgcgagctccgccgcgtccggttcaggcaagccactccacagtccacacacacatcccgaaaacgctaacacgtcaccaataccggcagatcacgctggattttcctcgtgttcgcgtggaatttttaacacttctctctgtgcgcaacgttgcagccgcgagagatttggcgaggagcgggccaaggtgtggtgggagcagaaccgggaccggatacacgcgcagtatctgtgagctaacgcgagacccatcgttgatgagagtgaagtgatactgtgacagaagctaacgcgtcgccgggaagaatagttaagagtgtgatgatactactactttgccgctgctacggttagtgctactaggttttttttacagggtgaatataggatgagggggaaggatgctgtggtctgagaagcagcaggctcagtcaagctgctactcttgttaactga

SEQ ID NO: 14834 - DNA, 222 bp, Oryza sativa
gtgtcgccgccgcacaacgacgtcgcccaggtcggcaggctcatggagagctacctcgccgagatcgcctccgacgagaacctgtccattgactagttcaccgccctcgccgagctcatcccggagcacgccaggttcaacgaggacggcatgtaccacgccatcgacatctacttgaaggttagaagctgccattcacatcgatcactaaaaaatggctaa

SEQ ID NO: 14835 - DNA, 2096 bp, Oryza sativa
actgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtatgcaggtatatccgaacttatcaatgtagaggcatggcgggtacccttatgggtttcatccaacaatccttatcttgatctgtaaaaggggtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcctttattacacgaatacaaggcactgccttaaacaaaaaggaaaggtgcttatcattggtacattgtatcctcaacatgaatcatccttaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgc

SEQ ID NO: 14836 - DNA, 4521 bp, Oryza sativa
ccaatgaacatctcgcacagatgcgcgaagatggccaatgtcatcaccgcgttgggggtgaggtgcgccatctggagatcgtagaactccagaacatccatgaagaaagaagaaaatagcggagccagccctgccattgcaaaagggagaaagaagacggaccgccccgggtagtctgtgtcgcgaccgggaaaattgccttttcccgaacgccagtgtattaatccccgtcccaggaaaagccggggtacaccacacaaacatggtataaaagacacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggctcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgaggaaggcgatgacaggtgggccccacccgtcagcgagggtggcgggcgggcccgcctgtcagcggcgtgcgcgcgggggaggggccgagtgggccgcggggaggagagagagggaaagagcgaggtgggccgagccggcccaagagaggaagggggggaaagaagacttcttttagggtttttctttttataaacctttttaactttgtttatttcttaataattattatttgtgctctgaaaattccactaaaatttgagggctctttttaggccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaaatcctttttcttttttctttttctttttttttctctttttcctcctttctttcggatgggccggcggcccatcttctcctttactccccctcctccctgctgggccggccgcaggccga

SEQ ID NO: 14837 - DNA, 31109 bp, Oryza sativa
tctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagacggttcccacctgtcaccaggccttagaagtgggtcacgcccgaccgcttcccttaaggagggcgatcggcctggcataacgccgggggctactgtcggtgacatgggatcgggagtatcatgactagagggttgaggcatacacaaatcgcccacgtggcctggcaccccggggggacgtcgggcccgagggtgatgtgttcgccctcctcttagtccccccgagggggtcgggctgcacccccctcggccccgagggcggaggcgccccgacccctcgtgggttttcgctccgcgtgtatgggttaggtgagcccagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctgatcagatatatgccaggcttcatcctaaccattacaggcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatgcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctctccggcggaggcggcggtggcggtggaggcgaggtgaaacggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgctttaattgtggcatcgacgtgagagccaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgttgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgttgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccacggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctgcccgtcgtggtggtggtggtgccggtggtgtgccccgccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaccgtgtacatcgacggcgtcggcaacccggagcagcgcatcgacctgtggttggaccccaccggcgacttccacacatacgccgtgctttgaaacccaagccaggtcgttttcctagtggacgacacccccatccgcgtctacgagaacaagaacgccaccgccgcggtcaagggccaccaccgccacgccgccgccgccaatggcaccagcaacgccacatcggggcgggcgtccgtgccgccgttcccgtcgccgcagcagatgtcggtgtacagctccatctggagcgcggacgactgggctacgcagggcgggcgggtgaagacggactggtcgcacgcgccgttcgtggccacgttccgcgacgtccgcgtcgagggttgcgcgtggccggcgaacgccacggactcggacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgccggtaaccctttccatataactcgaccagtaaaataaagggaattgctaactggctacctgctgatctaccctataattcaccaacttgttttactcatctttcactcttacactcttacattcatcactcaacggttgagatcatccctgtgaaatccaacgctccatgtcatctccacctcccacctcgcaccataaccccaacccgactcccgtcttccacgcgattcttcctcccctttccttcccgtcttccacgctacagattgcgcctcctcaattcctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccggccgcagtcacaacaggaggatcacgaatgcaaagattggacctgaaatcagtgaacaactgcacaagcagccccttggtcatgatatcggtgaactgatgggacgacggtacatggagcacatggacctgtcttagagccaccttctcccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggtggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttggacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtagccgaaggcctgggttcattttaggaaggaaggcccagcagcccagtacatgacaaccatgtgcacagacctagagtttgagacaatacaaaacaaaacatgggagggcgtcatttgccaaacatagtaccacctcggaagtcttcaagaaatgaatctagcttaaaatgcaaaacctttgaccgctaagcacgaccttacttgaacaggatctgttctataggctcgtaccgttgcatccttgactaataaggaggcaagcactcaagcttggttgatgacgcatgacctgtgggccagagcgtgattgacggcccggatcatttccgtgtgaattgatcccgcggctgtagaggatcgttccttgccgggctttcgcttggtcagggttggcccataggttgtctgacaggcatcattttttttttcagttatcttcaccactccattaattaggccgttttttcaatatttaggagaagcctgaattactaacagtaaaatctttgacaagcccaagtcatccgcatgacaatccaaacagtaatttgtagatttttgtaatcatagtgtgttattatccttcatcaattgatacttctgctgctcacattgatcattcatcaattgatacttctgctgctcacattgatcatttggactacctcgtaataaatggaaatccaagttcatgctacggagcattggactgataattaaggtgttttagtcacatcatgcatatacacaacaaatctgaggtacaagatctcaacaacgtactccctccgtctaaaaaagacaaatcctaactagtgaaattaagtgagcatacatagtggtactactaaggctatgtttagatttgacataccacatcgaatatacggacgcatatttaaagtattaaatgtagtataataacaaaataaattacagaattcgccccgagatgaatttattaagtctaataaatcaatcattagcaaatgtttattgtagcaccacattattaaatcatggcgcgattaggcttaaaagattcgtttcgtaatttacacacaatctatgtgattaattattttttcgtttatatttaatactctaagcatgtatccaaacattcgatgtgacattgtgtaaaattttatcaaagggattgccctgaagactgctatgcaggtccagacttggacgaaattaaattacagcatctttcatgattatgtcaaggccctgatcacatcagctgggtcctcagaaacataaacccccatgttaaattgcattatcatcagtttgggcacggatcagtacgacagtacactattggatacaatttccatctactaatgtttacaggtggagtttttaaccacgtgatggctatgtgaaggagtaagataaactgtaggagaaaagcatttcgtagtgggccatgaagcctttcaggacatgtattgcagtatgggccggcccattacgcaattggaggacaacaaagactagtattagtaccacctcggctatccacatagatcaaagctggtttaaaagagttgtgcagatgatccatggcacgaccttacttgaacaggatctgttctataggctcgtaccgttgcatccttgactaataaggaggcaagcactcaagcttggttgatgacgcatgacctgtgggccagagcgtgattaacggccggatcatgtcactggctgattcgatcccacggctgtagaggatcgttccttgccgggcctcgcttggccaggatggctctcaggttgtctgacaggctcccaattttttttttcgttttgcattgagttttctccgtcgcatgtttgcagcgtgttcaaaaagttcgcagctgtatttcacttatttacggcgccacattttcatgccgtttgtgccaactatcccgagctagtgaatacagcttagcttcacacaacaccggtgacccgctgacctgctcgtacctcgtaccgtcgtacggcacagcattgctggaattaagggtgtgatcgatactgcttgctgctgcagcaaccgtggctgcaagagctaaaaatggctgcagcggcagcagctgaaaaacagccacagccatagcggcagcagcagatagcagttccgatcaggccctaaatccaagtcctagctaaacaggatgctccattgaacagccaaaccggcctcacatggtctatccaaggacctgccagttagccacgaaatatttcgtgaaaagccagctgaaggctgaagccctttttgcactgaaatgagtatgcgtgcgggcctgatgatccgtggcattgttgctgcggggacatccatgcactgcagggtaatggaggagctgattgagccatatgtctcgctgcaaaggcttcctcctttcggtggttagcccagagcctctcccagagatcgacccagaccagcatgcagtaatcgaatcccgttcgatgattcgatctactaaattcgcaaaggctgtagcgcgcacatggcgccaacaggcaacagtccgggccatttcgccatgccccgggggatccctctgacgcctcacttgagattccttgaaagttgcgaacacatttgtggttttatcttcacttgtgaaagaagacgtgtcatcgtatgatctctactttcttttcaagaaagtcttctgggtgatcttatgagcactctgactatctgaacgctgcctaataattcacataaagctcgggcgccagttcacagttttcatacctggactactgctactgtgttagtgcagtagtgctatagctaatgatatggggcatccaattagttgggtcctcacctggtcggtccatacatgaacctgacgcccccgtgctgtgctggcttctacgttttcatcaccgaaaatattgcagtcccacacgctctctaggttaaggagcaactggcggcttggtgcatatacagtagtactcttgatcagtgaagacctaggtaacagggtactatagcaggttcctgtgcacaatgatgtgaagcaaaatataaatgcttaatttgtcaacattgtatacaacgcgcgtcaaaggaatcatttcaagaatgatcccatcttctgatgtagtggtgtccaaggctccatatacagctgccccagtgtataatgcatggaaagtacagaactatgtacatcttattgtgcaggaactcgtcacgaaacgcaatcatatatacagtaaaacatttttttttgtgtgtggaagtgccctttctgtgatcatgctgctggtagtgcccaataagctaagcaccaccaagtatattcccattgtcagtagtcaccagggcattcatcaagtcggttgatatatattgtcaggtagggacatcggagctagctagcagcttggccccggccgccggcgaccatcacggccgggatgatccgacgccatcccggctacttttcacagatcatcgcatgcttgccatggacgacaatgcagagaaaatactcttacctgttgctaattaaacgtctaagtcaaacacagaaactgaaaacgaatgtacactaagttttgcctaattagttcttgttgcgatctacgcaatggtttcgtcagcgacgaggaaagaatgcacacaggaaactgatgcaataatccgaaggtgactcgacaagaaattttttttcgcaggacaaaaggaaaaggagagttgtgaaaacgatcgaagtagccgggggtcaaaaagggtttgacccgcccacccaggctatgaatgcgatagacactggcttgacaggcccatcagctggcccggtatacctaacacaatcacgatggggggttggtgggcccagccggtcagcgagacagatagcgaatccgcgggcctttgggctttcgtcagagcccacctgaactgttggcatgtgcagcagttttcggggtccatcgagtgttgactctgctgaagaaagggtaacaaaacagatggagagttttccttggtttcacatacacagagtgagtacatcattaaagtaagtgaattcacaacatagaaatgcattcaattattcatcacaaaacctgttgttttattgcctttaattatggacaggatagtgtttgtttgtttatgacgtaacgggcgcgcaccagtatatattgtcactagacagtgggttttgttaggtaagtagtactgagaatgtagcctcatcattaagagttcaagatcattaacacggcgtacacttgttttgtctcaatagcatgtgttcccactgtgatgagatcagtctcgtgaacaatcccgtgcatatatgggttattaaaagcatcatcagacgtatggttgacctcttgcttggttgggttatctgtccactgtcctaaccacgtgtgttaggcgcagagatcacaaacttgctagatcgatctcacgtacgggcacactacattaccatacagttacgccgaaattaaaacaagatgccagatcactcacccaacttagctaagctccaatcgatccgtgcccaacccaaccgttccggcagctgtcgggacaaactgagtagactccgagcgtgtcgatctaattctaaagtcagagcacactttgacgaacaggttgacccactgcgacccaggaatcaaacagctagtaggaaactagcatttgtctcagcctaatagcccaaagatgccctcgtgtgtcctactgtccttagcccggccgtgtcaacgcccagcctaaaccggccaacacgtcaacgatccgtgtcgcagagcgtgtgcttttcctgacgcgacggatgccggcgctactgctacttcctacccctccgaaaccgacgccgcggccgggttgggtttgggtcttgggtcagcgtcgacgtcgtcgctggcctcgtcggtttcggaggcacgtgttacaggccgggaaccctcgatcgatcgcgcggccgcgcgcacgcacgcgcgtctggtttgctccgcgatgttgcggtgcgcactagccagcggaggactcgtcgcgtgtacaggttgccgtggcgatcgagcgcgcggcgtgcgtgtccacgtacgtacgccgccccgcgcgcacgcgcacgccgccgtgtttcgcacaccggcagccggaccattctagccggcgcgcgggcgcgagcgagcgagcggcaggtcggtcggtttcgggagacctcgtgccctgggtggcacggcagtggcaggggggacagcgtagcgtagcgtagcttgccatctacgactggacgactccaccaacaaaacattagactctataaatta

SEQ ID NO: 14838 - DNA, 5013 bp, Oryza sativa
ataagtaagtgttcgcaagaggaaattgattgcacgcttctaacacaaaccatgcacgagcatgataataatactatatatttgtagttatgggtcaagctaccatcccaccttgtgctaataaccaatccttcaacgaaaacgcatccaagagatcgatcgagattactactactactactgctgtcatcatctccaggttctgcaaagtgcgaattaccggtgaagtatcactactactcgatcaagtcaggcaggcaggggaggaggaaagagatcaacctctgaacataaactagtaatttcacctctgaaaaaaacacccccagcactcgataggggaaaaaaaacggaatgaatcgaaagttgacctccattccaaaccccaatcattccgatcgggcggtcaaagcttcgtcgatacgtggcagcgacgtcgctggcccccggccacggggagggagggacacggcgtggtgtgtcgctggacgccgcgattcagatttcagaggaggatgctgtccctgtcccgccttttgactcggcgttccgatcgatcgatcggtcgatcggctaagcgagtagtagcagcagcagtggagtgccgtgcgttgttcagagttgcaggtgcatgcgtgcgtgcgtgtgtgcgcgagagagaatgagaacgggtggcgtttgtggtgtgtggcttggcaaggcgggatggagggtgagtgggcggctggctttttccgggcacgcgtgcgacccaatcgggccccgcgcttttgacgccttcgccgccgcagtcataagcgtgacgtcaacgcccggggtcttcattcttcaatcgcttaaactggctactatggctaactaattgcctaagctgtaccgccggtccgccgcccgccgtgtgttgtagcctaggccggccaccgtctgtctagaaaagattctaagattctgtttgaaacatatatattatcatcttttacaatattccaagattttgtttgaaacagattgtcgagtaaattattacgacagattatctatttaattgtaaacatatgttaagtattttgataaatatgtaatttaaaacatatgggcaaagcaatgcattaaaaaatttattccgtagtaaattacaggggtatcatctaagtaatattagctgattatattgacatcgcatgtctattattatcagtcacaaatcgacgagcctagacgactgcataggatcactggccttagttatggtgtagcagaaagtaacttttctttcgcgaatgctcattgcatgtcaatatattagaagagtttttgttatacaactcaatcagtcagacatgcctatggggggagggagaaaaaaacaaaagctacaaccaggtaaaggaaagaaaaaaaaactactacggaaaaggctactccgatcagcgggagggtggaggcagaaccataccacactcctaataagcccccaaaagcagcaacaccagcagaagaccacatacgagtatacgaccctccgagaggatagactccagaactactgagaccgaggagagcgcagagtcgaataccctagagttccactccttccatagctaccaagagacgagaaggaccggggagtcgaagttggcgcgaagatgcttagataagcagaccctagaagacagccactagacctgaagcgagctgtcacggggggagggcaacctagccagagggcgacaacatgtggtgctagatctgtcgagcgaatacacagttgaagagggtgtggttcgccatctcaagattctgtgtgcaaaaggggcaggctgagtgctatcaatatcacgcttctggagaagatcagccgtccagcaacgctgctaaaatgcaaaccagatgaagaatttacgtttaaggagaaagtacattaattatatatctgctgagtactctaaattaccaactagtactcaattatgacttatgcccttgccttcatttcaaaattttaatagtactagcgccgtgtttagttccgaaatatttcttcaaacttccaattttttcatcacatcaaaacttttctacacacataaacttctaacttttctgtcacatcgtttcaatttcaaccaaactttcaattttggcgtgaactcacagctagaacaataaccagtctcttcattcagaggatctctctatgtactacggcgaatacgatggtttcctgaccataagtagaagaataatgtgttgactatgcatgatgggcggatgcacgcttaatttggccatattgcaccgtgccatgcatctaacgtcctgattggatgtatatgtgtgccaggagcgagcggcgaggaaaaacaaaaacgtcgaagagtacaaatacgcattgactgtcgacctgcaggtctgaactctgagagagaatataatacatggacaaaaatccaaaaaggagaaaggcagaatcataagaatccaagacaaatcgccggccgatgcatgcctaacgcgacatgaggggttcttgttcctctatcacaatctgcttttccaaacgaaactgatatgagtacgtatgagattaatttacttctcattaagtttgtaatttgcgaagttatatgctacgactgtacttgggacagaggtgtattgttctttgatttattttgatctgtcactcttctatcttcacttcttacacacatacgcatgttttcaggcaactaatacactactagagaattaatctttgttggatcgctaaaaaacggttcgaataagaaccgggactaagattatctttatagtccctgttaaaaagctgaagggaattttttgatcttagtcctggttgataacatttttagttccggtttaaaaagtcatcaggccttactatctttagtcccaccaaccggaactaaagattaacatttagtcccggttatttataccaaccaggaccaaagattgaaaaaaaaattcaaccgcacactcctcggtggaagggaggcggtgcccgggcgggcaggtggaagggagggtggcataagcggcggccgagcgggcggaggggtcgtcggcaacgctgatgtcgatgtgcggattgttggttttgtgatgtgtggacttgtgttgtttgttgagcatgtgaattagtaatgtcaatgttctatgaattcgtgtagtcattttgatccgtgaattttgtgatgttggtgagtttagctgtgaatttgtgacgttggtgagttcggcgtgaaatcaatatgctgacaacaaaaatacaatgaaaaaaaaggaaaaaaaactttagttccggtttgtaacaccaataggtactaaagatttatctttaaacccagttatttgaatcgggactaaaaatggacatctttaattccggattgggcatcccggtaacatatccaggattaaaaggtgtttcgaactgggagtgacgtgggtttctccagtagtgataggagataatctcaacttgtatatatggatgtgactctgtgagaagtgcgcgagattcacagtcacattttttatttttaaaacttgtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcttggtacaggccgggaattaggtgccgcagctcattacccctttacggttaggtgatatcatcaaacattccctctaatcgttctaatttttatttgtttctgttgctatcgctaagacttcttttgagaggtcaatgcctttgattacatagaatttattcgctagtctttcactgcttgttttatttgcagaaggataataagacattaatttaaactgattcgacatatttatcctgattctatcgtgaaaagcatgcatgcatattgctatcaattaatcaattattgaagtgatattaatattgtgtaccccccaaaaaaaataaatataagagaatctcaaaattgctgacaaatggcatgtctagctagtactagtgtgtgctaccactactggaacatcgtaaaataaaaaaaagaaagaaatggaggtaggaatttctagacatagcacaacagtatagctagatgtgatatgtttggcacaaataaagggaattttcttttttgtctaatctccttttaattaattccaaaggaataatataatctatattcctatatgagttacactgcacacatccaccccccctacatttcttacagatgctctttctgaggaacgacaattatgatccaactaattaattaccagacaaaaaacaaagctggtacattttttttacagtagtacacaagcagctagggctataggtgtccaaacgggcgggcacggcccggcccggcacgggcacggttccggcacggcccgtttcagcacggcccgttaggcacggctgatgaaacgggccgtgccgtgccggcccacgtgccgagccgccggcccaagcacggcccgtggatgtccgggccgtgcccgtgccggcacggcacgcacacgggccacgggccgttcggggcacggcggcccgtaaaggcaggccgc

SEQ ID NO: 14839 - DNA, 3235 bp, Oryza sativa
atgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacatctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccatcggcccaagcacggcacggctactcgtgccgtgccggcacggcccgttactgtagcaggccgtgccgggccgtgcctgctacaggttcggccgtgccccgggccgcccgtttggcccggcccatttggccacctct

SEQ ID NO: 14840 - DNA, 4245 bp, Oryza sativa
agaaagagaggagaagctagggtttcggcggccgcccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaacgggcatttctaaatggagatttggaggaaaaagtatacatggcacaaccgaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagct

SEQ ID NO: 14841 - DNA, 5516 bp, Oryza sativa
  unsure (1)..(5516): unsure at all n locations
gaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgagggggacaacatcgttttcagtattgcagaaatccgagggctctaccgtactncaagaagcatcatcgtacatctcgtccagcgtcctgttcttgactcgaaacctttncngcgagcttctncgacgagaggcggatccctcgcttcttcgggaagtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctctccgccgccgccgccgccgccgccggcggcggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagacggcgaccgcctcgtcgaagctgcctttctcctccaagtcggcgcggaagaccgccaggggaccaagtgcgtgcaagttcttaaagtgggagttcttctccatgttttctgcgactcaaaattgcaatgtgtagcagcagtttcagaggctaaaaccaaattcctttttaaaaaaaaaaagaaaagaaaacgaggtttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcanctacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagctttcaccatttctaatctctcctctttcgtaagctttctctttatgtgagcctacataaaggaagatgttcatataagcaaagtgtgaatgtgtgtgcatgagcgcgctggcacgagtgcaatgcgggagggaaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgtttgtttttgacttatcatcctggtcactgtcatcatcctgatcagagccttcatcagaatcatccaatttctcactgagttcctcatcatcatcagattcagatacatcattctcctcatccatatcagagtccaattctagttcatcatcattttcttcactatcattgtcagagatgtcttgatcctcatctagttcctatgtatcatcttcatccccagatagttgatcttcctctttcataccttcatctgtgtcaagcttgagtattctatagtgtcac

SEQ ID NO: 14842 - DNA, 757 bp, Oryza sativa
gcagcccatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattcttctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaaca

SEQ ID NO: 14843 - DNA, 3878 bp, Oryza sativa
acgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttaccctttttccagagaaaattgaacttttttttatcacaccaatgctcttcaaaagaaattcaacgcaccacatgtccaatacaattctggttctgttgagggtgttgaaatttcaaatagcatgagtaaaaccatagcttttaacccccaaaacgaactttttaccaagattcatggttggtatacagagtcaaaattcaacagaaatgctcttcaaaagaatttcagtgccaaaaagtagagggagatatgtcaaatagttgattttcacccaatccattaatatttgtactgcacgaatacaattctatttgaaccctttatttcttagaactgagtgaaccatcatgtgtatctgtcatggaatttgattcaagtttcacttgtatgagagctacaaccatacatgttattctccttagtgaaatggtaaaccaaatgcgacgaactcctgtaaagctagcagacaagaacaattcaacatcatgcgcaaaaacacaataatagaattcagtccttactgaaccactatgtacatctagaagatatatattataaaaatatataaaagtttggtcaatcaataaggagcattaccctttttctctttatttaccaaaacatttagaaatccatgagctagacatctgcattgcatccaccatctgcctccccggtttgcctttgccctgtattgtcagctcagagactcacatagctgcattggttctctgcatgctcaattctgttagaacatttttacatgactagccaccagaatgcacaatatggccggcttgcgagagtacctgacagtgacaaaagaaggctacactgcaaactcatctcagtctcggccacctgttaactgaacctatcagatccaacaaagatcagcaagacaatgtttttgtagctataatatgatactattgctgaatgccattttctttttctgctgacaaagtgatgaaatgtggatgattgggctgagttaggctgcaatgttgaagaaagcagatctctgaaatcttacaggtcatggtcacttgaaaggggctttcctaccttcctgatactgagagatttgcaagagcctcacttgctgacattgtcatttactggaagtca

SEQ ID NO: 14844 - DNA, 4734 bp, Oryza sativa
ttttcacgttggcatgtacggtggcataacacgtaatcaaaagtggcaaatagttaagaaattacctctacaaattattaaatacaaacataagagggatatttgaataattggcaaacctaaaagtggcaaatagttaaattccgctccaaaggtaggcccgaataactaactatacgggccctttcttcaacttgggtccaaacaaatcggcccgtacccacgagtgggccgatgcagcaggaatgggcttgttcaagttttagattgcagtcaggcaatggacaaatggcatagaagattagaagatggaactatactgatgttttccatccattccattctgagctaacccttacggcatgtttggcgacttaacaaaaagggattggtagtttagaggaggaagttgggagtttcatttttatttctcgtcccttggtagtagagatgagaatcatacaaagtttgagtgggaattaaagttcaagtgatgacatacaattcagatatatcctgacatacttaagaagggaatcccctccaaattaactgttactaaacacatattgaaaagttgagattttgctctcaaactctccttcctaattcattctaaaactccgacacccaccatccaaacaatttcctccaaccaaacgcgcccttaataagatgattgcatttcactgacataactaggatctacaatagatgtcaggacaattgtccgtcgtccatttggcaacggatacaaaatttgttgataatggattatattcgtttcaaaagcagaagcaatgaatcaccattcctacaataacgcatagctgcagaaaatgccgaaatttacagacaaggataaaacaaatataaacattcatctcccctccaaggctgtaatgctcacgccattcacggaattttccatattctctcttgcatattcagttgcgcgttttttgtgcacaaaaaatataggttgctttggttgaggtagcggtgcagtattgttctctaacatgaacacaacagatgacatcagcggcctatcatctggatggtcctgaatgcacaagagcgctatgtggatacatctcaaaacttcatggagtggacaactctccacaacgctcgagtccaccaaatcccttgcatttccatctttccataagctccaagactacaccaacagaatataagaatcagttacaaaagtatgcatcgtttgagctgaagaaattaagcattctgctgctcttacataagctataaggtttgggaagcccattatgagatggggggagctgatcctgaagccacttatgatctccaaaagtagaataccaaagctatatatgtcagacttgacagaaaagattccttccattgcatattcaggagacatgtacccactgtttgttaagcggtgaggaatgcaccgtttgaatcagtaaacatgtaaatttgatcacattaagcattagataattcatgcatcacttactatgtcccaacaacacgggtggtgtttgcttgttgctggtttccaccaaagatccgtgccatgccgaaatctgatattttgggactcatttcagcgtccagcaagatattgcctgctttgagatctctatgaataattgttaatcttgaatcttggtggagataaagaagccctcttgctacccctttaattattttgaaccggtttggccaatcaagcactgtttttcttgtagcatctcccaatattaacatgaacaaagtgtatcgtcagccatcattcagtatatatttttactaattcactaatcatttaatataaggccggaaatcagaacataccaaaaaggaaggcatccaagcttttgttcggcaagtattcatagatcagtaacttttcatcttcatgaatgcagcaaccaacaagtttaactagatttctgtgctgcaatcttgcaataaggacgacttcattcctaaactcctctattccttgcccagaacccttactgagccttttaacagctacttccttgccaccttccagaattccctatgtgagcaaccaaatgttcaattaaacaagtaaaagccaaatattaactggaaatgtcaagctatgacattaaaaaaaaaagaaatatcaagatatatcttctccttaccttgtaaactttgccaaaacctccttttccaagcatattataactggagaaattgtttgttgcaattacgacctcttcaaacccaatgaatggaaaatccacatcttcagccccaagttcatttgaggcactcaagtattgtaccataattttgttctggatttccttgcttcgctgtttgcctaacaagaacagtattatatagaaattgttttactaacaaaactacatggactgcattttgagaagtgatgtgagtgttgttgtaccccttgatttgcatatccacacaaggcatatgcatgtgaggatcagtaggctagccacaactggaaggacaatcttcactacatcagtctccttcttgactgctgcagaaatatagtccatacaagagaatgggactttcaggttctcttcataagctgcttgcaagtgcatggactagatgcactttactattagtaatgtttcattttaaccatatttgatgctactacagacttcagatgaattgtgaattttacaggcagatttagtgtgtctgcaaacatcagaggaagtggtaaattggcaaatctttacacattgggcaatagagtattgggtcccatagtagcagaagtggcacgccaaaagataggccacaagttgctaatgcagcaggataccaatttgagtcctgtcaatggtacatgaactggactgaccaagaaatgcatcggctagaaaaaacaaattactgaaatcggtgtcaactgaacaattggtcgtaatatactaggctatgtttcgtgaccaccattatctttcctaatataacttcctcaactaaagagtaagagcaacaagtgcctaattcagcaaggtgcccattcagtatgaaatggattagaaagcatagatcagaaagaatgctttataaaacagtttagaaagctctgggtcaagttaaaaagcataaaaaaaaatgcgtaatcaaattaattaatacttaacagtgcataagtggagtaagtatgggcattaatcacaatgtagaggcatatgatgggcagggaatgataaaaagtaccagttgggctcggaagccggaggtacagattctcaccaccaccagtgacctttgccaggtctagaagctcccccatccaaaccaagcacctcgatgtgtcacccatcatgctggcagtgctcaggttcgcgtaagcatatgctgtgcaagagcagttgtgcctgcactcttccatgcactcatcaaggcttctgttcctgatgtacaagaacttgtcaggtgttttcatgccaggcaaggtcaagaaactatctccatagctacatttcatctgctcctttctcacacatcctcttgaaatgttaagaccatcaggcttgaatccatcaaggcacttgcatgttgggaatgcctccgcagcatcacaataaccaaatggtccacaggaggcatatctttcgcaagtataagagggattgctgaataacacagaccatgcaaacaagttgctgttccagatcagcatctttattgttcctgtgtagtcgagcatcaagcgcatgctaggagagtcatcagaaacagagtacatcatgtatatctcattccctttgttgatgattgtctggtatgtcacagagctggtattactctggaacatagcagagaccaacgcaccattccatgccccactacgccagtatggacttgttccattccaaaccaaaacctggaaatccgagttggggtcaccactgagggaaaagttgccggttgatggatcatcagggcccttccaagaaacaatgcgctgagcaacctggccattgtatttcagcaagagcttcatgccagggaggatggtatcagtcaaatgatcaaagctctgccacaagattgtgtggttaggagatcgaaggaccaaattaccagaattaagaagaactaccgtggctccagaacctccagtggtgatgttgttccttgcttcccaaagagtgtggcctcccgattcagacaacacaaggtcagaactgttggagatgaagagcatggcagaagaaggggcagtgattgggttgtcacggttggcaacccacaccacggtgcgattgggaatcttgtggtaccatatgccaacatataaggtagcatttgagtttgttggggagaagaaaccaagagcaaaaacaccaccatccgagattagcatgtcaccagggtagagtggctttgcaggtgttagctgatcatctgatttgcacaaagaaatcaagaacacgagtacgaaaacggtagcgaaagccgtgcccattaggccttctattctgtgtaaggttgagtaagcatggaagcaattcttccctccaattgtaggaagctcttatcagcgaggacacgcaattggtaggaactatgaacaacaagccaaacaagggtcggtctcatccagctgaacaaagttgactcaaatgatttggccatccagcaaatcgtctgcccaacttgagccagcaactacataatgccgtctgagtgaaggttcct

SEQ ID NO: 14845 - DNA, 6141 bp, Oryza sativa
cgtcgccgccgccgccgctggatggaaccggatctgcctgcgcgtgctcgatagcttgcaagaccgatcagttggcgaatcctgaatgccgcagcggcgcagccgcctcggctgcttcccgtcgggcggcgctcccatggaaggatggggattggttccgttaacgcagatggtgcgtatttcttcaggccttagatccatgagagttccagtgcgccattgattaatagggtttatccagatctccactgtggaatgtggattgtgattgagagtattgcttcctggttggtggtggtgtgcaggtttcgccttggcctggggctttccatgaataaggcggcgccggcgtgctttgctgctttggacaacgcagcagcggatgcccttcaaagttcaaactcgtcacctgtaagcagactgcttctttcctatgcaatgctatcaaatgataggatttggccaaacgatttgcatttattagtctgcaaatttcagagcaagccaaggctgcagtagcagaaatagttaagtttctgaaatatggatgtatggaagcattccttttatgcaaccaagcaacaaagaaaatgctggttacaatgtattgctcagaacattttctgtgtataaatttgaattgctaatgtataagtgtacaactacaagctacagaagtttatagactaaacagggaatggtgtaataaacatttaacgtccctctagtgctgtgatactcacgttatttacagatctttccttgttttctctagtgtctttagttccatagaccctagctgtcaaataagcagactcctttggggtaggaagagcagctgtctcgttctctaacatgaacacaatggatgacatgagtggcctggcagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccaaagcatattcaggagacatgtaaccgctgtttagatcattccaaaaacaatgtaatgtgcagtttgaattagttataatgaaaacatatatcattaggtggtctacaggttacttactatgtcccaactactctggtagtattttcttgttgcttatttccttcaaagatccttgccatcccaaaatctgatattttgggactcatatttgtgtccaacaagatgttgcttgctttgagatccctgtgaattatcgttaaccttgaatcttggtgcaaataaagaagccctctcgctatacctttgattatcatgaaccgggtcgtccaatcgagaactgattttcttttagcatcttccaagattaatgtgaaacaaagttaattgtcattaaccatgaatatcctcaagaatgtttgtattatacgaccacaaataagtgagtaacaacgtaccaaaaaggaaagtatccaagcttttattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcttggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctgggctgtaaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacctgaacaagcatagcaggtgatcaaatcacaacaaaactgcctgtgcaagtcattcttttcaacatctcatgagtgaattgcacatggaaccacttatttatttttacccatatgttgcaaatcggattaggggtacatcaatctgcttatgcaatgcattcttttacaagatctataaacctcagctcctactgtagtaatgtacaactgcagaaactgcttgagagtttaatctcttacagtctagcggccttctagcgctgtcaggctcgcgttattaacggaactttccgagccttgtctttcttcttcgtcgtaatgcctttgcacgaaatatataggctgcttcggtattgggcgtgccatgtcctcgttgtccagcatcgacacaactaatgacatatgcggcgtggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattag

SEQ ID NO: 14846 - DNA, 756 bp, Oryza sativa
gtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccccattctccttcatggatatcggcaagaagcacaacgccttgttcccgaggagtgcacttcaggaggattacattagccgcgcgccgatagaggggaccttctaccaacacgtagcgtttggagatgcgatgg

SEQ ID NO: 14847 - DNA, 3119 bp, Oryza sativa
  unsure (1)..(3119): unsure at all n locations
aaaatggcgctccatacgccgtacttggcgcacgtaggcgttcatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagttgaggcggaccaagtatttgaggacgtcttcactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttagattgcccatttcaccacccgtccagtaccctctcgattatgcaagatttgaccgagggggtaagacgtaaccacagtgacccgatgcgcctggaaataatggcgcagtttcctcgagaccatcaaaacagcgtaaagcattttctgggctagagggtatcgggtcttggcatcccggagggcctcactaacaaagtagacnggccgctgcacctttcggtggggccgatccttttcgctaggggccgcatccntggggcgctcttcaccgagcggccctcgcggggcgcactcgtcttctgtgccgacgacctcggggtcggagacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgttgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacataggtcatcatcgccgtcgtcgatgtcctcggcgggggccttcttcttggcctcacttcgccgatt

SEQ ID NO: 14848 - DNA, 9331 bp, Oryza sativa
acctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatcatacgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttcttcccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttcttcgcgaggaatatctcggcgcggcagacgtcgtccacgtgaaccaccggaatggagccggtggccgccaggcctttcatggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttcttcaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaatttaaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggagtagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatg

SEQ ID NO: 14849 - DNA, 303 bp, Oryza sativa
gctcaaccacaggacgtgccacagtggagctggggttctgtcgtgctagcagccacgtaccgtgcccttggtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctt

SEQ ID NO: 14850 - DNA, 482 bp, Oryza sativa
ccgtcagttgtagtagatccgacgggattgtccgcggcggcggcgaccgaggtgacggccggcggctgcgaagcgaggtcagggaagcggaggagatggaggacgagccgccggagagcagaccgccggcggcgagggattcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctccttctctatctccggtcggtcgtcgcccacctcccgccagccccgcgccgtcgtcggccgctggccccacgcgacagagacgaagagcaggcgaggagtcctggcagca

SEQ ID NO: 14851 - DNA, 289 bp, Oryza sativa
cggagcgcctcccggcacgttcgcctccccctccgcctataaaatgctccccatgccctcctctctcgtttttcgctctcaccgctccatcccgtgccccctaccgagctcgcaccgccgtcacttacgccgccgcccgtcgacgtactccggccgtgtgccgccgtcgctagagccgccgacgcactaagccaccgccaccactagcttagccgccgcaagacccttcccggccgctgctctgcgtcaccggaataccaccgaaaccccatttccctcgcgtcgtcgg

SEQ ID NO: 14852 - DNA, 8741 bp, Oryza sativa
  unsure (1)..(8741): unsure at all n locations
tcagcttttgcacgaatatgtcaccatgttttaactgcacgtttcctcatcgcaggacctcgtctgccttcgagcgcgttcgcaggcacgaccggcacttccgcgagctccgcaggggcgttcgccacctcttcgggcgcgttcgccagctcttcctctcacggagcgtcgatccctcgcccacacggtactttactttttattaatactattaaatacctgtatgaaactgatagtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaagcaggacgagttggtcgtgccgtacccccggaccgactcacgtactcccaggggcacattatggcgcanggtaggagggacaggggtaagaggcctcgtcagtagtgttctacctcttcagtccttatgtgaccgcttcttttggcttacaaacttgtaaagcagtactacttttgctattactactgcaagactacttggggttggctcggctacataagtcttttcattcatatggtgctagaacaacttatgctcacgacaacgcactttcggcgcttcatggtagtgtcagatccagtagcgcgtacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacataatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaactatgccctaaaaaataataaaattgtattttaccagtcttggagattttaatcttgtatagttttcaatataaaaagatttgataactattgatatttataaaaaaaaatatagcacagtataaaatcgccctcccccagggcagcaagggggccgcctgcaaaattccatgccccctcgccgcccatttgcaggcggccccccgcacagtacaaaatcgccctagcggagggcggcaagggggccgcatgcaaatttcgttgacggccgtcgcccgagagcgaacggccgtctgccacgtcattttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcggaaaaagtgcaccgaaggtccctcaacttgtcagcgagatacaaaatcatcctcgaaccgcaaaaccagatatgcgggattccttaactatacaaaaccgatcatacgagattcctcggcggtttatagcggatgagtcagcatgggacccacgtggaacccacgccacctcatctcttccctcttattccccctcttctccctttctctctctcacttttctcagccgccnacggcggccgtctgtggggaagagcccgccgggggagggaaaagaaaaaggtccgncagccggcgtcgcgccgccgaagcaaacgccgccgtcagcatcctcccttcctcctctctctctctctctctcactcttttctcctgttggaagccggccggcaaacgaacatagtggcgcggcggcgccaccgggaagggtggtgctgcgtggggcacgcggcagaggtggcggcgccggtgccgagaagaagaaggtcgtggcactgtcgtcgtcgtcgtcctcggcgtcgagaaaaaaggtgggcgcggcgccggaggctagggggttgccccggctggtgcggtacaaggtgctggtgctcgtgctcgtgctgcagtttctgtacagcaggcaggcgtcggtggcggctcccaatagcgggccgctcccggggtgcggcgcctggggttgctggcacacgcggtgcggcgccgccgtcgacctcgccctcgacacgctggaagcttgtgtacgcgtcattctatcttgggaaacatggctgcagtgctgcacggtttgaacttcaggtttatctggtaaagatcaaatggtgaactgaaaacagtaggtgtccatcttgttcaggcagagatgtgtttataaacttcagaatctgtattactcctggtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaagttgacaggctataataatctcatactatactcctacttgaaaaggattcaaaagattgcttctttatactgtactgacgatggtagaactgtactacagtatagaattcagtctaggttcttcagacttgccaatggcttgaacaagaataaaaacagagacatctttcgaactgaagaagcaaccatcaaaataaaaaggctcgtgaattacaatatattggagctgaagaagcaatgttcagctttccatccacactagccgcggcaaccccctagcctccgccgccgccgcgcccaccttttttcccgacgccgaggacgacgacgacgacagcgccacgtccaagtccgcctccggtggttccccggccatcccgcctccgacaacggcgccatgctttccgccgccgagggatacgacggcgaggaccgcgtcagcgcgctccccgacgacctcctcgtcgcccgcctcccttcaagggcgcgactcgcaccgccgcgctcgcctcccgctggcggcgcgtctggagctccacgccgctcatcctccgcggcaagccccttgtgcgccggcgtggagggccctaggggcggcgaggtcgacgatggccgccgcccacggcgaggtccccgtggaggcggtggtggctagcgcgtggaggaagcgcggcggcggcggcgctggtcgccgatctcctcctctccgccgccgaggccgtgggcgttgcagccgtcgaccgcgccctcgccggtcacccggaccccttccgcgtcgtgcaccggtccgagctcgcagagtcctcaaccatctgctcgcctgcaagcctcgcgctcgcgctcaacagagaggaggaaccgaggaccggctgacatggcatcctgatatatgggacccacgttggtcccatgctgactcagccgccacatagaccgaaatcggggtcaaaaccaccgaaggatctcgggtgatcggttttgtttagttaagggactatatatatatatggttttatggtttaagtatgtttttttatctcgctgacaagttgagggaccttgggtgtactttttcccccaattaacacggtgcacgacacgacacacggcgcgattgtactttacctaccgtcccctctctcgatcggcttacggacaatgcgtatgacgcacgcccggattaacgtcagttgtaagtcgatggtcggccatgaatctacatgtcagtccagacgcacgaatgcatgactcaggtccagttcttttcttccacaagacttagataaatattaagattttcgtgacacgcttttcaaactgttaaatgataaatgatgtgtttcgtacaaaaactttttatataaaagttgcactaaaatatcatattaatctatttttcaagtttgtaagaattaaaactcaatcaatcatacgttaatagcatattgttttgcataaaaacttaggggctgtttagttgatggccataagttactacactttgccatacttaaggttagacaagtttgaccatgttagatgattgtttggttggcttccacaagtgtggcaagattcctcttttgtaatctaggtcccacatgtaagtgtctctaaaaagtgtggcatggtttcattttgttggctagagtgtggcttggattttgatggcctcatctttggcaagtttggttaagaaagcatggtaaacctagtcaatgttagtatctgaaccaaacagccccttaatctccatcttcatcttcaatattcaaacaccaccgtagtattgtgtagtactctaccagctatgcttaccattgctgagagcagcgtgatatgacgatctatttgtccactccatattgacacttcaatcaaccacccaactcgcaccgcaccggttttattttataataaaggtgatattctggatatagtgctcgtcagaatgtttcttttaggaatacttactgataagcacgccagaccacctcactggctcactacacaaattgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccaactgatagttacatatatacatatcgtgacatatgatggatcgaattattatgagactttatatgatctcaaaaagatggtgtgaattttcagagttcagtttcacctctcaaagattctactaattgctgcgatttgtattcagatgacatggcgaagaactcccatctcaaggacttgcaggcacttgaccccttgaaggtgttccgtgctgacatcggcgaagaaggcagcttggacgatgccgtcgccggctgcgactacgccttcctcgtcgctgctccgatgaacttcaattcagagaatcctgaggtgaaaagcttacacccttcgtcttaaaaaaaaaaaaaactaatattacctacaaacctgaaaacatgtgtctatctaagattgtatataggaatttatttttttttacaaggtagtacttggcaccactaattaagatccctactgactacgagatagctagttttcgtccgtttccaatccatgttcatccaactttgatgtgctctactgctctccatttcgtttttttttccgacgttgatggtggcagaaagatttggttgaagccgccgtcaatggaacgctcaacgcgatgagatcgtgcgcgaaggcggggacggtgaagcgcgtgatcataacatcgtcggacgcagcgatctccagaaggccgctgcaaggcgacgggcatgtgctggacgaggaatcctggtctgacgttgactacctgagaacggagaagccgctagcctgggtgacgttcctctcttgacattttcacatctccatcttatccataaatttaagaaaacttttacagtattatactgacagtacaaataatcgaaaaaaatattattttttcctcctgcttcaatataatatagtataaaattaaaggggataaaattgtctttttatactattggtggagggtaattctgtaaactcataatttatagtgaaatactcccaccgtctaaaaaaccatatgtcacattctagcactccctcagtattttaatgtgtgacgccgttaacttttttatcaacgtttaaccattcgttttattcaaaatttttgtgcaaatacaaaaatatctatgtcatgcttaaagaacattagatgataaatcaagtcacaataaaataaatgataaatacatttttttaataagatgaatggtcaaatgttagtcaaaaagtcaaccgcgtcataaattaaaatacggagagagtacgaggttgtgttttttttaggacggagggagtagagataggcattattttcaccaccatgaggtgccgcgccgctgcaaactagcacaatggatgaaaattattaaaataccattgttaatttaataaaaattcttaaaatactcagtatattgtatagaaaagttctctaaatttagggcctgtttagattgtaacaaaaataaaccttaccaagttttggcaatgttaaaattttggcaagatgctaatattatcaaaattttggcaggatttcttatatattgactaaatttagcaataaactaaacatagactttttttataagtttaccaaaaataaatattgtatggttgaaaatggcgtttgcgtttgcaggcgtactgtgtctccaaggtgcttttggagaaggcagcatgcaagttcgcggaggagaacaacatgagcctcgtcaccgtattcccggtgttcaccttgggcgcagcgccggcgccggtggcgaggacgagcgtccccggcatcctctccctgctatccggtgagttagaagcaccagcaccagcgatcaaatcaacaagctagctcccaccaaagtctcaacacttgcaggtggttcttagatcccaccttaaaaatttacaccccgtcacatcgaatatttgaacagctatataaaatattaaatataggctagaaaataactaattacaagattacgactaatttgtgagacgaatctggtattacagtaaacattcgctaatgataaattaattaggcttaataaattcatctcgcggtttattagcgatgctgtaattagttttttattaatgccccaacaactcttacgacaccctatataatatccgatgttacacgccaaaactttaccgcgtctctgaatataaacacacctaagttggcttctgtttattacttctcaggtgatgagacgcatctcgaagtcctgaagcccctgcaatcgttcaccggctacgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttggccaacttcgaaatccaacatagatatacatgcatgctgtgttcgatctgacgagcgagtgatgatctctgttatctttgcagcttcgacgggatgcctgagaaaccgagagtctgctgttcgtcggagaagctgatcagggaagggttcgaccgttcgagttcaagtacacgaatttgggcgacatacttgatgaccttgtggagtaaggcagggccctgggaattctaccacattgaacgaacagctcatgctgctctactttcaacctactcccttcgtcaaaaaaacgaaactaagactggatgtgacatatcctttcgtccaaaaaaacgaaactaagactggatgtgacatattctagtacaacgaatctggacaggtgtatatccagatttgtaatactaagatatgtcacattcagtactaggatggtttaggatggtttttatgggatagagggggtagatgtcacgaggaccaaactatatatgcgcttgtgaaataagtggtctgtgcctttaaacatctcaaagaaaaaaaaatacagtgttttaagatgagcctaatacacagtagataatggcaaaaaaaattaataccttatagggtatcctttggtcttgcatgtcatttaaatagttatatatatttttaaaaaaattaacaagattcatttggatgatacgtaagaaataaggagatgtccattttgagggaccaaggctccgttcatttggtctgttagggatgccacttgtttttttagccgcttcccaaactgttaaatgatgtatattatgaaaagttttaaagcttctttaaaaaaaatctaataaaaccatttgtcatatttatagtaattaatactccctccgtttcatattataaatcatctagttaacccttttaagtaaagggtttgactaagtttataaaaaaaaactagcaacatgtaaaaaaaattaatttcattaaatactacattaaagat

SEQ ID NO: 14853 - DNA, 662 bp, Oryza sativa
ttctcttcgttcaaatccagcgcccgaacgcgagaagtcgagaaagaagcggcagcgacacgggcgccgcccacaaccaatgcatcgccgcggcggcgtgcctcacgggtcccgccccccaacagctgcgccgccgcctctcaccggtgagtctcctccccagccgccgcctatcctcagcgaaaccctaggcaccgagccggccgcatcgacgcgtacgaccgtgctgtgtccgccggtgaggtgctgacggcgcaccccaaccacgtgcttagccggcagtgctcgtcgcagcagggggcgatgggccggatacacatcgtgtcgccggagtcgaagctggagtgcggcgagatctacttcctcatcccggccgcctccgtccccgacgccaagagaaggacgagcaccggcggcgccgccggccacgggcaccacgtccgcagcaagtcggagggcaacgccgccgtcgccgattggttgggcagccagtgcagcgcgtcgccggagacgacaaggatgatgagggtgcagaagcaacaccaccaccaacaccggcggcgcatgagcaccgggagccatgcctcgccgtggcagccgcacctctcgtgcatcactgaggacccctgagcttagctttcatttttttttcttctcttctc

SEQ ID NO: 14854 - DNA, 1235 bp, Oryza sativa
cgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcatgcgggagccgcaagggggatcaatctaccccaggagggggtcgtgcttctgggccccgcgtcaggggctcggggagcaaccgccctatcgacgaccgggggaagaggaagctgggacgaacaccttccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttcttcaaggc

SEQ ID NO: 14855 - DNA, 1800 bp, Oryza sativa
agatcttgaagcccgtaagacggcgctggcggagatcgctcaacaggtggaggaggagcggggggctgccctcatcgccaccaccgtgatgaacgaggcgcaggacaccctccgccttcaatacgggagctgggaggcggagctaaagaaaaagctcgacgccgcccagggggtccttgatgccgccgctgcccgagagcagcgagcaacggagaccgaaacggcgctccggcggcgtgaagaggcccttgaggcgcgtgccatggcgctggaagagcgcgcctgcgtcgtggagaaggacctggcggaccgcgaggccgccgtcgccatccgggaggcaacgctggcggcgcacgagtctgcctgcgccgaagaggagtctgcactccgcctccgcgaggacgcgcttaccgagcgggagcgagctctcgaagaggccgaggccgcggcgcaacggttgacggacagcctgtccctccgtgaggcagcgctggcggagcaggcacgccgcaatctagaatgtgtccgcgccgagagggccgcactggaccagcgggccgctgacctcgaggcgcgggagaaggagctggactcgagggcacgcagcggcggggcggctgcgggcgaaagtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagccccaggcccccgctaatctctagttttttctttttctttctctaaggccttcaggcctcttttttgtatagatcaacttaatctgcaatcaaaaatgatgaaattttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggtacggggtt

SEQ ID NO: 14856 - DNA, 669 bp, Oryza sativa
cgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcggctaccctcacttgcctgtccagatggactagcatctgcgccgcttgggacttctgcattcttgggcatttcttgtagtatggccgcgca

SEQ ID NO: 14857 - DNA, 1275 bp, Oryza sativa
agtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgtccaatgcttcaccgcctccttcatctcatccttatgagcataccttgcaccctcaattacctcgttctacttatactcccagggtacatgatcaccctctgatataacaagtccagagaagtcctcatttgcccaatcagtggccattacatcactttcctcatcggatgatg

SEQ ID NO: 14858 - DNA, 755 bp, Oryza sativa
tgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtcttgcacgtcatttttgccgccctctgggatggcgattttaaaaatcggcctcccagaaggcggtaggcgactactttcgtcaattttaaaatgaaaaattatttttgtaaaacttttaataaaaaa

SEQ ID NO: 14859 - DNA, 7490 bp, Oryza sativa
cgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtgtcagaagttttacacggttccccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccagaacatggctgctgccgttgccgtctccttgcagcggctggccggagacggcggccgccgacgatgtgaggatcacgcgcttaaccgtgccggctttcacgcacgacctcagaacgttcagagtgctttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcg

SEQ ID NO: 14860 - DNA, 475 bp, Oryza sativa
gcgcatacctgcaggagagccggcgagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctcctcctttcttcggcatcctctggaagagttgaggctaaatccatcggccggctcgaagccatcaaggcacttgcactccttgaagctgccggtgatgtcgcagtagccgaacggcccgcaggcgccgtagtggagacagccatggcctggtcgctcgaatgggctcgtccaagtcgatgatacgttgttc

SEQ ID NO: 14861 - DNA, 1448 bp, Oryza sativa
atccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcacaatctgtatgtggaaggttcgcgagaccg

SEQ ID NO: 14862 - DNA, 366 bp, Oryza sativa
ccggttgccaaacggcaccgacatatggcaaagcttcgatcacccgactgataccatcctcgcaggcatgatgttcttgatgagctacaagtccgagatcatcggacgcctcactgcgtggaggagccatgatgacccatccactggagatttctccttcagcctcgaccccagctcggacctccagggcatgacctggaacgggaccaagccatactgcggtaacggcgtcagaaccagcgtgacggtgtccggcgcccagtatccgagtaacagcagcttattcatgtatcaaacactcatcgacacagggaacaagctctactactcatacactgtctccgacagctccatctacacacgcct

SEQ ID NO: 14863 - DNA, 720 bp, Oryza sativa
cgctcgattgcttacatgttttgttttcttaccgtgttaccgtttcactaaatgagtatctcgcgtaacgcttgtcatgtagtactaatgtgcaagatagtaactccactacttgaaatcaacaaactcactcgtacgttcggcaatggcttgcacaccaatttcaactttttcacggcacaactcttcacataggacaataaacttttcgcattgcaagctaatacaaaaaacacaagaactaaacagaagcagagtatgctagaagaaaagcaggggaacaaaatcagtgagagagttctgtacctgctaggatggaggcaaaaactgcaagtagcaacgccatgtcgagcatggaagcagctgaagacgccattctcaagctcgactcaacctgtgacatctgacctgttgttgcttcttgcagagcctaacggccacgagcagaagcgctactactcccggcttatataggaaggtgagaacaacgccaaaatgtgtttggctcatactggccaataggattgaattcttagtctgaattaactttgccatgttcaaccaattcatggatggatggacaacgatgacttcgacaagaaaaaataggcaggagatagtcgaaggtcacactctgttcggtacaggtaggcagtggcgaagacaggacaaaagtagagcaaagaccattagccaaaggtaacatgagattagtgagtc

SEQ ID NO: 14864 - DNA, 30063 bp, Oryza sativa
  unsure (1)..(30063): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaaaattttcagctacgaacttactcctttagccttcacctaaaaattgcttactattattttcctggagttgtcctcaattttctcaacatcactcatattctagacgcgttagttacaacaaataatgtgattactgagcaggaagttcaagaatatcggcatatttgtaggaaaatgatgtcttcagtccaaactgagaaaatattatgggagtcttctcttaattgctgccccaggcagcaaggcatatggatatgccattaaccaactcaagaattgcactgtaaaatgtcaaaaactaaatggaaagtatttgtgttcttatcaaggtctttctgttgagttttaaggttcagagttatgatcccttgatggtccatttgtgttggtttggatcaacaacatgccatgggctgctgatagtatcatggcggctcttggggccaaggtaattgaattcttcgctgtaacaattgtttctccagtaatgttttgtccatatagtatactttgtatttcaaacctatcttctgaaatggggaaaaagatccatatttccacctagggaatatagtaggcatgttcatttctgatgacaaacctgtgattaggactagccattagccataagtatttactgaccagaatgtggacagaaatcctttttctatagttcttgaatttatacagatcaagaataaggatatttctatttcatcttgtagcaaggcaaactttatgatttgttcgttgtaaccactctatgaggtaagcatgatttcgttgaccgatgaagggggtaaaccctgttgtgatttgaagaaataaattggtatattgataatgctaaaagaacacttagttgtgcttgtactttgttatagggaactagattgaactaggtttatgttttgttttctggttcgttcatcactttttacaaccaaaataataactaaggttcttgctcaaattttttttttgttattctaataccagtcaatataacatctccattgttcgatatttcagttatatctattaaactacttctccgaagctaaattcaaactcagcatgtcaccctatcctatttaactggttttcttttttacagcgtgaaatatatgctattttgcccatgtaacgaagagtagttaatttggggatcactgatcagtgatcacataagcatctattttttctgctgaaaaaacaaaacaaacattttttgcgaaagcatttgctggataatctatctaattggtttatttgaaaaacaaaacttccattcatggtaaatttctatttaggaaaatgagcttatgtttcctccaaacagggactttacccaagtttttattgaaggtctttccatcaagtatacattttgaatgacaccatggtttgctagcccaactgcctttctagctgatatttgatcatgtatatcttacaattgctttacaaaaggcattattatcctctgtatccatgttataatttgaatcagtttcttctaaaacggattgagatgtttcagatttcaaaaaaagggtcctaaatcctatcatcaaaataatacttttgttggagagtgttgaatattttcagagttatttaatacgtattgcaatattatgtttttctgctatttcaatcagaattgagttgttggtgataaattttacccaaggctatcatttcattttctattctgatatttctacatagattttctttagaaatttggtcgattaatgctctttgctaccctcaaatttaatttttaatcttgtcataccaaatacatgaacatgcacctttcaagaattcggtgtattctaagccacacctctaccatgaagcagatgtcatacgaggagttttttgacctacatctggcacaatcacttaagaggtgcaaataaaaatatgctcactatatgatctttgttttctcctttctttcagcttttcagccttctcttttgattccttcaaatggatagacaaattcttcaactcttccgccttcaccatttgttcaacaattctttgagtaagatccttgttcttctcttttaaattcaagcactcttgtctgggatcctggagcaataatgacattttattatgttcctccttttttttttttatcttagaaccatgttttgtagatagcctgctcttcaagatttgtcagtaaaactttaagctgcaaaatgtcatcttcaattttcttgttgctatcaactgatactactatatcttcaaaattgagacttgctggtaccaactggagccaatttctctgtgtttctttttgtaagctcgtcaagtcctttagataagcttcgagtgtgtcatttctatcagcttattttgctttagttcacatgtgtactctaagtagcttatcacgtctttctcgttaacctgcaggtttttaaggtcatgtctgaagaaatcaagttacacattgatctcctcagtccatctcaaataacttagcttcagtttcagtgatgagtgtgtcctttagaacagttgctagctggtctctaatattggaaaggtgggactagagtcatatttttacagttgaggtacatctatatttgttcagtgtgaaaaaccatcttgcatcaaactgtttgtcatctatttccaaaactgggtctcttagacaatttaactatgtttttgtgctcatcaaaggaaagccaaggaaagcaggggcctgactcttctgaccaagttgttacatcgaccttgcaaagggtagagtgaagatctcgtcatgatctcatatcatcgtgcaaatatgtgatttcattttccatatgcatcagtgcttcattcttagagtataacggctatgtaatagttttgttctctccagattctgtaacaccactcgtacgaaattactcaccaatggctaacatataagccgtttgattcatatatattatatgtgccttcaactttattcagctttaatcttacaagaccagtagttcagcctaaaaacagcaaaataatctaattaatccatctatgtgcaggcggcgcgtcccaacctctagtctcctattaccaattgcagcagacttggactaatggaattgcttgaagtgaagaccagtgaacaaaaggctttacacaaaaagaattgttgacctctttcgggataaggcccggaagaagcagggattgaaccagggcttgttgacacagcagatatcaaaagcctatgttatctcattttcagggaccgagcaagggatgagcgccctctgatctaacgtccaaacaaacaactgcccttgttactagaaatatgaagcgtgctagcgcgcacttcctattaaccaattcaccaattttaagatttgtaaacaaagataataggagccgaagtcaatcccttaaaacactcctccccgaggggacgttatcggtcgcttcgttcccttgtttactgatctcttttcaggagataggtctaccgttgcaaactcatctgcttgtaaattcattgtgtaaaataactcgtaaattcattgtgccagaattgatcactgatcaggtgtgatcagtctcatccgtctaagagactgatccggtgcgatgagtctcatccgtgtaatattttggaattcctcttccaactcgtcccggaatgggcgttatggcaaagaacaagaagaaaaagaaagaaggaacttgtccaatagtaacaaatggtgcctccacaggttgacatctgatccaacctagtagtaagcaatccgccaaaagcaaccaaaatattccttggtgaatcggtcgaaaacttgaactacgcacatacatttctttaaaaaaaggtaaagccaagagatataaaaactggtgctattgcggctacacctggagtgagcccacaagagcttttactgtaccagttccgaatataagaaggggctcgcggattttaacaggttaggcttaatctacccaattggaaatctcttgcagtagcttttactagaaatccatttctcccacaaagctcctgtgacctaaccatctagatagaagcctcgcaaagagtatatgccgaaaatcctatgtttggagtgaccatgaacactgcttgagacccttctttcgtgagagttgtgattccgctttcatgttttggattgagctttaagtggattggaggcgggcattttcatttcaacgtagcagtagggaaagtgatttcggggggttagtacacatgggcagttgggacagttacaggtagttaagttcggtcttattcttatgggcaagtggtcctagaatctctctttccttctctaaagtatagctttatgaaactagaatatgagtaaatatagaaatagaataataagaatatcatatagccgtgtattggttttgatcccagttttatcctacatggcggctgagtcagcgtgggacccacgtggacccacatgtcagcatgccacgttatctcttctttcttcccttttcttctcttttctcttttattttcttctcttctcttgtgagggtaggcggaggcggaggcggaggcggtggcgcacgccgttcagaatgaccgcctccccgtgcgctccgtgctgcagatgctcttttccgagcacggcaagctcaaccgcctcgccgagctcagcggcggtgcctccttcggcgcgcccagcctggtattcgacctccccggcgcccgctgccctccaagcgcgaggtgctcgcccagcaccacgagctccgccgcctccgcgaggacttcgcccgcctccaggtacggtttcatcacggccatctccgccgccaccgttcatcaattcaaagctttgaggtgttcgtcattgtcttcgtcgcgacgtgcaggtccagtgcagcgcgctgcaggctcaggtggacaggctaagcatggagaggaggtggcacggtggcggtggcgggttcttcaagtggagcacgttctggttcggcggcatgagctccgacgtcgcgagggtggaggactccgagagcggcattgagcggcggacgccggcgagcgggaagaagggcaggggaggcgcacttgactagttgcagaaagaactctgcaaagctatgtatgcctcacttgagtactaactgttaggtttgtctattggattacctaggtttagatctagtcggtagaacactttggatggatgaacaacaatagatgaactaacaaagaggaagtgagagggtttagggatgtgaccggtcgatgttgaggaggaggaagtgaggccggccatcgtcgttgtcgttgtgcgcttgacgtgggcggcggcgacgatgctgcgcggcagtggcggtcgtaggcgattccggcgaggtcatggcgcgacgatggagtcttcccgtcactggctgtgcccccttgatcggttagggtttgtggggtggagtggcggtggcgacgaacctcgtgtcttgtgtcgacccgtcctccacccctctttatatggcgcagggtgacggaggcccaccagccattgggctgggcgcccccgatcagggcgcgggtcaaggcccccttgagccgttgggctcaaggagagggagatccatctaacattctcccccttgatctcactatttcttttagctttttctattccatcacaggtttacatatagagcatgtttcatcgtcacggttaattaccgctggattcgacagccactatacacatctctattcagaaacagatactttaacttttgggccctatagtccaggattcataaggcttcccttaaacacatgcatgctacatgttccttgaacatgttgggaggtaggcctttcgtgagcggatccgcgagcatcctttctgttataatatgctcgagactgattgtttgatcccggactttgtctctcacaacatagtactttatgtcaatgtgtttggcagtaccacttgactgattgttgtgagagtacattactgcgggttcgttattgcagtataactttattggtttcacaatactgtcaaccacctttaaaccgggtatgaacttctttagccagttcacctgccccgttgcttcatagcatgctataaactcggcatacatagtagaccctgcagtgatagtctgttttgagcttttccatgaaatggctcctactaccagggtgaacacatatcccgatgttgactttgtattatcttttgcaaagtcagaatctgaataccccactatctggagcgattctgattttctgtgagacagcatgaggccttttgttccttgcaaatagcgcaagactttctttacaaattccaatgctctaggcctggattactttgaaatctgccaagtaacccggtaactaatgccacgttaggtcgtgtgcacacttgcgcattcatataaacaattttagccatttatatctggtattgatactgccatctatattcagggcatgtctcaacatattgccaattatcttgttatacacagagcttgaactgagataatgaagagatcgcaaaaatgtgtattcgtggtctattaaattctggccaatatcaaaatcttcaactgattttcctaaatataattttttaaccatcgcagttgtttcaatataattcccgggataatggatcctactccagatatgatggctaaaagacttgtaccgcaatataacatcgttactttaaagacactacaattatctgtctaaactgaagcctgaagaccatgaggttcgtctctttgaatgaactccagtatccaaataaatataggggcaaaaatagaggagcaacaaatcaataaaaaatcaaacagaggcaaatgcatgggaaggaacatactggcacattctcattccttggtaagaaataaaggaattatagaatatatagctttgcattgaccaagtggcttaggtataaaccaactggcctgttataaactaacaatattatctgaatatcatctaatacaatattcaaccatacttcagatttttaaggtaggaaaaatgtactgacctccctccttattcagggtgaacaccttattccaagtccatgtatagatcaagaatatagagaaaatacactgagaactacaatgtgaagaaggcaggaagaactgcccacctaatgatctatcatacatatatcaggaaagtgagctagtaaaaatggagatataaacaaatggtacttttggacttgccaaattggaacactggatgcaataatatgtcaagattgtcaggttcaccgagaatctttgatgtcatcagaaaatttaagctttgccgggtcatatgtaatacttccagattcaagtccatgtttagtgtcttctatttctttctgacagcgctgctcatttcccatttgcacacctgataagaagcacaaaagggaacttattaccaaggatgaaagctgaagaacttagtttaacatggcttgcatgttccatttggaaaataaaattggcttcacctttacactcactataacaacaaaaataaccggcatgtatcatggaactataataatgtacaccccagagaagactgtctagacctccaaacagaaaataacctcatgaatactttggatgggaaaaatattgttcagtaggtgccaacaaactaaaacggtgaaatgtaaaaggcttagaagttggtaatataaattacttccaataaccaaattgcacagtagataacagacctacaacatatttgtttggttcaaagcacattgtagtcaatatagcaaattttggttgtatcaaatattgagaaagcctatggaaacggaattcatggtactaataaacctgatatgcaaaatgtaagaactaaccaattcaaattacatatggatattttgtatccttagacaatgggtaattctaaagataaaatacagcattgcagttattattatagattaatgacaggcatatatgtcactcttgtgttcccaaccaaaaagtacatagagagctagaccatggcaacagttcgtattaatactgcaacactaatgtgcaaacaggtaaaactaatttgtatagacaaatgatctgttaaaactcatgctcaaagaatgaagaagggcatctaggagacaaaccgaatcataatatcaatacactcaattcatatacaacatatgcatgacagaaggagatgattaatttgatctgtacctgggtggtgatgtttaaacattagtactgaataatctagccttcactcccttttttctttccttcctaccaatcatgtgaaactcacaatgagcagcaaatcaagaatagagagcaggcgctagaacagatatgtatatatgcatataatagggagaatcaatgttttagcagtagtcatgttgaaagaatgaagaacatctaggagaaaaaccgaagcacaatgtcccaatttacttgcagccgtcgtcaccataccttgccatagtttgtgccttgctgccgtcgtcgccgtactttgccatagcccatgccttccgccgtcgtggctttggtgcccaagctgctgctcttgctctccccatcctggcaccgaggggaggtgagcggcatggagaacgggtgaggaagacagtggagagtagcgttgtactgccgaagagggccacgaccggatccacctggaaagtcgagggaatcggacttgggatcgcatcaggcatagaggatagggtgagggagagagaggctaacgtggagatgagatgaaagaggagaagaggagtgcagtggctcgcatccctctcgtccgggcaaccgacaatccaccagcgaggaggccgctgttgccggatctggaagccccgcctcctcactggtggacatgacggactcgcttgccggcgcgggagcgcgggcacagtaacaatggctggatgagggcacgagggaggcgaaggacgacgaagctacgacagcgacggcgcgcgcgaggaatgaagagaagagggcatggcggcgcgcgtgcgagaggaagcggcgacggcggtacggcgagatagctggagtaggttgaggccttgagggagtggaagaggagggagttgcggcagtgacgacgcacgggagtgaaggaggagggcgaggctgcggcgcgattggaggaggagggcgaggcggctagggtttgttcaggcttgcgaaatccacaccgtccgttagagatccgacgatcccacgggtgcggaagggccagcacagtgaggaacgtggacggccagatcgaccctacctcgagatcggacggcggatattagcggggaccggtgcgtaattaaccaaaagtgtagggttttttttgcaaaaattgctgatgtgctggtagtcttccaccgatcgcacggcttttaagtaaacctatattccatccttccataacgttcaatttaaaactcaatctctcaatctacaaattaagaatgtattctttcttataccttatagtttgaatttaaacatccgtgtttatatttattttgtagtttgcatttaaatttacatgtttatattttaatccatagttgtatcgagaagtatggacttactggttattagtagaactagatggtgatggtgctgcatgcaaagcgcaaagctttcggtacgtagctgacgactacacgagaacgaattatttggaggcgtcgaacagataaatattagtactatactagaaaatctcgcgccaaatggcgcgccccatttagcatgttcttatgcatgaacgtagaaatttcaaaagatttggtaggattaggccaacttcattaaattgttcatttaacatgtagatttattcaattaaagatcatcatattttaatctatttatggcatagctattaaaaagtgtttttttagtaagtctacattatttaaaatgtacttattttaaaaatattaattatcaagctttatcttcagctaaataagccatggtctttaaaaataagctttataaaatggactgtttttttatgtaagtctacattatttaaaatgtacttattttaaaaatattaattatcgagctttatattcagctaaataagccatggtctttaaaaataagctttacaaaatggacatttttaaataacgaccgtactcgttttttatatatataaaaaagaccaaatcgaatttatgataaaagaacatcttttcctcgttcaaaatataagcattcaaagtttatatcagaatatagcaattgagtatccagtcccttgtctcaaccaatcataatatttcttatttaatttttccacttacccacctagtttatatttggttaatatttcttatttaatttttccacttactcacctagtttatatttggttttcaactaagaactatgtaataatggctatagcttctattgaagtaaacactggattttatccattatctaaaaactcacctagtttattaatacctatacccaatttcaaataatgttttagaccttacaatgacggggcatttctcacgaaagtagaactaacaaaaaaaaaattctactccaaccctgaaaactttatttctagcaattctcatgcaaatttgtagtggcaagaaatatcctttgcgtccttatcaatttttaaattttaattaaatatgtatatataccttgatttgattggctaacagatgttcttataagggagtacgtaacatatcttttagtatttgattgttttttttacttgacacagcctattaaattttaatcgctctttattttgcaaaagttctataaatattgtataatactagcaaaatacccgtgcgttgcaccgggtaatgatatggtgactgaaatttgatttgaactatttatatgaagaaaatgaattgtaatttaatgaaatataaaattttctgcaatattaattacactcttttaaattatagcaaaagtgatattgcgttgcaacgaatagaaaaaacagataaagttgaattaaaacatattaaattctaattaaatgaaatataaattttctgaaatatttaggtattttttaagtaggtaggtatacaattaaattaatttataagtaaagtaagtgtaagaaataaaatgttgtggttggatttaacttttattaaattttctatattaattacactcattgaaattttattggaatttacctagcttaattgctaattttgataatacaaatatcatttcagcatttattgaaataaaaatctaaataaaaatccttttttctctatgggcctttttcaacccattttcttcttcagcccgcaagagaccaaagtctacttaatacccccatactcctttcatttagtggaccgcgggcccacgtgcgggcccaaaccctcaatcgatctcagccgttagttttgatggacggctcagatcagattaaaattgatgaaaccctaaccctaaccctccccccagccgagccgagccggccgcctctttctcccccgccccgacgccgcctctccccctccctctccccaccggggtctctccccctccccccagccggccgactcccccgccaccggcgccgtccctcccttctcgccggcacggcgcggcgatggtggggtgcggcggtgtgtgccggcgcctccgccttcccccaaggcgagcggcggcggcggcgccctcctccccgcgagcggcggcggcggccactctctccacttcttcccctttctctttgtgtggcggcgggagggccggcgacgccctcccctccgctagatcggggggaggggatgtgcgccggagcggaagaggcgccggcctgaacgacgtggagacaggcgtcggcgccggccgcctttttttttttttgcaattttattccatggctattgctaaccgaatcggattgtgtatggacgaaaattagatgtgacgaccggaaaaacacgaatatttatattagttatagattttacatgttaaatataactatatcttttgcatccatcaaaacatcacaaaaaagctgattccggctatcggttggcaaaagtgaagcacttattaactctctttattattttattggtcgatacttatcaactgcattagtgcaaagagataggtaaagtaatgggttttctagagattctgatgtgcaagggacatcacaagagcttatatctgattgacacgtggcaaaaattttggtgatgtttagctaatttttcaggctgccacgtggcccaataacattctagaatcatgaccctgatataggtagaagagattgctgataaagaaaaatggcattttgcaacacatttaacttgttcagtgttcaagctaacgttgaacctggtacaagtacaacatgctggcacgcatgtccacatctcgcgggtcgagggttcaagccgaatacaacacacggcatgttgcatttcatcataatttaaagtacttagcatcactttgaacaaggttttggtggtcacatgtatattcgcaaccttcttaaggtgtccgcaaaagacgtgcgcagcataatactttgcagacctatggttatcaacagcaacatgccactaggcacctgcacgaagaaaaacaagaaaatattactgtaaatttaaacaagtgaaattctattgaggtaccctaacaacttgacattacgatatattgctcaattaataatataggcgtcacagcaatgatttccacatgttcagtaactgtagactgaaacaaaactcacgacatacctttttgctcatgtctttagcaccttcgtgagcattctgaatgcagcagtactgtaccttctcgattcatgagtaccactcagttgctgaattcttcccaagaaactaatattatggttcagactcgaagactcgttactcactactgaattacggaactgtggacgatgaagcattgacttctcatctgctgctccattggatacagacagctgggcccctaatactgatctccagtaggggaaaaaatttctctttatgaatgttggatcccatcctttaagtgccttttttctcgcagcctgtcccataattaaatgaagattaagctttgtgaaacccaaaaaaaaattgttaaattccagcttgatcaaccaaagagcacttgattcacaatattttcatatatcctgggagaggtgttttacttgagcaacagaataaattgttttctggttatattcaagtgatgtcaacaaactgaattgcttaagcaaaagcagctgaaccagtaagcagctgcacggcagaaacataacaaccagaagcataacagacatctatcagcttgatttattaccatccaactacaaaaggactaatcatactgagttcgttcattctaacatcttaactaggtcatgatcaaatatcaaaacaaaccattgcacaccaaaaatctatcgcaagaccacacacacacagaaagggaggcagatcaaatctaaacacaatacttaaagcaaaacattctatctcattggagaaaatcaattattttcagattgttgacagtactataatctagaatgacgcactgctgtaaaaactgccgagcaaccttttaccaggatagagaagagaccagacatagagtttctacttttctagaatcccaactacaagataatgatctggcaggcactctggcttatatgcaccagccagtaagatggcaactaatagcaaacctaacttggaacctaagtaactgatcattagctgctgctgctccctgcatgctttggtacatcatactccccacgcattgttgcacaataattaacaaggtgaatataagaaatcatcattggtaacatcggaatacaattacctttttttctgcagcaggcagagaagtagacatttgtgcaacagccttggttacatctatatgaccataaaaaatttaataaaggctctttctgagaaattcagaaacagttacttaaataataaacacacacctttgtgaactatgtcgctgtaagaaatcttgttatatggacagcttcaataacaagtttaagaaataattaataaacaacaaacatttgcatagaaaaaaaatattatattgaatacaaaaagagcagtacaggatcatggtgtcaatgtattcttcgttagggcaaaacccgaattccttaagaatatatgaaacacgcgcaaggacctccacattgggcacctgaatgacattagaaccattatatcagatagtgaaaaatgtcagaaaatgaaacataaaaatagcatatattgataatatggtcatgtagtacaatgatatcattggtggcaaagaaatgacaaaaaagaatggtttagataaaatttaattataacagatgaactgaaagaaggtagaacagtttgcaatcacatcgaatacaagcttacttggtaaaataaagtgcatatattgataatatgatcatgtagtacaatgatatcattggtggcaaagaaatgacaaaaaagaatggtttagagaaaaattaattataacagatgaactgaaagaaggtagaacagtttgcaatcacatcgaatacaagtttacttggtaaaataaagtacatatacaaacatattcaaaattacgtaactatttctcttcgtttgccttaactatattcaggattaggaaccaaataatacgactagatggttcaaaaggtacaaggcatgaacattagtcattcaaatttcaacttggtaactgtaattgactataaattataaaaaggtaaaagtctattttttggcatttgaaatttccttgtagtccatttttcaccctgaactttgaactgggcattatacatggtgcattaggcagatgaactaccttgggtggtgttctgttgctgttttagtgtaatttttttcaatattttttaatgtaatgtgtttgggcctaggctcatagtgctttcttgaagcatatgccctgaactaagaaactagttgttttttaccccaaatttataaactggacaaataacacactaaatcatatttcatggtggacaacatgatagtggttctcgctaacatgaacttcatcaggtcagtttcattgttgtggacctaatcatgcgacatatatactaccaaaatatgcaaaatatgagcctgcactagggaaaatcaccactaataccaatatattttttttaacttttccaacttgtttgtgtcaacaatatcaaaatatcctcagggaaatgtagtcagcttaagacaataacaaaacctattggttgccacttgccgccatgaaccaataattaatacgcaaagtatttcgttttttgccgttatgtgctgtgcatcaagaaaattcacaaggagataatagcacacaagtattcatgaaacatgcaaaagttgcaatggccaacatcactaaaatatatcaaaaagtgtacacagttactctgtatatgcctgcgctgtggttacaactacgattaaagaggcttgttgcatctctaataaaattgatataaattgacatttttatacaaagatttcgtatacatttctgtaaataatgttaaatcagttttggttacttgaagcaaaagcaaaaaacaactcacataatatccaatacaaagttgaattgaaatgcaataatatttccacgctataaatcactaacacaaaaggttgatacaaatgcatgaaaattttattactatttgagatttgtttcctaaatcatctccacaactcagatattagaatgcatatcagcatctgacaggaataccctaaagttgttcttttggaagggtgagccttcagaacctggctcccctaagaagctagtagttgttatgaactggtgagtaatgctataacaggacaaattgtaggggatatggtactagagttgggcgagggaggaaatttcacagggattacttgacaaatggcatgccccaaataatagtaccaatcaccagctagagtctgctacaggctctattcagatactatctcttacaatagataagacgacaaaaggttctgacattaatgcaccaaaacagtttttttgttatctttcttttcttttcttttatctatcctcatgcaacaaagtttccttttataaacgctaagagtcgatgttaagccgttgttaagcttaacaacgatgtttcaccctcctttcccctctcatccatgtcagcaaactttaccttgttaccaatgctaagagcctgctattagttgctgttgtatacatgccctaattcaaacctatctcaaatcaaccagaggatagtaatctaatttaatatgtttcaaggatagccatgactactcaaaataacccaaggtacagaagctcctgcaacatgctaaggtcacatccctaacaatagagggctccagcttctcaaagcagcggaggctcttacgtcataactcataagcttcattagacagcttactcttgtgatggttttaacacaatgttgaagatagataaaactggactgaccgttcactttatgctggatatgctaccctatagtacaagtaacggaaagtggccacggaaatcaacaaatcactagcattcttgttaggatcagggcatggagccatggaattacctattaaaatattaataccaatatgaaaaaatatacagtgagtaagagatcatatggtgctgtgattttacaccattaaaaaaacaatagtacctctgaatgtgcttgaatgtagttatccaaaacctcaccagcttgcgaaattatagtgacaatcagacatttacatttcaaaagtgctcttctttcctccagcagcttctgcccctctgcagtatcacctttatcacacactagggaatcatagtcctcatatatacgttgcgcgataatgtcgaacccatcaggtttgccctcacggatatgttttcgggctgccaggagtaaaactgcggattctacaagcttgtcattcttcatgtaattccagagctcatcagctagattatctgttttttcagcaagcagtctaactgtatccaaaaaaaccttctgcacaataaaaagaaggcaaaggaatgaaatctaaatgactttgagcatttgtatgcaagcaagcagtgaaaaattacttcctattacatctcgtttccactaattgtagcaaggatgaactaggatcaagcggaataaaacctactactccctccgtcccataatataacaacctaggaccggacgagacatttcatagtacaacgaatctggacatgcacatccggtcctagattgctatattataggacggagggagcatttagctatttcctctgttacaaattactagctttatccaaagtcaaatatttatatccttgaccatcaatttctataaattcgtgtgttttaacaacatgcaaattatatattatgaaagtatttctcatggtgaatataaaaacataaatcttaatgtgttaaactatatgaccagaaatagacggtcagatacagatagctcacttaggacaaaactacaatgactagaaaaggagggagtaatggaattttgaactgctgacttcttgcctctaaatttgaaataagaaaatgcctcagcacatgtgaaaatttttaaaagatgacaaacaggaacacattttgttgtcatgctgaaaagatgatactttggaaagagcgttaagtgaaacaaaccatctcaggtagacacagcagatgaatgagcttgtagatataatcctcatgatactgcacaggagatagattgtcctccagatatttatgcaagcaagtatttccaactgcaacatggagcgggagtagtccgggaatgccagcatcattgactgtgtgtaaattggctgaagcaccatggcagaacagcaacttgatcatgtcaacagagaaccgttcagcagcttcatggagtggaaaaattccatatgggttaatgcagtttggattggcatgcatacaactgagctgaggtgccttgccctccaatacagttttcgcacatcgcaaggcattatgcctgacaatgcaggataaggtttctgaggtgatgttacacttaaatgccatggccgcagtacattccgcgaacaaacggaagaagcaccggacactgtcctttctcaagacggagtccaagcggggagatatatcaaagaaggcatcccgcaccacctaaattggtccgttcacaatcagaagagatgaaaagaaatcagctttcaatgtaataaagcaaaacataaagtctcattgccgtgcaccttcatgacaaaacatttcatttcagcaaagggcaccctttttttttgagaaaatggaagagacaacttacgtaaactaaaatgctgcaggattaaaaaaggacaaacgtaacaggatgatctagcaactgaattctgtacatgaagactagagagcaacctgaggggtagggtctgggatgattatatcatttgttaaggacttggccatccaagcatattttattttaacccactggaagagagaatgtcagcagccaggtaccaatggaagacagaaacctagaggaagagtgcagatgggctaccatacctcatcagccttatccaaatcagacttcttgataactagaaaagggcgggacgggtccatgttatctacggttgctccatcttctttacctttaccaacactttctcctatgaaagcatctggcagaaaatgatcgggaattttcaccactatatgtttgtctgtaacaaggaggattaatctctagttacattcaaaagaatatcataactttgtactgctagtaatataatataatatacaattggtaaacaatgatccttaagactgtgaagacaaaataaatgatatttaggacatggacacgatctacaaagtggcacttaggctagcaatatctatggaaacatgatatttcaagtaaagatgattaaatattatgagtattttccgtgatgaatatactgtcaatatgtgcagtactttatatactgatggtcaaagttaaaatagtttgactggtaggaaccataccctgcaacaacatatattttgaatcaaacggcacatgcatcactgaaattgatgaattcattgaatttccacccccacagctggatataataatattgtgtgtaatagtatagaaacctatacttcattcttaaagaaggcagtggtggtggcagtgaatctgccaccacaccaactctgttgtatagattatttcttttaccaactactccttcgtgttttaatattacaaaatagtccttctacataatctacaagcacgaaactgtccccaaaacctcgcaattaatttgttccaagcaatattagcacgcgtttaatttattttaatccatcgcaaatcacagatatttatctagtatatgtgaaatgaacggtaaaaagaagtttttcacatactagttgaacgagtgatgtgtaaaacttatggaaatcgaacaaatcaaaaaataagattgatgtttctgttcaacaaaacaatacctcctgctgtactagatacgccgaaaagaaatcaaatcggtaattaggctctgaatgtttcagaagagatcagaattatagatttgacatttcgacatgaggaacagctccagatctgagggcgattcgcaaataattttggagatggaagagatatacaccgtagaagactccgagttgaagaagaagaagaagaatgggaaagaagtactgaaataacaaaaattggttgatgtaactattaccgagggccgattccgacatgacctccttgctatgataaagattggggctttcctggatgagtagaaccagatctccagatgagatgaagggctggcttataaaatagtggtgggatgtaggaaagggggcggtggagagttcgccggaggcgatggcggtggaatgagcacctagggtttctttatgggaagatatttgtgatggggaactggggatggtggacaaggaagaaaaggatatgatcaagggctcgaggcccggcctgagtgcctgacatgttgcgggctgtaattaagcgcctggccaggccgagaaggcccaaatgaacttctttcttttctttttcatttttttaaaaagtccactttaggctatgaactatgtagttttatttgagtcccttaaccataaaatctgatataaaactcccttaattattaaaactagttggatgacccgcacaactacacggctatcatcaatttaaaattatctatttttacacataattttatttaaaattattattcatgctattctaataattttatagtttttaaaagcaacgccagtcgctaccctttactcctttgtcacatttttatttgcttacttgatctatcactacttctattcatcctcttgagaactttaaaagttaggccttatagtttttagagtaccttatcttattgggtttcgtttacataatttttagaagtatcgtcaaacatcgccaatttactactctacggccatctgttgccacctcaatttattgtcatcgggattttaaaaatcaaatataattattatttgtgttcctttttactttctataagtctcgccaatcgttagtggcttcaccaatatactcctctacagcaaacccgctgcttccccttcttattgccattgacattttaaacataaaatatgattatcattgtggtttttttaattatccataagtcccgccaaccgtcgtgaccatgctgcttaacggcatacctatcgtcactcctcttaatcatcattgtgattctatttggggttttgtttatagtttttgttgatatcccatcaaccaccaacactctactcctttacatgcctattgcttctcccctttttaatgctatttgtcatcgttgttttctagatggactttttttaaaaaaaaattgcatatttttcattccgataatttttattcataaattatattcaaacttcaattcttataatttttttcctatttttgaaaattattttatttgttatttcgaactttagttaatctcatcatgtgttctagattgcctcttaattcaattgtctttatttttttcttacaaatttaagttatttataaattttattcaagttgagctcttatttttttctttttctatcttttgaatttattttattttttattttgaattttaattaatctcgtattgtgttctatatagactattctcttaatatttttttcttttttatttctaatttcaatggtttagttaagataaaatacactgtgggatttcgcttggatatatatatttttttagaaaatcatgagctgtagttaggagtccgatcgtctcaagttagcatgcgagttttttaaacatatttcttgcatgattctttcggtattaccaaaagcgaacgatcttaaaaaccgactcaaatacggatatgtatttccaaaagcaaacaaacttaaaaaccgactcatacacggatgacttaccaaaataccgataaaaacatggtcgttaacaaatttttataatagtagagaagagatatagatagattaatacaaaaaaaaaaccgactcaaacacggatgacgaaccgtggaaacatcttcaattttttataaccgactcaaacacagatgaccgactgtggaaacatcttcaatttttataatagtagatatttggattgtttcaatattctattcctacttgaaatctctttttattttttttctaattctggattttatttgttttttattttgaattttaattaatatcgtactggtttcttgtatggactcttctttcaatattgcttattttaaatttcaaactttagttatttttaaattgtatttctatacgaaatattcttttattttaattctaatttaggattttattttatttttattctgaattttaattaatctcgtattgggttcttatatggactcttctttcaatattccttatttttaattctgaatttcagttatttttaaattgtatttctacttggactcttttttttctagtttctaattttattttatttttatttaaaattttattaatctcgtattgtgttcttatatggactcttctttcaatattgcttatttttaatttcgaatttcagctattttaaattgtatttctacttggactcttttttctttttctccgattaatgtgggaatttcttgcccccacagcgatacaattgtattcctaattgaaatcttatttttctttttctaattttggaattttttttttcaaattttaattaatatcgtattgtgttcttttaatatttttattttttattttcaatttcagttgtttcaaatttgtattcctacttgaactctcttttattttttctatttttggatattattttattttttattctgaattttaattattctcgtattgagttcttatgtggattcttctttcaatattgcttatttttaatttcgaattttagctaattttaaattgtattcctacttgaactcttttttttttgctaatttcggattttatttttatttttattcttaattttaatttatctcgtattgagttcttatatggactcttcttttaatattccatatttttaattcctaatttcatctattttaaaattttattcctacttggagtatcttttcttttctaattttggattttattttattttatttttttcaaattttgattaatctcgtattgggttcttatatgtaaacttctttctatattgcttatttttaattccgaatttcagctatttttaaattgtatttctacttggactctgcttttttttttctaattttggattttattttatttttattttgaattttgattaatctcgtactgggttcttatatgaaaacttatttcaatattacttatttttaattccgaattccagctatttttagattgtatttctacttggactctccttttatttttttttctttttctccgattaatgtgggaatttctagcccccacagcgaacgtggtgcctcctttcaaaactgttttaataatataatcgatagatagatatatagatatactagtgcaaatcgagtctcccagcggtttagttaggtggttttgtcccacgtgacaatggtaaatcgtaccatgaaaattgaaagaatttcgttgaatctacctcccatcctttctccttttcttcttcctcattcctctgtctccccatctctctccaccgtgcacatgtgggtcagcgggcaatggagacaccgatctggtcggagagcaccctcagccatcgccgtcgcaagtggcaagaagagacggcgtcaccattttcctcgcttctcgttgtcatgttgattacgctatccttcacttagatccagaatacgccgatggctgaggactctggagcactgtctgtaattacattggtgatgttcttttcttctgaaaataaagatgaagatgaagaatacgttttttacataaaacaaggtggtattaacgtatgattgattgagttttaattattacaaacttgaaaaatagattaatatgatattttagagcaactttcatatataaatttttcgcatgaaacgtaccgttagcaatttgaaaagcgtgccacgaaaatcttaatcttcatccaacttttattggagaaaagaacgggaccattgcccccattcttgtgaacctcatcatgctccagaacttcttctccggcgcgctaccaaccgatagtgacgggtgattggctggtttggtggtcgtcggagatgtctcccttgattgttcgttcttggatgggtggtagtagtcgggttaagcaaaaaaaaaaaattcaaagattgaattaaggtagttgttatcacaacttctttttgcttggatggatgctattgtcggtgtctccatttgttgcttggatggtgttgatggtccttaagtaccaaattcgatttatcaattcatgcataataacaattgaaagaatataaaatagaataccaaacttagaggtagtagtcttggtgaatatttatatataggtaaatatatggacaaaaatcatccgccatgtgaccaaatacacctccggacaatcggacacgattacacggtttggaggccccacgtgtcaatcaaaaccacctaaaattgagtccagccaaagtacaacatgttgggggcccaccaggcagcctcccaaccgaatgagtggccggtaggtgagccagaagttcggtcgaactgcctttgcatcccctcgccatctgccaacacgtggagcaagatactggagtcctaattgcggttatgtgtggtttctgagcttaaccaacccacaaaccatcattacaactaggggtggcaacggggagggtcggggctgggttggacgggaacgtgtcacaccctgatccggcaccgccgtacaacggcacctgacaggagcgtgtcgtaggaaaaacggcgcgaaccgcttcctacgaaaccgcgatcacagtaccagtcccaggacatagcgctggtacccacggtgacaaatatgaatcattgcaatccttaaaataaatagaggatttatttaccttgacttaggttgcagctcgggacaacccgagaatacaaccgacgacacggacgaggcaaacaccaacaacagcagcagcagtggaaccaacggtctaacacccaacaccacaggcaatactagggaactaggacgaaaccttaatcttcacttcacttcaacttcaccttcagagctggcagaactatatatatatagagcaagggtgagtacttatgtactcagcaagccagggggacttaggtggttaattcaagcttcaaggaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctgcagagggggtacactttacctacatgacgttactagccttggtcacctagcccgtgcggatcaaacacgtctggtgacttggggctttcacgacaaggcatttccaaagccaacacagggttgccatatgccaacgagaggggtcccggaccaacaacaggttaggtcccagaccatactgtgccatgaagcccaggggtcctccccgacaccaccccggcgaatccacttgtctcttggcatcaaggcttccctggcctagcttgttactcagccaggggtgtcccattccacccatgtggtcgcacttgttatatgctcggatgtaattccaaaggaatcggtccttaaatgtgaccgcacaagcattccgcccaggaatggccttgtgtcgcgagttttatttttaaaactcattttctttcacaaggcaccgacccaggcgtcgggttttccaatcctttcgtaaaccaagttttacccaagatgtttctcagattttaagttttaaaggcgaccgtcgatactcgcacagagtgtatgaataccgaggcgcaaccaggtggttacaagggagcatgatatagcaattaacaatggaaggatcaaatgcaacaagttaggtaggcccaccaatctgcctcgcaggcggggcaaacatattaagtgcaatcctatcaatgaataatattttacaatcaatataattaagttcaaatataggctcaagatgttcaaaggtggcttgccttgctcagggtcttcacgaatcttcgagaaatccgcttgacgaaaaatatccggtaaccgcaactaggcgcatacaatcaaaaatctaaacaaggaccaaatagaaaaggatcctatttagactaaaataatagtgccattagatagatcacaattttacggaattactggaagtggaacgaggtcaatcggagtcacggatcgggagatatgaatttttggaggctttaaatgaatgtctggacaaggaaatgatttatttgattctttggagcggggaaaacaatttgtggaaattttgtggacaagggaggatatgtacttatccgatgggaataagagaaattatttacgaaggttgtttgaattttctgggaggaaggaaaatatttgtggaacaacggaaaaaggatttattgaattttctggattaaagaaatgatttattgaatttgtggaaaagaatattctttttagtcactcattgacgtgtggggccaacatatggtgagagaggagtgaatagggagggagcaattatggacttttggccactgtgtttggggaagggagtaaagatagactttccttgttttttaggccgaggaggaaggttggccaatgggccaagcccacgagcagggagagagaggagggggcggctgactgggcaccatggactgggtcaaacgccacatgggcagccacggtggcaaggcgagaggggaggaggaggcgcctggatcggacggctcacagcggcgcaacgccgccggcgagcggcggcaagccggaggggccggcaggcaccggaagcgagaggggctcaaggcggttccatccaccggctcggatgagggagaggcggcgcgatggcggccatgcggcggcgggatgggcggcacggcgcggacgcggccggcgaggcggccagccgtggcggcgtcccggggagattctctagggctcaagggggcgcgacgatacgaggggttcggtatgaggagaccgatggcggcgcatggccgagcgcggcgcaggcgtggcgagcggccgcggtgagaagaggaggaaagaaggggagcaagctggaggagaaagaggcagggacgaccaaccggcggtgacgcgcgactacgcgcggcggcgggagcagagcaggagggaaagggtgacgcggcgaccggggggaggaagaagaagccgacggcggttcttggcgcccgcggtggcaaaacagaagaggtgcgaggaactcaccgacgaacggaggcatgggcgcgaacgcacgccgaggaggcgtggcgctgagatggcgcggccgggaaaggattcaacgccggcagcgagtgcggcattgggtaagggatgagaggagcgcggccatggcgaaaatggaagggaggagcgaggtgctcaccggcggcatggcatcgagtaggcacgacaaagagaggataagaaaggtgaacgaccggggcatgcggtggggtctttggtcacgccggtggcgttcttggccgccgcgactaagaagcggccggtgctccggggttgcccgtgcgacggcgaccggagttgaggaaggaagcggcatggcttcaccgtttgaggcacggagcaaggggagggaaaaagggggtcccggagtggaatttataggcggggagggcgggagcttgcgagcggcatagtcggtttagagggggagcatgcgagctggcgcttggctgccaaccacgggcgacatgaaaacgacgaacgacggggatgcgctcggtggtgaaggcggtggatcgagcggtggaagtcgaatcactagggcaggagcagctgcacggcgtggtgaaagtggggacgtggctgagggctctgcctccatcctttggacgcatgcgcacaggagtaggggcgggaggatgacgccggcggtgatagcgtggatggtgcggcgtggagcggcgacaaggtggcagcacgcgatgcaggtgttggtattttttaacgatattactagaaatataatttctaacaatgacgcagaaatattcatggtatattatggttacagagtttatccgtaagctcacgcatataccattgtagtatttcacccaagggtatcgtatttattttatcccatgagaatatcatgtagagagaacttgactaataatttatatattacttgtgataatcatatcctgagcaggggttaagataatccaagggtagagtgacacacaagcaatagctactcattctcataatatattatctaagctaagtggaaagaaatgagaaagaaaatatattcctatacttctagtatacatacattctagttatctgatatactagctaatactctctatccgatgcccttctggtacttcgagaagccacccctaactgtcgagttccttatgacagcccgtcatgaccatacaatcggggctaaatacggaggaatatcctccccagggaattaacttaggatcatatacacgcgcggaggaatacccgtactgagctgtcaccatcagcggcccacctctcatccgcagcatataaccccaaataatgatatcacgtaatctagacaccacgtctaaacttccagatactactctaatatcatcatcatgacatagagtaaatgcataagtaaacattatacccgcaccaaagcatctcccagataagctagcagcatattcagtataacatgaacataatgtaaaattggcattcatactctcggaaagtattccaataccataaatgtataaagaagaatatttaataatactacaaagcttacaaaagaagataggaaagctactaaagccatacccgaactctttcgaagacttccggactcctaatttctactctattcctattccactagcttgatactactaaactaaacttgagagaatatgagagaactttacttgaggtgtgtgagtgaagtgggaatggcaactccttttatagccttccaatgacgttgtgaatgttggaatggtcggaaataccctctaaccgtcattgggggctaatccacaccttccaggcgaagccctggatcggatggcactgaggagggttcagccgaacctggggcctgcccaatctagcccaatttcggctggcggcctcctccgttgttcttctccacagacttgtgaattttggcccagtttgtcgtgtcaattccgagtcttggtccattcatatataagtctggttctcgacatcatccgattgatttatcgtctgtgttgatgtcgattctcctccactttatgattattctccgcacaaggttagtgaacctaatactagtggaatattattattctaacatactctcttcttttttaatagatgacgccgttgactttttctcacatgtttgaccattcatcttattcaaaaaatttacgtaattataatttattttgttatgaggtgttttatcactcatagtactttaagtgtgatttatatcttatata

SEQ ID NO: 14865 - DNA, 2734 bp, Oryza sativa
atcatctattaaaataatggaggtagtatatataaattgcaagcatcactagttctcctctattttggtaatattgacggtcgaaactgatcgataacgaccgtcaacaacagcaggcagcccagtgctgacggcagcggcgaccgggcggacggtcggtcatcgcgcgcgcgcgtgaaaatcgaacgacgcggccggattttgggtggcgtcggcagaaagcggcgagagagagagagagaaagtggtcacgcgcgacgcacgtgggagagaagatgcaggccaggccatggccggattcggcccaagcgaatatgagggaggtaaagtagacttttaccaggaaatcgctttaagggatttgggggcaattggtgcgggatttgaattcaaatcgaatatttgaactcggcaaaacatggggaagccaaagaggggattcgaagcgagaattcgatattcttggaacatatatataatcatggggaggcgacggtgacgaacttgttaatggtatttcttagatttagccgcttgtcaatgatatttgttggattatctcttattttattgttcgaaatggaagtgatcttcctattttgctgatgtagatgccacttattgatgtctacaacaatgaaagttagtaggggaccaccatgaatcatacgccaatgtcggaggagactagcagagaaggcctccgggacggtcgcggcgcgagaacgacgtagagggagaattgccggagcagcacgcagttgccggagaagagcgaagtgtagtcgaggaagatacggcgacactggcgatgaatcatgctggacgaagacgaaggcgaagtagtgggaccaacggcctggatggcgacgtcagtaaccatgtagaggtagctggaccaccggcctagagcggcgacggtggcagcttggagatgcggcgacgatgctcgaagtagacgaagaagaccctgagcggctgacgatgaccagtgcggatgacgagggtgtcgaagcgcgaacggcgatgaagacgacgaggggcaacatcgtgacccataggggcgacacaggtgcagcttgatgtcgatgcagcggcgagaactccactagtagggaggccatgctgaggagggcgcctctcagcgttccaacaacaagtggaggtggaccacgggcggtggcactgcggcccaagggggcgacgcagcggcaacccgaagcttaatggcgtagacgcatgctcgatgacgatcggttgcagaagtcgttgtagccgggagcctgaacgggtgatcaagccgaagatgcgtggggctgaacgatgaagtcaaagcagagtcgatgccgatgtcggagatgtgtagaagtcgacgaggcggtgggcgacgcaaacccgatctatgatcaggaaaaaaaaacagacacacacatgtacagcagcagcaacacggtaacaccacatctcttcctcaatggtgtcggtccatagaccaagtccagcaatctctctgcctcaacggtaccagcaccaatgacgcatgcacatctgtcctctccagacctccacagccagagccagccatccatgaaactccatgtctacacttctctctctcctcccttgcagtcaagcaagttcacagaagagaaaaaaaacaggacagggtgtcacgtgtcaggcccggcggtgctgacagccgacgtcaggagagggcgcaggtggtggagacgaaaggcgccggagtcggagggcgtggcggtgcagggatgccgccgggatgagtccggccggctgcagggccctggcgcgccgatggcgtccgggtgtcgacggtgaagacggcacggcagaaggagcccggcgacgccggctggggacctcggcgcggtgaagagaccgaggatgagccggcgaacccgctgagtggatctgaaggtggtggaggctggcgacggctcgggatccggcggtcggcatggaccgagcggctcgggatccggccgtcggggccgcgccggcggaactcgggcgacggggctggagcagagacggacgccgtggcttccaagatcaccagatcgacgtagctgctgttgactcgacgaaaaacgagccccgccgaggagatcgatctactcggcggcgcgacttgacgaagacgacgtaatgacgaagacatgccgtccaagaagatcgagatcgatcatctcatgacgacgacgcagatgcgaatgacgaacggaaaaaaaaacgggtggccgccctcgttagaaacaatttttaaatcaacttttaaattttctaatatttaattactctcaaataactgttacgaactcagtttgtgctatcatccatcaaagggatcgggctgagttctttctccaattttcctaactcatctccctcatttttcacgcgcacgttttttaaattgctaaacggtatgttttttataaaaattttctatatgaaagttgctttaaaaaaatcatattaatcgatttttcaaaaaaatgctaatatttaattaatcatgtactagactgctccattttacgtgcgtggaacgaacacagcctagtccatagattttgggcaaatgagttactgacaagctggtacgtgcgtactttcacctctcctgaaggaatcgtaatctagcgtgcagtagtgctggtaaactatcacacatcatgcatcttaatgacgcccctaaaaccaattaatt

SEQ ID NO: 14866 - DNA, 402 bp, Oryza sativa
atcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttattcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacagtggtgttgggtgttagaccgctggttccactgctgctgc

SEQ ID NO: 14867 - DNA, 674 bp, Oryza sativa
ggggcggcttgggccggcccacaaggagaagggcccgcgggagagggatgggccgacggcccaacaaagaaaaaggagggaaaagaaaagaaaaagagaaaaaggattttcctgggattaaaatattgcgcttgctcatttttaattggttaaaattatttccaaggctctgaaaattccactataaatcctgttaatatattgtgacatgtggaacccaagaaaaatcccacaatgccaattccgattattatttgcatttattaattagggaattagctctaggttaattaagataatttcttcggacgatttatttagacaatttttaaagcaagcaaaggggggaaaacttcagggcgtgacaaccacaggcaatactagggaactaggacgaaaccttaatcttcacttcacttcaacttcaccttcagagctggcagaactatatatatatagagcaagggtgagtacttatgtactcagcaagccagggggacttagatggttaattcaagcttcaaggaaagtgtcggtgatatgggaccgggagtatcgtgaccagaggcttgaggcagacgcagtcgcccacgtggcctggcaccttcggggacgtcgggcccgagggtgaggtgtccgccctcctcctgatttcccccgagggggggtcgggt

SEQ ID NO: 14868 - DNA, 5430 bp, Oryza sativa
aaagagaaaggtgcatgtggtatcccctttaaatataaaaggaggaccttgcccatagagaggggggttgattcttttggagattgagagcctagaacaggggagaagtcggctcacactttgtagctccttcatacacagatccaacaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcagactcttccgtgtgcgccaagtttttcttgttcagcctaatggccgagcaaggaaaagcgcacgatctctctccgagtgtgagcggcgacgacgtggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgctttaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggcttcgtgtagtcaaagcggagggcgcggcgagcggcgtctgctgcgcgccattctcccgccactccctcgtcgacacctccaactcgggagggtcagcatggagagccgaatgcccgcatcgacatcgagcgccggcgtaataaccggcgtactccccgcgcaacggagggcgcctcttcgtccagagtgtcacctcgacatggacgtgaggatcagccctccgtgccccccgccggtggtgttggctgtagagcctttgtggcgagtcttcgaaatgtccgttggcccccaaggttccggccccccatcaccgagaagtacgatgggagcgtcaaccccaccgagtttctccaggtcctatacgaccgggatcgaggccgctgggggtgacgacagggtcatggcgattttctttcccatggccctaaaagaacaggcgcggggttggctaatgaacctgccacgtgcgtcggtccactcctggaagtatttgtgccaacagttcaccatgaacttccaaggcacatatccgcgcccaggcgaagaagcggacttgcatgcagtacagcgaggcgatgatgagtcgcttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgttgagggcgctccgcgggccacccgaaaggggaggcctgcgagcgacaaaaagaaagaggctggtactcccatccgggagcgcccagccagcaagtggtgctccgtccacaacacctccctccacgatctcgcggattgtcgcgcagtcaaaaacttggctgagcgaacgaagaagtgggaggaggacaggaggcaggaacgccgtgagggcaagtccgcggcagttccctccggtaaacggcgaagtgaggccaaacagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcaccttcgaccagaccgaccacccaccgtgcattgcccggggagggcaggttgcgatggtagtttcccccaccatctgcaatgtgaagttgggtcgtgtcctcatagatggaggagcggctctcaacatcctttcccccgcggcctttgatgctatcaaggccccggggatggtgctccagccgtctcaaccgatcattggtgtgacgccggggcacacatggccgttaggtcacatcgacctaccggtcacctttggtggatcagccaacttccgcacggagcgggtgaacttcgatgtggcggacctcagtctgccctacaacgcggtcctagggaggcccgcgttggtgaagtttatggcggcggtccactacgcctacctccagatgaagatgccgggccccagtggccccatctctgtccgtggcgaccttaaagtcgcgctcgcctgcatggagcagcgcgcggaccacctcgctgctgcgaccaagcccgagggtggtgacgagaggcttggcgcctccgcccccaccgccccgaggcagcggattgccacatgcgacgaggtcccggtcaaggaggttgccttgggcgacggcccatccaagaccacacggatcggtggtcttctggatggcaaataggaagacgcgctcgtttccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttttagatgcatactctggttatcatcagattcgcatggctagggaggatgaggagaaaactgcgttcattacccccgtaggaacctattgttatacatcaatgcccttcgggttaaagaatgcaggtcctacttttcaacgagctactcgaatttctttgggtagtcaaataggacgtaatgttgaggcttatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcgggtgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccttgctactttacttagcggcgaccccccaagtagttagtgcagcgttggttgtggagcacgatgaagacaatcctcatttcgtgcacccccattctgtgctaacttggcccgggagcgagcggggaggaggggcccccgagtcggacggtgggctacgcccctgacgactggagtcggccctctgccgcttgtcagacggtgctaggtgccccggacccccagaagggcccgaggccactgcggggaggccgcacttaacgccctttgaccccgaggctaacccctgtgctgactcgacccggaaagagcaggagaagaggcccccgagccgaacggaggccagaggcccttacgaccgagttggcctttgcccgctgtccgcgatacaaagggggggaaggcccccccgacccttcaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacagggcgggtggtaaaatgggcaatcgagctttctgaattcgatctgcactttgacaacgcccgctatcaagagccaggccctcgctgattttgtggcagaatggaccccggctccagagaccgtctcaatccccgaggccagcacgaactcctcgcagctgcctcacaccacccactgggtgatgcagttcgatggttctctgtccctccagggtgccggtgcgggggtcactttgacctccccgaccggagacgtccttagatatctggtccgccttgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgtcattttgacgggatagagcttcggcatgtgcccagacgggataacatgatagccgacgaactctcgcggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcattt

SEQ ID NO: 14869 - DNA, 2693 bp, Oryza sativa
  unsure (1)..(2693): unsure at all n locations
atcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgagggggggtcgggtgtcaggtttcgggctcgggctaaccccgcacccccctcgggtgtgcagggttagccgggggctatcacacatgcacagccttacttttcttatttcagcatttcaataaaagcagtttcaatttcctaaaggttgtgtctgtgccgtttttccttctgaagaatcttaacttgaaataaggtcactcgttctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaagatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattctgacgcgcccgggtcgccggcctcgttgccaccgtcgcttgcactgctggcgttcccctcctcgtcggagttgggggcgaacgcgagccgaggggccgagccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgccccgcctcgcgaagggacaggctgtccgccagccgtttggtcgtggcctcagcctcctcgagagctcgctcccgctcaacgagtgcgtcctcgcggaggcggagcgcgcattcctcttcggcgcaggcggcctcgtgcgccgccagcgtcgccttccggagagtagcggcgggctcgcggcccgtcaagcctttctccacggcgcgggcgtgttcttccagcgccatagcacgggcctcaagggactcctcgcgccggcnggaacgccgctcagtctctgttacccgccgctctcggcagcggcgaagtcaaggactcctgggcggcgtcaaagcttttctttcagctccgcctcccggctggcgttttgaaggcggagggcgtcttgcgcctcaatcatcgtggtggtagcgatgagggcgggcgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctaaacccatccagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcctgagggttgcccgaaggagtgggcccagt

SEQ ID NO: 14870 - DNA, 7688 bp, Oryza sativa
attttcctgggattaaaatattgcgcttgctcatttttaattggttaaaattatttccaaggctctgaaaattccactataaatcctgttaatatattgtgacatgtggaacccaagaaaaatcccacaatgccaattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaaaaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcgggtgtctgcatagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaacggtgccatctgtagactagcttggtacctgttgttgtaagaaaactcagcatacggcaagcttttgtcccatgctccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatccttaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattagccttgccgggatgatagtgtattcccatatcataatctttgattagctcaaaccatcttcgttgtcggagattcagatcaggttgggtgaagatgtactttagacttttgtgatctgtatatacctcacaacggttaccgatgagacagtgccgccagatctttaaagcatgaacgactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccgaaggtctatcttagagaacacagtagctcctttcagctgatcgaacagatcatcaatccttggcaaagggtacttgttcttaatagtgacctcattgagtgtgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccgaaaaaacctctggatactctctgaccatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccattgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcctctcggcatcggtacgcacgtcctcaggggcgtagcgcgcgaggcggttgaactcatgcaaatactctataactgttctggttccttgttgcagggaatggaactctctcttcttttgtgccacaattccctcgggaacctgtgctttattgaaactatgacgaaactctgtccaagtaacctctgccccagctggacgggtcaccatgtagttgtcccaccaaacagaagcgggaccttgcagctggtgtgtagcaaaagcaaccttctcttgctcgttgcattgcaaaaggttcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcatcatctgagtctgattgtccaacacctgagcaattgttgggttctcgggcggtggggacagactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagagggctcagaaactaatcttgcttatgaatttaagtgcaattatcttaatcttgattaaaacactgaaaaagaggcacgcaactcctaattgaggcagtcataccactgacacataatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatttttttttttaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccgaaagaggaggtatgatgcaggatataaccacaggaggctagaggttcttttgcataaagctagcatttaaaagcagtagttgaaagcagtagaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcggtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaaccgccatgggtgcgaccagcaaaaccatgcacccacagcccaccattcagtgtattttaattaactcacaccattgcggtggcaccaatctaaagctatgccaatagacaaagtctatgtaataatgtgatccccatttgtgtactagttgaactaagcatggctaagcatttcctaaaccaacatctaatcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgaactgatgagacctcagcaacgtcttcgaggaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaatcaatttattgcgcaataaagccccagggctgacgtcatccaagggggggcggcgccgacatgcgggccccactggtcagcggcactacgagagggagagggggcggctggcaagcgggccccactggcagcggcacaaggggagagggaggggtggtccaccggctggtgggccccaccgggcagcggcacagggcgggagaggggcgtggctgttggcttggcacggctcaagccggccggccagccatggggcggcggcggcggcacgcgcggtcaccggcggtgaccggcagcgcgggagacggcggcggccggcgcgaaggcggcggcggcggccgaagacgacggcgcacgcgcggaggacggcggcgctcatgggagagagaggaaaggaaggaggagaggggattcctcaccttcgagcacgtcggccggcgcg

SEQ ID NO: 14871 - DNA, 3296 bp, Oryza sativa
atggttccgtctcccccgtcttgcggagccgtttcttcttgcgctccccctcgggctgcgacgtcggcgcggccccctccgggcgccgactgctggcacgcgccgccccgccccctgggggaggagatgggggaggtgttcctcccaacttcctcttccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctctttcagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcagtcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgaaatataaaaggaggaccttgcccatagagaggggggttgattcttttggagattgagagcctagaacaggggagaagtcggctcacactttgtagctccttcatacacagatccaccaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcagaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctg

SEQ ID NO: 14872 - DNA, 161 bp, Oryza sativa
atttatataaaaaaaaatatagagcacagtacaaaatcgccctcccccagggcggcaagggggccgcctgcaaaattccatgccccctcgccgcccatttgcaggcggccccccgacagtacaaaatcgccctagcggagggcggcaagggggccccctgc

SEQ ID NO: 14873 - DNA, 697 bp, Oryza sativa
cgctaacatatgtgtgtataaaatagaagttaatgcattaaataatgcattttcattatttaaagtacaaagattaatgataattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaac

SEQ ID NO: 14874 - DNA, 513 bp, Oryza sativa
cagacggatcgctcgctcgatcgaatctctgctggacctctccacgatgtcgatcgaggaggcgttaggtcgcctcaaggtcgtcgatggtgatgagccacagcctctctcggggcccatcaccatcggcgggaagctccacctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatga

SEQ ID NO: 14875 - DNA, 251 bp, Oryza sativa
catcgactccttgcaaaaaaacacacacataggcatgttctgagttctgaagtactctgcaccttatcacctcggccgcggcctcccgatgcagggtgtgcaatgctgtctcctgcgtgtcgcggcggcacgactcgacgagctcgagcacttggtcgagggccttgttgagaatgttcgtccttgcctgcagcgttgggtcctcgtcgtcatcctgctcgtagcccttcacggcttgggcgacttgcttc

SEQ ID NO: 14876 - DNA, 2921 bp, Oryza sativa
ttgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagatttagcttacatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagtaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggagaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactaaaagggcagacaccgaacttcgacacattcccaaagctaagggatcactgggacgagttcgttgcatataagacaggtaaacaagggcaggcgatgatagaaagaaacaaagaaaatgcgccaagaagaagtaccatcaccacttggggtaaggaggctatagcgtcgcgatgccgaagtgggagcagatggaggctagcttgattgagaggggtatcgaaccggcaacagccaattggccggaacgatcgaagttctggtactatgttcacggtggaacgctcaacccagctgatggctcactggtcttcggcgatcagatacgagaggctgcgcgatgactaacagatgcagtggaagcctcctctcagggcacgttccgaccatacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctatgaactcaacatgtaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaattgacctgtcccgttgatgacatcactcagcggacaccatgtgagctgcatattcctttcaagaacttatcaataaaggtaagatttagccattccgctagttgctgcttatatatgttgattactaataaataatctctcccaacatgaaggtggcgtcgggcatggccatcccaacggacccttcaggtacttaccaccgcaggccgattccagcagaatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagtggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggatcttgacgcttacgttgcatcagaagtcaagagacaattcaagcctcaaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacagtttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagta

SEQ ID NO: 14877 - DNA, 800 bp, Oryza sativa
aaaaacaccgtccacgggaccaactggtgctcccgccagcggtagccgaagcaggtacgacacgtcttgcagcgtcgaagccatctccccacaggaaaggtggaacgtgtgcgtcttagtctcaagcggtctacaagagcggcaaggagtgaccggtctgcatcccaccgcttcgcagggtcacggtcgtccgccgccgcctcaacaagcctacaaagtggtagaaggcccgccgcacgcaacctgtatagagcaaacttcaaacataagtacaacacaaagcaaagttgagttgaaatgtgaacatacgcgtagcaaggaacgtgacggaggtcgacacgcaaccactcgcgcgacgtgcgtggacggaaggtgccgagctgtgcaccctcgactgctgacaggaacgagcggtggttcctgtcaatcgcacggttcaacagcgccggtgtgtcgtacgccatacctgcatcaaatagattgatcagaaacatataaataattagttcaacataagtaataaatgttcataagcgaattactaacacatattaaacaatagtacaaacaaacaaaagtgtcaccatacggaatatttctgattacaacaataactgcagttacacgatatgagtacttagtccgaacactcatcacgataacattatgatacaacaccgaataggtcacaatactactagtacaacaataactgcagttacacgatatgagtacttagtccgaacactcattacgataacattatgatacaacaccgaatagttcacaatactactagt

SEQ ID NO: 14878 - DNA, 398 bp, Oryza sativa
ttcggcccatgatgtcaacctacaccggcgagatcatacggttgcgaaacagggccgggctgtcatgcgagcgggcgtggcaagaacgccgtactcttatcagtcgggggcagctaatgcgcgaccagactggtcgcgcggtccgcacctgctgctgctgctaattactactagtagtactactatactattactactactagtatctactactactattactactagtacctactattagtatactgctggtactactataaaaaaaatatatttttatatgtataaaaatatatatacatacgcgtataccaagtttatatatatatatatatatatatatatatatatatatatatatatatatatatatatatatatatatatatatgatatat

SEQ ID NO: 14879 - DNA, 1632 bp, Oryza sativa
tgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttattgagaaaattccctatctagcatcaaaaaaagttgctcttccccctgtagcatccaaacttcaaaagttccctatctagacaccctcaaaatttttattccctatctgacacatctgttgctcccattacctccaccgtcaaaacaagcttggacccacatcaaaattttttgacctcgctctttctggatcggtcccatccccaactccacgctgctgctcctcaactccacgccgccgcaaccctagatcgccggcccatggccggcagcgcggatggcgaccccctgggcggtgaggacggcgattccgcaggctcaggcaccgtttccccatgcgcgcccctgcaggtagtggcgccggcgacacgggaggctaggttgtcgcgggaggtcgggaaggcgaggcggcggtcgttcccggcgacggcgagcgggggggggagcgcttcttggcgatggcgacggcgacggcggtggagacgccgagctcccgcatggcgagggcctcctgcacggcactgaggcagacggctaggtcgtcgcgggaggccagcgccctgccagcacgggcggccaacccccggcctgctcggccggctaatcccaggcggtcgcaggcagccaggacccttccactctctccgctcgccaggttggttggttggtcgtagcatcttgtgaaacttgtttctttctgttctgctacacgccattagtggttcttgctctgtttgtgttcgatcgattgagcactactatgtgttcttcgttagatgctcagtttttgtgtttacggagatttgcttgatcggtgcaggtgatgagggcgatctctgcgtcgaggagggaggccatggcggcggaggaggagaaccgtgcactctcggaggcaaggatcgcgtcgctgtcgctgcagctcgacgagcggctgctgctgcgcgccgcggacgccaggctgagcggcttcaatggcttccgcggcctgctacgcgctgcacaacgccagctcgctgctgctcctcgtcctcacctccggcgccgtctcctgtgccgccgccgccaccgcggcgggccgtgctccgcggagggcgccgcggacaccggcgggttcatggcatccattgcaatgctgcagcagaggatggtggaggaaaaaacagtgaacagaggaaggggaaaaaacgcctaaattaccaaagaagggcaaaaccgtcttttgtcctacttgttaacaccgttaccctcaaaactaacggaagtgctagattgggaacaaaaattttgagggtgcttagatagagaacttttgaagtttgggtgctatagaaggaagagcaactttttttgatgctagatagggaattt

SEQ ID NO: 14880 - DNA, 2437 bp, Oryza sativa
catctcaaattgggctgagaaatgggcccacgtaaaacttaattgtaggtcggcccatactacctcaattctggcccatatagaggcacgtcaaccacgaccccgtttcggaccagcaatttgtctccactagaagaagtctagaacagcaaaatccctcgacgacgacgaggccgaggtggcgccggcggcggagcagtcgagcagatagtgcaaacagtctcgcgcccgccacgccacgccacgcccggccatggctcgcggtcgcctcgagcgctcttgaaaatgagaaggagcgaaaggtttgactcgccgatatactggtatgattggtcttgagctccaagtgttcgatgaaaggacgcacaaaggaagccatgtgtccgttactgtcaagtatattcttggaactctgtagtctgtacctattatcaggtttttgagaaacatttccaggaaaatacttcagttgcaactatccattgaatacattctgagtcatatgaaccccgctttaatccaacaggatactgagattcttagttttaagagcagggagaaggtgtggggaaaatacgaataaatagcagttgcagggtctttatattttgttgattttctttttgtgctaatgggagcaaaaccagttaaaattcgtgcgtcctcaactatttcttacaccaatcttcatatcttcctcatactcacacaggtgaacaagaagagattgggagccaggcacctagcttaacaattgaattcacagcacaagctgagagcaaggatccgggggttgttggttcagcacagctgcacaagtggacattagaaatcagcaaaaaagatagtaagattctgttcgttgatcacaccaaattggtatggttaattgtgtatgctcacaaaagagaagagactcaacagcgttaattattacatgatgagaaatacattgcccagttcacataagatgtctcgggaaggctatgctacccatcataacgggcgagctcgagcgccttctcgagattggtcacgaataccgaaatgggtggccgctcctcccaccgcagccgcacgcaatgcactgccgtctgcgccaccagttccaccgcctccagctgcctcggcgttggctccgctgccggccgcctgtccagcatcttccacacttcccccgcctcgatcagtggcagcgcgatggacaccaagctgcgatcagacctctcgtcccacttataccactcatgccattcttctgttgtcttctcctcttcttgtcgttcactctcctccttgtcatcttgtgtgttctccccctcctcttccgcacattcttctcgcttctcgtcttcctcaaattcttctgtcttctccctctccttccattcttccctattcctctccaccgattcttcgtcaaataaatatgatttcttcccggtcaatactaccatcatcacaacgccaaaactgtacacatcggtcatcaaattcagagtgcgttccatatggtactccggggccaggtatccatgcgtgccaatgacagtgtcagtctctgccttttcctcggtgagcgcaaacccgagcccgaagtccttcaagcgcggcgtccagttgccatcgagaaggatgttggatggcttgatgtcacggtggatgatcggctgctgaccgcagaactgcaggtactcgatggcccgcgacacacctagcagtatctcctctccatgcgtgtcttccaggatgccaccactggcgacgacgacgacgacgttgggccgtgcaggtggtgatccagcgagccgttctccatgtactcaaagacgagcagatgctctttctcctccttttccttccgggacggccgcaggaggtggcgcttctgcttctcctcgaccaacacatagtagctatatagtggaacgatgtgcttgtagcggatggcagagaggattgcgatctctgccttgaacggctccataccctgaggtgagttcagaccacgatgcttaatggcgaccacccgcccatcgggaagacatcccatgtacaccgagccgaagccaccttcaccgatctttctatcaggggcaaagttgttgcttgcctttgcgagctccttaaaattaagaggaattttatggtccagcaggagaggaggtaccaaaatcatgtacgtccattggaacccatccgacggctaacgaacgtcggtaccgccaggtaccgtaatgccgatgggcggtacctcccctccatccgcgttgtgctgattaagtggaagggcaaatctggaatttcgcatcgtacatctgtttctggaattttttttatttataattttttttattaaaagttttacaaaaataattttccaatttgaaaattgacggaaatagtcgcctaccgccctctgggagggcgattttta

SEQ ID NO: 14881 - DNA, 10996 bp, Oryza sativa
  unsure (1)..(10996): unsure at all n locations
gaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaaggggttttccacctatccagctatcttcccaaaacaaagttcttttcccatttcccacttttttgaacaaaatttaaaaaaaatcatcctttacttccatcaacccatgccagaaatgagaattaccctgtttaaaagttaccccagacaaggtgaagcatctaggcccccggtgttaattttggtaattaatgacaagtgctaattgtggactaaccattcttttgagctatattttaagttagattgacatcatgtgtgtgcatggatgattattgatggattaaaattgacggcgcaaagcaaaaggaagagaagacgataaactagtgttttcattttgaattgatcgaggcgtggggcgatcaaaattgtgctagtttatttttagcttcgccatactattaagaggggtaatgacctatcaaagggatgattttaattgccaaattaggtcatttgcatttagacttgtgctcacatttcacaacatgcacttgctatatatttgtcactgctctggactgccagggccggtctgaccgccggacagattccggtctgaccggccggtgtcaccagtctgaccgccatgtcatggccggtctgaccgccgtatcaatgccggtctgaccggaaggtgttggccggtctgaccggccggccatatggccgggatggcatgctctaggatggccgatcccgagccgccggagccgtattcggtcagaccgagctgaggacggtctgaccgagccgaggccggtctaaccgggcaccccatgtcggtctaaccggccgaggcagtggggcccaatgacagccctacaacggctagaaaactagccgttgtagagtagcacggtctgatcgggcacatacctccggtcaaaccgacagagcactgagttgggggatttcgcccccaacagctagttttggtgggtgggagtataaatactcccccaccagcagcaaggggactctcttggcacccaattcaattgcatacaccccttgtacctctctcacacacctttgagcttagtgttcatccattgtagtgattgaggttgttctagccaagagtcaagtgcattgcttccatttgtagagctagtgtggcacttgattaatcatctccacgccgggtcattgcttgttactcttggaggttgccgcctcctagacggcttgtggaggagttgcccggtgacctctccgagaagattgtggaggaggccaggcgtcgaattgtgagtggtttggagttcaccaccttcggagtaaaggaagaactaccccgagtgatcgaggcttgggtagtcctctccgtgggccggctcccgccttgcccaccccttgacgaagggggcgtgcggtggcttcgtggttgggcggtggagttggactcgcctcaacggggagtaggaaaccggcaagtttccgaacctcggtgaaaaatctcttgtctccttgtctcatttgattaccgcatttacatttgtgcaatttacatttctagagacatacttgagatcatatcaccctaggtttgctaaacattaacataggagtgtgatttactttcctagagatataattgagccactatcaccctaggtttgcaaaatataacttagttgcttagttagagttgaccctcaccaagcctagccacttaggttagtgttgattaggtgtcatttagttttaaatcgcttattcaccacccccctctagtcgacatctcgatcctacacaaggttttatttttcaaatattttcccctaagaatctcctgccaccaaccttctttgttttccaaattccatatccatttccccaacaaggccttattcataatgtctaggtccagaacacctagaccccccgatctcttggtgagcagatgatgggccattgcactaaatgatattttctgatgccttggtcttcttgccaaagaaacctcctaaagaaatccattttttctttcacccctttgggtaacttgaaaaaggagatcatatacatgggaacactgcttaaactagaattgatcaagattaatctccccttattgactgaagtttcccttgccagcatcccagtttgctttccattttgttttcagcatttctccaatctttctttgtaatgcgtttctgatctattgggatccccaaatatttcatgggcaaagcacccacactgcaagtaaatatctgactgaaaacctctgccttatcagcagtctcaccaatgcagaacacctcacttttattgaagttgattttgagaccagataattgctcaaacaaacataagatgtattttagatttttttgcatgtcttattatcaaatagaagaaatatggtatcatcagcgtattgtaaaatgaccatcttgttgttatcattatcccccagtactcctatcagcagattatcctcagctctttacactagtaaagttagtacttcagctgccaaattgaataaaagaggagatagaggatctccctgcctcaaacctttatgtgttttaaagtaaggccccactctatgtgttttaaagtaaggccccacttgatcatttacctagacatcaactttactacccattatcactttctttacccaatctgaaaatgtaccgcgcatggtaactatgataaccacgtgataaacgcatggctgacgacgagattatatccacgtgagaggatgatggttcagatctaatcgatcacaaacaatgaaacaaatattgaatcagcgaatcagagtggtcaggaaaatgtaacggaaatatcgattcacgctcactcactcaagtaggtgagcagtgagctgagtcagcggtcgatggatcttcgaggacgcggttgttagtttggtcaatgagtttgaggctgtgtttagatccaaactttacatctaaacttttaactttttttatcacattaatttatcatacacatataactttttagtcacatcgtatcaatttcaacttaaacttttaactttgaaagaaactaaacacagtctaagcttcactgtgtaatgccagtccactacgcgtcaaagtgtagtgggctttcagccttgaagggctaatttcaatgggcccgggattccgtctatacaaggcctcgtctggttttgccacgtaagcgaatcacgagttttttttatttataattttttttattaaaagttttacaaaaataattttccattttgaaaattgacggaaatagtcgcctaccgccctctgggagggcgatttttagagggcggcgtaaatgacgtggcagccggccgttcgctctcgggcgacggncgtcaacgaaattagcaggcggnccccttgccgccctccgctagggcgattttgtactgtgcggggggccgcctgcaaatgggcggcgagggggcatggaattttgcaggcggcccccttgccgccctgggggagggcgattttgtactgtgctctatattttttttttatataaatagcaatagttatgaaatctttttatattgaaaactatacaagattaaaatctcaaagactggtaaaatacaattttattattttttagggcatatttggattgttaccgtacaaatattttgttagtgccaaaatataagcaagttttggtagtactaccaaatatttagtaaggtaaaattgcatttgatcatatttggtttgctgccaaaatgtaaaattgtagtgaagaatgttatacataatctcaaatctaaattacgtattaccaatgaataggcttccattttcgtgtgtggtgagctagtgggaaagaagatatgaagaggttgccttcagattgtcaattatatagcgtcgttttcactgcaatatatgtgaaatcaatgagatacattattcattagatgtgacaagacgatcacgcgtaggcgtgattcactttatgtcaacaggcagcgtcgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttgcaagtttgtaaggcagaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccgagctgagaggagcctagtacgtcctggtggtctgcaccgtgcaagtcgtcgtcgtagaactggctagtaggaccagtcctaccggcgtgagacgaagaggccccagtaccgaagatcccggctgcatatcctgctggacaaggaccatcagattcgtacaagtatttagcagtagtaataaaaagtaaagtaccgtgtgggcgagggaacgacgctccgtgagaggaagagctggcgaacgcgcccgaagaggtggcgaacggccctgcggagctagcggaagcgccggtcgtgcctgcgaacgcgctcgaaggcagacgaggtcctgcgatgaggaaacgtgcagttaaaacatggtgacactttcgtgcaaaagctgaaacaaaaatgaactaatatcttggctgaactgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttgtcctgcatccggtcgaaggtcgccctctgctcaacgtcagtcaagtgcaaacctctgttcaacctcacctggacagcggtgatatcggcactgatatcccgtgcggcatcagcctatgcaagatggaaataaaaaattcagtagttgtcctattttatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgatgtaattatcataaaaatttcgaaatgaacaatccgaactcacgagtggtcggaaggggggacggtcgtctgcacgttgcccggaaacacctgcctaagtccgaactgtctcatcacacgctgcgggcagtgaggctcaacgaaaatgtcgaacaccatcggcaggatggtcagccagtaatcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctgcacgtgagcgtaacgacgctgcaataaacatgatcggaattagaaatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcttcagggtgcagaaggtccgcctacagttaagaatgaaatgttagtacaaaacactcatccggtcgcaaataatcatgtatgataataacatcttatttacttacagtgaactggagcaaccaagccttgctaggcccgactgtagagtacggaggaagggtgctggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtcttaggtctccagcggtctacaagagcggcaaggagtgaccggtctgcatcccaccgcttcgcagggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcgcacggttcaacagcgccggtgtgtcgtacgccatacctgcatcaaatagattgatcagaaacatataaataattagttcaacataagtaataaatgttcataagcgaattactaacacatattaaacaatagtacaaacaaacaaaagtgtcaccatacggaatatttctgattacaacaataactgcagttacacgatatgagtacttagtccgaacactcatcacgataacattatgatacaacaccgaatagttcacaatactactagtacaacaatagtcggaggtactcattacaacaacattgaattgaaattacacgatagaagtatttagtccgaacactcattacatcacaacagcattttatttcctaaatcgaaagcattgttacaccatcgaatcgcctgctgcgcgacgacgccttggccttgcgcgcctgcttgttgttccttcaccaggtggtcgcctaccatcacttgcctgtccagatggactggcatctgcgccgcttggaacttctgcatttttcgggcattgcttgtaagtatggccgcgcagatcacacttgctgcagcgtaaagtcctcccacctgcttctgactcatccatatcatttctgatgcgtctagtttggcgtcgaccctttttcacccttaacttagatggatcaggaatataaaaaacttgggcactcagcgttgtgtaagatcctgagatcccgaacccatatatttcctcactccatgtatgaaagattgcttctttcctgaaaaaatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgactgaaatttctgatggacgaccctgacctccttctcattgttggtgggtcatcatgtaatgcaccaagaggtatgggaggctcgtcaccttcaacttgtggtctgcgagattgctcgtctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcatatgtgccatacctcatctaaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgtaatgaaactgcccaatgcttcaccgcctccttcatctcatccttatgagcataccttgcaccctcaattacctcgttctccttatactcccagggtacatgatcaccctctgatatgacaagtccagagaagttctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttccatcgatggtccaacaacatcccctgcattgctaggaccctccacatcttcggttcgcattgaaacatttgtatctttctcttgtaccgacacaaatataacgaggggccatgaccgttcaaaagccatttgcacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacattaactgcgttaacctcgcatttctgtactacgccttaagttacattctctacaatattgtcctctaaatttctaaaagtacgttacattctccagatcaaactaaactacatcttacaattaacactactgtctatgtctcaattcatactattatattctatgctctggatctacacatatgtgctaaaatatatggaactaaaactaaaacgcaacatatatactcaatcataacatattagtacaaatgcaaaagatgtatgggagcatacctgtgatgaagtgagcgaaccagcagggcttcgccgctccgcttctgctgccctcccctctctctctttcgttttttctggatttttagtgaatataatgaaatttaacagaggaggggctgggctttataggggggggcccaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttccatgcccccccccgccgcccatttgcaggcg

SEQ ID NO: 14882 - DNA, 2187 bp, Oryza sativa
ggatgccggctcaactacttcccggtctctctccccggtgctggtactgcggaggcggcaacctctcggatggcggcgagttcgggggaacctcctgaccaccctccccctggtccccctcccgacgacgctgccacttcctcccttctcctcagtccgctcccgactcatttggaatgaatgaagccgaggtcagtagcagctgccagtccagcgccatcccactaaggtttgtgagcttatcccaaaatcacaactggagacaggattggatcatagggacgcttatatatatttgtcgacattacaaactattagtgcaataattcttggtgataaatgctcaagggttaagcttatataaattgtagttgcatgaatcatattagcaactcattggcttcctttggatgagttataatctataatgtaccttttggcttattagcttcatttggattttaattatataatgcaagctcattcatctaattagaactttagatgaattctatttatagttagagtaattctacggtccttgaggaggtaccatgaggtaccaaaaatttagtgcaaaatttggtacctcatggtatctcatagtacctaggtaccaaaaggtaccaaatttacaatagaaaaaatggtacctccttaaggaccgtaaaattgctcagttagagcaatatatacggatatactaaaaattagagacaactgaactaagtttttttagcaagaactcaatatgttaacaatcttgtttatgtgcattttacatatcactgtgccgatcgagctttgcatgaaagcttgtgagggtttgtatttaacatacaacaattggcaggagggttggtaagataatgcccaagaatttgtcagttttgtttaggcatgtgaacttttatttgacaggcaaactagatttgtgaaatatactcatctttctattcagtttgatattgtaaatatgcccaggattccaaccttaaagagtgttgattttttttcaggttttggcggcatacatcagaaaactaatgatgtattgtatgcatggttgttagctcttacatgttaatgtaagggttgtttgacaaaaaaatctgtcgcaatgtgagctgggtcagtttgcattttgccaaggtgtgtttggaggctgcagtctctaggcatatgtaagctgtgatgtgaagttctgtgttttatgtattttttttcaacttcttcagggttaaatgtgataatatgtatgactgttattgtggtcaaaactgctcgtcatgggtgcccatgtatagagggaaggttatgccaaaatttttaataaattatggaatttgtgtaattgtgtggtttgctagctcttcatgcttgtgtgtaaaaaagccatttaagcgcctatattaaccagcgatctctctttcctgtataagcgcataagttaactgatgatctctctatatccacataagagcatatattaacgggtacccctaatgggcgatcgatcgccgtagggatggggtagcgatcagattcgctccccacctcccccctccctccctccacctggtttctttttttggcaccgcattactttcctattttaataaatttatacacctaaagtttatgaaactaaagtttacacatctaatgtttagagaccaaaagtttataagtcaaaagtttatatatccgattcaaatttgaatttaaatattttttttatatagtatttttgtacatctaaagtttatagacctaaagtttataagtcaaaagtttatatacccgtttcaaatttgaatttgaattcaaatatccgattcaaatttgaatttgagttgaaatacttttcatatatagtatttctatacatctaaagtttatacacctaaagtttatatacccgattcaaatttgaatttgaattatatctgattcagatttgaatttgaattcaaatattttctgtatatagtatttctatacatctaaagtttatagacccaaagtttataagtcaaaagtttatatacccgattcaaatttgaatttgaatttaaattttttatatatagtattttctacacataaatttttctaacttttgtttttcaaaaaaattttgtgtggtctactgtagtagaaagaggagagaagaggagaaagggg

SEQ ID NO: 14883 - DNA, 7965 bp, Oryza sativa
  unsure (1)..(7965): unsure at all n locations
gtttttgcaaacctttaacgctttgtacactctgcccgttagatgtatatctaatgcacacaggatcgactgataaaaccgaagtttgcaggcacctgcgggataggcggtcacattttatagggatttaatttgtgcattaatttactggaactgaaacgatattatattgagcgaccatacagtagacatactagatagatagcccgatcgaagtagaaaacccgatcgaagcttacatatgcatctatgcacttacacactcaacacacaggaccaagtaataagtatataacattaacgcaaacacacgcgtactcgtttatttagttaggtataggactaggagagtacgcactatagtattacacacatatatatatgcatacagatacagtcgtcgtgcgatcagctcgcctgagctccgtattcagattcagggatcaccatctggcgcctagccatgacggggaggacctggaggtaatactccatcttgtacaccaccgtcagaatctgctcggctggctgctccacgcctctgccgcggccgccgctgcaggatatcaggggtagcgggatcatgctcctttgcggctgctggctgtaccacacgatcatgcgggcgtcgccgaggacttccttgaggttgttcaccatctctctcgtctccgcctcgcgcgttagcccgtacgcctgcgggtgctgcatcaggtcggccacctgctgcgccagctgcttcagccgctgcacatgcccctggttctgcctcgcgctcccggcctcctgcacgataagttcacaggtttgcaccacctccttcgcaagagtgtcgctaacgccgccgccaccactgccctcttctgctgggattgatgctgcgaaccggctgctgcatatgatatttacaattatattccaacatacaaagaaaaacggaactttacttaaattaacagtatttaagtcatgcatgctttcagcgtacttagtacccctccgtcccaaattacagggcgccaagtaaaattaaacttggtagctttgactaataatcatactaactattatgtatgttatatcactatatattcatattttgaagtactttcatctgatgctatttcatatttattatgatcatagaataaaatacaataccgattaaaatatgttattgaaaatcatgtgtaaaaaaatataagccttataatttaggatagatggagcactagttttaagtatacgtgcatctgttcttacccgttcccgtccgcgaggtccttttgtatccatcccaacacccatttcgcgtctgtggacatatcatcacgatgagtcaaacctctgatgtatgagttcagctcatttttcttcctctgaaattagaaacaattattattccagcttctttctgtgcgtgtgtatataaaaacattattattctataaaaatattaatttttgataatcaactcatgaggtcaactatatatttcgaattcttctcaaacttattcaagtatcaccaagtttatatataaaaatatttagtagcatttttaacacaaaacaaacctaatatcagcatatattcatgttagctaattccgtgttttggataatactaaattttcatataaacttagtcaaacttaaaaaaaagtttgacttgaaaaaaaaaactctaagcgacttataatataaaatgaaggtataatacaactttctttttttaaaaaaaagtctattccctctgtctatataaaataaacatatataagctcaagaaaatactaaacatgaaaccaagcacaaaattattaattcagacttagttgagttgagataacgtatggaaacaggtaattaattaatgcacaaactacctccctaagtcccaaagcacaagacgtatctattagcttttatatgacatgcaacatgtatatacataccttgaatattaacttctttcataatatattacaaaaatctaagaaaaatatttttaagtacaaatatatataatggtattacatgcgtgacacaaaatttgtatagtatatattattagcaaaaataagctagaaatgttaatttaaaaataatataagctagagctctatattaatttacctctggcaggttcctgcaagcgccatctccaagtagcatcttaagaacagtcatgaagaaacgatctttgtggatgttaacgatgagcaccatgttggcgacatggaactgctgcaggatgatcgagatccgtttgtccagggcatcgaacttcttggccttcttagagggggccaaacgcttataccagggcttctcgatttggcatgcctcaacgagcaagagcgcgtcgtcgagggcagtttttaggctcctcagcaccccttccgtcgccaggtcgggcgtccactggttatccagctgcgtcaggaggtttcttatgttttggacgtgttcactcagaagagagcactgctccttgcttcgccgagctgaatccaccatctccacgattcgactcgccaggctgaggatcgccgtcaccagcccaacggtctctcccaccatacccatcatgtctaccgatcgcgctccgcgcccgtgacactcctttccaaattaaattcactcagattgcttccaaaataatcacttatatactcctgtggtttgtaacgtaaatgactgtggtttgtaacgtaaatgactgaaatctatccccatgatatactccctagtccctccctttctaaatatttaacgccgttaatttttttaaatatgtttaactattcgtcttataaaaaaaataagtaattattaattatttttctatcatttgattcattgttaaatatactttcatgtatatatataattttacatatttcacaaaatttttgaataagacgaacggtcaaacatatgctaaaaagttaacggtgtcaaatatttggaaacagagggagtacttaactagcattatggcctgcattgtgcagctagtatcattatattttttttatctcacgtaataacatgtatgcatgcgggtgcacgctcgtgtgtgtctgtctataggaaactactacacccaccctgtatacaatttagttaattaaatggtaatttttttaccacctcaaggagcccgcactttcccttatatggattaattgattgaccaatatgcggggagtttttttttatggattgattgaccaatacgcgaggagttttttttttttttttgctggattgattgaccaatattctcggaggttttttttttaatggatggattgaccaatatgtgaggagtaattcttttatttgcatcctttagatagagagtggaagctcttggatagtgaaaaaattactctgttagtgcaagtttaatagtatagccaatacaactattagctccaaatcatttttagccaatctaatagttaatttatataatagttacctataaatatatattacaccattaatatctggtcccacctatcatatatacatagtgttgtggagttcgtgttataactgactacaaatttatagcccgcttcttttctctctcctctcttatcttctccagtagtacttattgtttatgttgtacttgctctaaggtgagggttgagtgttgcattctcctagacgaggctccttcccattaactatatgtggtaacaaaattgcaattcacatgtcaaagtgcagtcaaaaagtttacggttgatctatttttgtccaacccaaacaaatactatacgtgtcgtttttataacaaaagattattaaatgatggttacagaagttatacatgttggtaaaataataactagacgatgaataccgaagttatacgtggttagtaaaatgatcgctgaacggatggatgtgggagtgattcgtgtcagtaaaaaagttactaaaagatatttgcgggaattctgcattggtttcttcagggaaaatcctccgaaactacctatacttaaaaatataggtgaatagctaatacggtccggtccttgaagttatgttttgggcttagttagttcttgatgttttaaattgtccaaataaatcattcaaattaattatttggtataatatattccttagacccataaaaatatcacgtgagcatgctaagtcatcctcgcatgcagcagtacaaatgaaatgaccattgtacccttatataccatttagaaaataaagaaaagacaaacagaaaaaataacatgccagcccaggccaaacattgttgcgaatgggtggccgacaaaggaatttacacgatcagtcataagtgacaattccaaaacgatcatgcacgtgtaaaacatttatcttctttttttttcttttctatatggtatataagggtagaatggtcatttcattcataccgctgcatgcgaggatgacttggtatacttacgtggcatttttttagtccaaggactatattaacccaaatgattaatttggaggacttgtttggacaatttgaaacatcaaggactaaactgagcccgaagtaaaacttcaggggccgtattagatattcacccttatctatagatgaaaatctaatattttttttgctttcatccttattatgtgcatcactttgaagttcgaattaattccttaaggtatagaaaatgtgttgcctctgattaaagatactaaggggagttgaatcttaaggtatcagattttcttgaaaccccttttattttatcagacaagtcaacgtaattagactcgctcatgaaaatacgcagacagttccctgtcaagacataacctcatttccaccggtgggtggcttaaacatgcacctatgaaaatcatttttttacaagcgggcggcttaagctactcgcctatgaaaataaaatttccaaaatttaacacatatatacacataactttttcgtataaaatcatatgaagacaaactttatatcaaaattgtatatctcgtcaagatctataattttgtagttaacaacgtttttcgtttgagatggtttagagatacaaatattcgatctattttataaaatctcagaattatatatgtttcaaataacctccaataaagatgtattaattctatatcaaagttgtagggctcaacactagatctacaacttcctaattgataacattttcatttaagatcatttggaaaggtgaagtcaaaagaacaacatcttaattataaactcttggtagtgtgagatggttaggatatatggatgtgtggacatgagatcttagttgaaatcttatacatcgtatgtgtccatactttgtgaagaaatggtatagctaatgaatattaatttgtgcctactaaaatttaaaatattttttcagttttgttttggcgcaaaataaaatataaaaagtaaaaattcattttgacgggtgggaggcttaaacgaccgtacatgaaaattcacaaacatgcaggctgttcagtcgtgaaattttaacagacagttgctcacaagcggctagccgtttgtgaaaaatgagttttagtcatatgataatcttttatgtaatcatgaactaattaatttaatcttacacgttaggaccatccggatcgtaaaaatgcactccctccgttcatgttataagtcgctttgatttttttcgtagtcaaactattttagtttaactaagtttaaattagcaatattatgatataaaattagcttcattaaatgtaacattgaatatattttgatagcatgtttgtttggtattaaaaatgatactgtatttttctacacatttgatcaaacttaaacaagtttgattaaaaattcaacgtgacttataatatactccctccatctacttttgatagtcatatttcatcttggcacacagatcaagaataagtgattctacttatcatccatttaaacatgctactagtcattcctcgtaaacaaacgatttattaatatttacatttctcgataccaatgtaactaatcttgtgtggaagaatagagagtcacgcattaaatccaagaaagacattaagatgataagttattggattgaaatatacttatcaaaaataaaatttttagatttgaaaatatgactatcaaaagtagatggagggagtaaaatattataaaacggagggagtacacattttatacgtaatatcatcgttcatctgtaaactgatcgagacgacaacaatatagtagagaaggttacttcacgattagaaataatcgaaactattacttacttttactgatcgtaatactctctccatctacttttgatagtcatattcccaaatctgaaaattttatttttaataagcatatttcaatccaacaacttatcatcttaatggctttcttaaatttaatgcgtgcctctccattcttccacacaagattggctatataggcatcgagaaatgtaaatattaatgaatcgcttgtttacgagaaatgactagtagcacgtttaaatagatgataagtagaatcacttgtccttgatccgtgtgacaagatgaaatatgactagtcgcttaccagccttcgaccttgtcagaactcgtagcgatatataggatatagtatagctagctctcccgagcactaaacagatggatgagatctcgtttgcctttgcttctggcaaagcttacaggcagccagcacgggctgcacggtatttattcttgcacgcatagcatacgcctgaaaaacgccaaagcagtccgtgtcgtgcatgtctgttctccgaatgaatcacatatctataaaagattatccctactgagtatacttaattaattactatgcgtttttattaagtcacatcatcgtaattaattatttctataaaagattatccccattgagtatacttaattaattattttttattaagtcacgacaccttaattatttttttgtcctcagataattaatctatttttttcttgcattaagccatatcaccttagttttagttttgttttgaattgaatgatcaatctatatatgacttaaattattataaatacaattataacttttaatcatcaaagatgaaaattatataagtatataaagttatctcatctagctaacttatattttatttctactagaaaagatgcttgtgcgttgtaacgggtaaagtcaatttaatttgtacatatgtgtcggtggataaataattacaatctactgttttgtttattcttgtccgaatcatttataactaagtaaagactattttgtgtgcaaatattttttatgcatgttcttaacgactcgaaagcaaatactataaaataaagtacgataaaaaagccaaaaagtcaaatttaaaattaagttctaaaatttaaaattggcttataagaataagcataagccaaacaatgaggcctttaaacatgagcttgatttgtcgtccaattttatctcaacttaggcaggaattgatgattcgttcatcctttatttcggttggcattttcttttcaaaagtaaataatgattattatggattattgtaacgatatccctgatagtgggatagtacgtatgagcatgtgtggaaactgacttgaaatcatgctaacatgtcctaggaattgtgccgcataatatgaatagaattagatgatctaggcaactatgtacgtgatatccacatggactatgcgagtttcattcgcttggtatccgcatcacacggactctctttcgtagttcgctcatgagtcatgaccttgcaatgaatgttaggcgtgacgggaatccgatacggacaacataccatagttttgacaaaaannnnnnnnnnnnnnnnnnnnnnnnnnnnnnnnnnnnnnnnnnnnnnnnnnnnnnnn

SEQ ID NO: 14884 - DNA, 9321 bp, Oryza sativa
gtatacggaaaatcgcgtgcgcgagggcgttgcaggcccaatcgcggcggcgcgcaaaggcgcgtgtggaaaacagactcgggcacgggcctgattgttgcctgcggcaaggagcgcgtgaaaaggtgcgggcccaattaattcatgcacgtctcggataagagggacactctaacataagaaaaaattaaggaaatgatttgatagaaacataaaactaaaatcgattcaaatacggatgacgtatcataattctagcggaaacaactttaatttctataatactccattccaaattgatctacatatagtttttttgaggttattcctaaatgatctacatatttgtgttcatttattagagtctattcgttatttgtgcattggagtaaatggacattgatgcatgcatccatgcacacaagtatttataacccacatgcaatatcttgatttgctattggctaggaaatattggtgcatgcattgagtttgttgctagagtaaatatagtatgagagagttattagcttttcttggtctttgtgtacctatgaaatatgtagatcaatttggaatggagggagtagtagagataagcatacaaagttttcgccacaacacgtagtgtttcatctagttttcatacagtatcagctaccccattgttaacgaccaaatttggtaagatcgacatcgaggaggaagattagatcgaagtggaatccaagacgaagattatttcagaaacagagcaagaatcggctagagtccaaatcggttatgttcagatcgactgagttcgagttagataaggatagccgatgcagccgattctgacaatatgactcggtatacgtcatcgagttaagttggtgtgctttacggtgattgctacgtaaggatagagtcctaaggaggcgattgtatctattaattaggatattttatgtaatttccttagagatatgtttgggcaaaagtctgccgtaaagacttatgatatcttagagtttgttagagataatagtcgtgtccggtatggacatatcttgtaattctcgagtataaatagatcccgagccctatgtaataattaacacacacgttcaatacaattcggcgcatcgccacctttttttgctttagttttatttcaacgagttcttgcttttgggttgagctgcatcggtttcgatcttcaacaagaggtaaaacttgttatggcggcttgcgttctcgggattagtgcttccatctttatgacactctaatcttgtttatgtaatctgttgagttatcatatattttatataatctctaacaatatcgttatctaacctacaatcgaccagcatctgtcggtagattgcagctgatcaggttagatattgacgtttatttagattatataggatatctaccactctataaaacttccagtggcttgattgtctagatgttgttcttcttttcatacttaatgttgtatcagttgagtttgatctattaagtcgtgcttagaatatcaatttctagcctgccttctggttgccgattagggtagtatcggggtttcagccgatcttacctgatttaactacttttattccatgtgcatgattgacatgttaagtctgccctttacattaagatcttattatatttgagtatattaagcttttgtttgatatattttacttgttttaatatcttaatatagagtggtatcggagtattagccaatacatgctagatctatctgatcggctatgctatgaacatatatagttctattattaacatatatttcgatctaagtgatttatactttctcggcatggcgtccgatctatcccaatcacttgatttaagtatatgtcaatatagggagtatatattgttaatatctacagccgatcgagtagatttagtttttccttatttattcatgattgccgatcgatgcatatatgacatcggctcaaaggtaaatgatatgtcatcggcatctagccgatcggctatcgtttataggattaactgcggtttctttgtctttatttcttgttgattgcaggatcaaatcaactggcacgctcatacacccgaaggcgagttttggacctgcactggagttaagcaaatctcccaggccgccgtgttcgatttccacatcaacacccatgcgcttctatcaagagaagtaaatgctaataagtactgcctccattccaaaataaaaataactttgttttttaataaactgcttgtgtccagatgtggtataacttttttttaccgaatctaggtattttcagctaatcatatgcttaagaaaggaatctctaaataatttaaactttgatcactgaaataactaacaaggaatgtttttccataatctaattaatatttgctaaataacctgtgggaccaataggccttgccagcgcaagtcttcgtccaccctaggtcttcgtccaccctaggtcttcgtctgccctaggtctacgtctattctcgatttagtaagccaggtcttaattggggccactgccagcgacagtcgtaagtccaccctaggtcttcgtcttcttgtcggcaaactgtgcatgtgtacagaaaacgtacggagcttctagataggctgtaagttaaaatgtatacatggaaatttacgactgtgggagggtaaactcctcaagtggaggacagccgaggctccgccgggagtagcggatgagattcgagagcttagtgaatgaagctatgtaatgtagagggggtcgggccccttgggaacgatgagacaaaatgagtttatacgagcggcggacagcctccatggtggcaaggtgtggcctcccctcctcaggtcccgattggtggcgggcagcctaccctcttgctgggctcggtgggtggcagacggcctcaacaacagtgcggcggatgaccttccaatgtcgctacaccagtagctcaaatccatgcgtcctcgtcatcggtttcgttctcttatttccagtgatttttagttcttgatgctaatctgtgcatgtttgatgtctgtgtgttgttagatgaatggatgatggcgtggttgttgatgatgaatgagttcttggatgtggtgctcgggatgcttaagggatgttatcgcttgggatgtgttctctgtgttgatgctttggggatgttgacgtgggtgttggtacgttgatggctgatcgagccgatgcattgatcgagcagtcaagcctttttatgtttgttgcatatgcttcatagaagtcggttgttagatgcttcgtatatgtatatactaggtgattccccgcgttttgctgcgggaattactaagtaattctcaatttgttttacatttaagttaggagtaaaaaaataaaacatcaggatttattagtcaaatgatacccgtgttttaatgtgaaacatatcgataagtatatattaaatattgtaaaagtgatagatagatttatgaaaatattgtgcaaatgatatgaggggtgatgattggatatacttgtattttgatttatagaattaaataaattatagatcatgttgtatgcttgcatgagattaaacatgtaattattgctagtaggtgatgatgtggtatggttgcatgttgagttttaggcttagtgggcattaaccttatagaaagcatatatatgtatgtgtgtgtgtgtataaaagagaatgaagaaaaacataactagttacctagttagaagagaggagaacaatcctataaaaactgactgaaattaatttaaaaatataatagcaaatttgtaccaaaaattgatcaacaaaagctataatcccccctcccctccaaaaaaacactccaaacacttttacgacgtatttattttttatcaaaaggacaggagctataaactaacaaattaaggagaatagaacaaagtctaacatggatcaaagaaagaacattgaggagaaagaaggctaaacttatgtgatactttttaaattacttcattattcatacaatatgcatatgccatttcataaaattttaactctaaaattgacccatatgttagaaactaaataaacaaaaagataaattcaactggaaatattcacacgatagactttttttataaagcaccagagtatataaaaaagagtattgttgacaactaaaatttggctagatatggaaaataacctgagccttctgcatagtgcaagtccgaccaaaggtatacggccgatccgactagcaaccccaagaccgagtccaattaagtctattcttgtgtttacttacttggacccgatgttttttgattcctatttgatctctaaacccaataggatgtggaggaaacttatagatgcaagaccaacacttttataagggttatggctgatttaattctaacccctgaatcctacacttgacaatcaatcgaatcgttgtttttcctttatttttcaaccatattttctactttacattctatagctgcatatagtacctaattcatccatctttgtcaatttatggtgtaaatcatccgtcctcgctacgagagtgcgatacccagcccttgtaggtttgtcctctaaattgatctaaatcattctaaaggctggtttaatctctcattggctccgctagtcgattttcatattttctaaacccatcctaatcgagagcttttctatatcgaggtggttgatgactttgttaacatctcaaatatttaggtgagaccgtgttaattgcaatagtctccaacacaaattgacgacactgttgatcgagattttcagccatccaatatggccaaaatgaatctagaatgttttttgattcctaattgatctctaaacctaataggacgtggagaaaacttgtggacgcaagaccaacccttttataagggttatggctgatttaattctaacccccaaatcctacacttgacaatcaatccaatcgttgtttttcttttatttttcaaccatgttttctactttacattctatagctgcatagcacctaattcatccatctttgtcaatttacggtgtaaatcatccattctcgctacgagagtgcgatacccggcccttgtaggtttgtcctctaaattgatctaaatcattctaaaggctggtttgatctctcattggctccgctagtcgattttcatattttctaaacccatcctaatcgagagtttttctatatcaaggtggttgatgactttgttagcatcacaaatatttaggtgagaccgtgttaattgcaatagtctccaacacaaattgacaacactgttgatcaagattttcagccatccaatatggccaaaatgaatctacaagctgaggaacgagcttagctcggttggaacattcgctgtggtgtgaacggtcggtcgctagttggactcatggggcttcacctcgatgggtttttcccgtcttttcttcggggttgtccttagggtagtctcgactagaaaatagggtacacatgcgtacgcgttcagtagcggtcctgagtgtctctactattataaaaattgaagatgtttttgtcggtacttttggtacgtcatccgtgtatgagtcggttttcatgttcgttcgcttttggaaacataaatccgtatttgagtcagtttttaagttcgttcgcttttagaaatatagaaggaatcgtataagaaatcttttcaaaaaactcgcatgctaacttgagatgatcagactgctgtttgcagcacatgattttctagcaaaatatatatccaagcgaatttaacacagtgaatttcaccttaactaaaccatatctctatctctatctctactattataaaaaataaatatgtttttgccggtattttggtccgtcatctgtgtttgagtcagtttttaagtatgttcgcttttagaaatacagatctgtatttgagtaagattttaagtccgtttgcttttggaaataaaaaaaagtcgtataagaaatcttttttaaaaaaacttgcatgctaatttgagataaatgtcagactcctaactgcttctcatgattttctaaaataaaatatccaagcgaatttccatggtgaatttcaccctagctaaaccgtataacaattacaagattaaaataatatttacccgttgcaatgcacgagtattttttgtagccttaaaaaaatgaatctacaagctgttaccgctgcatatattaatcagatcggcaagatcgtttggttcttgccgctgatctatccgaccgctttcgcggaagccggtctaacctacaccataataccagtccgaccgggatgaccgacaggcagcaggcaatatcaatctgttagtgtatgcgtgtgttcttaccgaggacaataggaaatcagcaaagttaatttttgatcaaattggctacatacaaacatcaagtgtaccaaagaaatgtttctgggctgaggttaatacggctgaaattaatcaagggaggttttctccgactatgacaagtgaagacgagaaggacatgctcaccatggatgactaaatattgaccgaggaggagcgacaagagcttcaaaacaagtggcaaagattgagaaggcaatgctcacaagctttatcaagaccaatcaaagcatctctaaaagagacttccgacctgctacctcgaatcgtcgtctccaaaagtgacgggttgcgactatggtgcattaccgaggcacgaacggatacagaacaagatttaaggagaaactcatctctttcttacttattcagtcctcctactcttctctttctctctattctttctctttcatctctccttctatcaatggtaatccagcgaggtaggaaggactcgagtcccccgcacccacgctggatccgccctgcgaggcaccaactatatgcatgaagcacgtattatacatataggttggaccatcaggtggaggtcagttagaggctggctgggttgacatgtggggccgattggcccatccttaggtcagtcgggcactcttgtgctctgttagtgattacgtttagatgattgtgactttagatggtttggattaactcttgatgtggatcggatagttggtttgagcaaatagtcagggccagccaggcaagaaatggaccatccgagctgcgcaatgtggtcggcctaggtggggggtaaagaaggccgacccatcaccctcttgggggaaatcaaaacggaacgggaacagctcgattgacagaactcaagccaaactgtaccaccttcctcggcccaaggactgtgagtcctctgggccgtagcgaacggcccaagatatcccaaaggggtttggagttttcttctccgaaacccctgttcctctcataccgcctcgccagagcgcctccgtcggtagcacaaacgccactgcaggagcgcaggtgacgccgcaacatctctacatattgatcctcgaggcctccctgcgtcacggtcgccatctgcaaccatcctcttcgcgcacacacgccgcgcggcggtcgcggacgtacgagacgacggaggagcaacacatacagagcgtcggcgtgggctcgtggcgaccgcgcatggccagacatgcagcgcagtggccggagacagttgaggagatgcaaattttgtataaggccctgtttagatcacactctcaaaaaattttcaccctgtaatattgaacgtttaaacatctgcatgcatgaagtattaaatataagctaaaaaaataactaattgcacggattgcgactaatttgcgaggtgaattaatcttttaagcctaattgctatttgatttgacaatatggtgctacagtaaacatttgctaatgacgaattaattaggtttaataaatttgtctcacggtttactgatggattctataattagttttttattagtgtctgaacactccatatgacaccctatataatacccgatgtgacacgccaaaactttacgcccctggatctaaacaccccctaagccttaacattgcgatgagtagggttccccttaccgttttcggcgtagttatcggtccaccgcggtaaggtggataccacggtaactgcgaggtaaccgcgagacattttttttttagaactagggccagaaagcccccatttctcttactagaaatgaaaatatccttactaagtcagaaaggcaaaaccaaagaagaaaaaaaaagctaaaaagcttatccagatgcctcacgggctggatggctagacacgattacatcattctgacatcaaagggataaaacagatcacaaaaaaaaagagaacatcttcatccttctatcctcctgatcccaggtctccatccatgtcttgagcaaaagatatcacttgccatctgtcttatgagtctagctcccaactgttattcagtttgcttccaacttctgcaaagatgcctaggaatccacccaggaacaagccataaagaccaaatcagtaggatctcttggaattttattctcaaagcatgttttattcttggacttccaaattgtccaaatgattgcagctaagccaatcacaatcaagtgtttcatgtttttatcatatctatcaagccagtgtcaaaaagatcatgatgattcaaagttggaattatatccagagcccaacacatgatattccagagtaatttagccaaaggacaatcaaaaacaagtgttgtatatcctcttttttgtcacaaaatggacatttttcatcccccttccttcaaccttttttgtacagatttttccttagtgggaattttgtttttaacaaacaaccaaataaaaattctaattttcagaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaaggggttttccacctatccagctatcttcccaaaacaaagttcttttcccatttcccacttttttgaacaaaatttaaaaaaaatcatcctttacttccatcaac

SEQ ID NO: 14885 - DNA, 15683 bp, Oryza sativa
  unsure (1)..(15683): unsure at all n locations
tggagcgtcacgggcttgttccggtcggaactagttcggggcgtgacacatatattatagaagtaacttataaaagaagaaaataactttaattaatgccttttttcattgaacaaattatctataaatatatatatatatataagagttacttttaaatttgattaaaatacttcctatacattcataatgctctgaagcgattacttttattaattttttttagttaattccataatttgtgctgattaatttaatttctagataaagttatgtttttatctttacaacggatttacttcaaatgacatgctaaagttatcttcgttttgttctaagttacttctataatatatataaattacttttaggttttactgaatttacttttatatatctaagaagtaacttagtgaaatctaaaagtaatttagacatatcataaaagtaatttgtgatttttcatcaaaatataattatgtgagatctcgttgtaaagatttaattgttacgaacacaacggtgtaatcggatcgtagatcggattagtagtttaagagaagattgtatttgaagtataggtggatggtgtctcttatagatgaagtggtagctgatttatcctagctgtgtagttacgtccaatatcaaaatatgtgcttcttcaaacactgaattgcaaagtattatccttcatctcctcggtactatacactgaacaataatactaccaataatgtcacgctgcatcagcatcagtaacatatccatgtcacatacatggggccgtcttggcgtgacaggccgggttcgaaccagatggcacggcctaccttgggagtttctcataaggataattctaccgtcttaagaagatatcagaggtattatattttttatataaaatttaatacctttaaatactaaacttttttaagtataaaaaatttttagtgtaaaatctcgatacctttagatattttctcaagtacataaaatttcttttgtcaaaagggttgggagttttcttctccaaaaccccctttccccctcatgcatgcgcctctccggagcaccgccgcatgctttcagcccctcatctacggcggctgtaaccaaacgaacaccctaccacgaggccacctcctctctacttctttagcacacgagaagaggaagcacctgtttggcatggtgaccccagccgtcggcgactgataacgaaatcgctagttagtgactagtcgcgcgcccttcttcccgcgcggatggacgcgtggcgcgcgtagaagggaagggggcgcggcggccgcgcttagtgggggtccacattggtttttttcgccgttttttgtggggtttcatacggttccttttttatgttttttcttttttttccgtactttcagttttcagttttctttttttttctgtttttcctttctatgtttttttagtttttttaaggaaaaagtacgaattacccccccccccccccggaactattccggtagtacgatttacctcctaaactacaataccggacatttgacaccccaaacacttaaaaccggataaattacaaccctaactcgattcgaacggttttcagcctacgtggcacacacgtggcggtacagtcagcaaaaaaaaacaaataaaacaggtggggcccacctgtcagcatttttttttcactcctctctgaccctctctctcggagaacacagcaagcggagggcgggcgaggagccgaccgacgacgccgacgggcggtcggcggcggggatggcggcggccggcgggcgagcgaggatccgacgccgacgggcggccaacggcggggatgactgcgggcggcaggcgagcaaggagccgacgccgacgggcggtcggcggcatggatggctgcgggcgggcgaggagccgacgccgacgttcggccggcaacggaatggccgaaaaattttggggggggccccccttttttgggccccccccgggagggggggggtttttttgggacgaccccccggggggggggggccccccttaaaagggccgaaagggggaaaagcccccgaacccgaattagaccggggccggccgaccggtggggatggctgcggacggcgggcgggcgagaagccgacgccgacgtgcggccggcggctgcgggcggcggacgaggagacgaggccggaggcgggcgggcgcggagggggctgtgagcaccggtagatgaggttggcgctcgatgaggttgcggcggtagagctcgaggatgctggccatggcggcctcccgctcctcggtctcctcgtcgttcgtgtcgagctccttcaccgcgaacgttgtcctgtgcatgttcctccccatcacgatctccctcgtagtcgaagacccctcccctccgtcctcccccgtatgcccaagcgagcagtcgtcctcgcccctgtccgccgtcgtcgccgcatgccacgctccgctggctctgtgtctgtcacgcccagaaattcacaaataatttccgaacttatttgtgcatgaaatcatcgtccaggaatcagccgaggtacacaaactgacaatttaatatacaaatctatcataataataacgttacatacttacaaaagaaaagaaaacagcagcggaataacggtctagcgatggcttcagctccgctcccacaggcggctcaactggggtataagccaaacgtcttctccttctggatcctttttcttcaactgaggtttgattgattattgcaaggtgagcatataacatactcaacaagccacacagcaaatatgcaagtgcacaaggataccaaaaaatggcataatatagggctcatttgcaaaaacagcatttagcaaacatttgagaattgtaaaacagtagagtaattaatcatcaattttaatcaacaccgaacaacacacccatgctgctcaggcccaaccatcctgaacaaccatacccggctgtacagatctatctccaaaccaggaatgtaccattccaaaccaggagctaatcaaattagcagttatagcattatttattatggtgagaagtgtgggactaatcacaaaagacattgttagacccgcccataaccgcgggcacggctattcgaatagttttactctggccagaggtgtaccactgtatccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgttttacaaccgaaactcgtgaaccggtccttaattttcacaagcatgaccatcaaaaccatgtgctcacaacccaccattatcaagttttaattggcaagtaattaattaaccaatcacgattgaccatcgtgagcttccattaaatatccataagtgatagtgaagcatgatttatcccattagtgagctattgtttctaagcatggctaagcatctattttaagcatctagctgaaccaaaccaatatataaggttctagctaatcaaattataacccataggtaaataaagtcatctccggccataattaaatgggaaaggctcaccacccagtgacattcaaaaataaatgcacagttgaaataaatagagaatttaaatataggatcaacatgctcaaaggaattgtgtttgggatctgtgtgacttgccttgcaataattggtcttcaattatcttcttgaactcttctgacacacacgcgaacctttgaaacgacggaaacgacaagctaacacgcaaaacgaggaaaaatactaataaaaaccaaataaacagaacatataaagtaaacaaacatgtagatcatgattttagatgaattatgagacttaaacggcctcattccgatttcgtatgagttaattacgaattttacaagatttaattccaattaaagcctattaaagaaaagactattccaaattaattaaacaatttacaaatgatttataactgagataaaagattaaaacaacctccggaaatagattggatcatatttgatagatgacatatgttaaaaagaaataatatgccactgaaaaaaaagaatgggtttatatggctgagactaatcttgaccgagtcgaccaagatcggatggcttggattgacctggcaagcgagcctcacgacataccgattgaactacgtgacacgggatcacccaaatgatcaaccgaaaccggcgaacggaaccggcgctatgaacggttctaaactaaaggacgactcaatacggacgaacgaacgaaacacggggaaacacctcgttcaaacaaacgagcgaacaactcaacaacggttgtggctaaaccggtgagctagacacgattcacggtaaagccccggtacggcaaacgataggccggtaggaacctagggatgcacctacggctttacaactcggctaccgggctacggctaaagcggtacacgggtggacacgacacagcagcgacggcaaacggtggctacggtagcgggacggcaacgacttggcacgcacgagcagcagcagcacggctgtagcagggagcggcacagcgacggctaggcagctagcgcagcggcgacgctagggcagcagctagcggcacagcaatacgacaagcggtgcgcacggcagcggcacaagagcggttacggtggcacatatacagcagctgcgcaatggcaacgtacagcggctaaacagcgacgcggcggcaacaaggcgccggcggcagcggcggtgcatacggcagtcggcaagcgacgcggtagcggctgctctagggttagagcaatagcggcggcgacatgaccgagggattgaaacctaacccgagggaacacggatagaagtttcaccgaaccaaagcgattggagagggagagatgacgacggcgacccggcggcaacacacggagacgacgacaacgctagacaaacaacgaattagattagattggattaataccctaggaaaaaatctacaccggtgaacgacataggagcggcggttgccggcgaaccacggcacaataatgcaaacggtgggcaccgggaggaagaggagattgagaggattccattcccgcaactaatttggaaagaggagcaatggggtggccggatttgaaaggaggaggcggcggcaacaggacacgggcacagcagctcggctctggctggaggttgaagatgcactgtagcgaggggatgcaaaacagacttttggctgggcttctattgcacagcctgatagatggagggatgcaaactagaattcggggggataaggccggccgaatagaaggaagaacgggccgaggactaaaggtgaacttttcctatttcggcccgaaaaggaaaagcggattttaattatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagaagttcagcaattatttaaatattaaattaatcattaaatggtctgattataattttgttaagtactttgagtgtccaagtattttcaggatttttcttgaaattatttgagtattggaagtatttttaacaattcaaagatcatttcagtgattattttaattggaaaaagtttttaaatccttccctaagtcgttgggccgatttcggcccaactctttctctctccgcgcggccgaaccggcccaatcggcccagcagccgccccctcctctctctctgtcaaagtctgttttgcctccctccttcaatcgggccgaggaaatgaagcccagccggaaaagtctacttttcctccctctgctactgttcatcttccagctctggacagagcccgagctgccaccttacgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggagcgatttcttgcgggaggagtccgatctcttcaatccaaggctataaataggaccccctagtcctcctctttcgtttgccccctctcccgtcctctcccgtgacccgtggagccgtcgccaccgtgcaagccgccgccgccgtcgcttcttcgtcgccggccgtcatccgtcgtcgttcggcacttcggtgagcaccatcgggttcgtctcgtcgtcctctacgtgtacatgccctccaaatccgcagccagccgctctatctccggcgaggtcgccatcttggttcggccatgggtgatgtcagcatgacgtcatcggtttttctttttctcgtttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgattttagtctttttgctttagtttccgacgttccggaggagagcgttttcgttgagcaaggttcggaagtgtttgcggaagcccaaggcaagtcacacagatcccaaataaccctttgaacatgttgaacccgtttaaagctattattttatttcaactatgcattatttttgaatgtcatcgggtggtgaacctttccccgttaattaatggccgaagatgatcttattttcctatgggttataatttgattagcatgaaccttatataatggattggttcagctaaatgctatatgtaagtttgcttagctatagaaacattagataactaaaggggttaattataaactatattatattattcttattaattatggttatatttaatggtagctcacgatggttaatcgtgtgatgttaattaattgataattaaaacctggttaaggtgggttgtgagcatatggttttgatggttgtgctcatggcaattaaggaccggttcgcgagctactgttgtgagacattaaccgtaccaaccacaagccagcgtgggcaacggctttatcttttgtatagcatgattcattatagtgcgccagactgtgaagtggcgagaagtccatgggggtcgctggggagtccatgccttgtttataagggggtgactatgatccaggaacggtgcactgttttgagttgtgttgtgcaaagggtattgtcacgatttccccctttgcaatgccgtggtggtatttcggggcatagcaacatgtgtggaatcgtgtcttgtgggtacagtggtacacctctggccagagtaaaactattcgaatagccgtgcccgcggttatgggcgggttgagcaatgtttttcgtgattagtctcacacctctcacagtaaatatggatgttaatacttggtaataatttgtttagctcctggtttggagttagatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaagggtccagaaggagaagacgtttggcttataccccagttgagctgcctgtgggagtggagctgaagccatcgctagaccgttaattccgctgttgttttcttttctttgtaagtatgtaacgttattattatgatggatttgtatattaatttgtcagtttgtgtacctcggctgattcctggacgaggatttatgcacaaattagttcggaaattattagtgaatttccgggcgtgacaaattacttttcccaattaaattaatcactgaaatgatctttccattattaaaaatactttcaatgctcaaataattcaaagaaacttcttgaacatacttggacactctaagtatttaacaaaattgaaaccagctcatgcaatgattaatttaatatgtgaataattactgaaatattctttatattattaaaattaggaattgagcttcgaaaaatccgagaaaattccagagagtataattaataatggagaatttaataaaaattaaatccaaccatgctttatatttaggaaattttatttcccacatttaacttcacttgtaaattaatgaacatttaatataaattctattaataatttattaaataatttataaatcctgaaacggaaattcaggctataacagtgtcccacgtcgccgccgcctcctgattccacgcgcctgccggctcttgtgtcccaggtcgggctccgccaccgcgctccgccgaccgcccgcgcccgccccctcgtctcgcgccgccggctcgtctctggcccgttgccaaccgccttgcccccaacgccgcggtccacctgtccgccgctcccttgtctcacgccgccgccatccaccgatgcctccgccgtctagcgcccgcccactcgtctcacaccgccgcttgcccaccgccgggccccgcgcgccgctgtcatccaccgggaggcccccgaggtcgacgtggtcgcggcacgcagccccccggcggctgccgcctcgcctcacctcgatgttgcccgcgctcgctgcctccgccgcgtctgaactctgaaggagaagagagagaaagagtgagggatagaagagagagagagagagaaaaaactgacatgtggggcccacctgttttttaataaataagttgctgactggactaccacgcgtacgccacgtagaccaaaaccaccgcggattgggtcgagggggtaattcgtccggtttgcatagttggggggtgaagaatatccagttttgtggtttaggagagtaattcggacgaccgcgatagttcgggtgtacaaatacaaaccttatatacacaaatacaaactttgtatacgtgtatacaaattttgtatatgcgtatgcaaactttgtatatgcgtatacaaactttttatacgtgtattttttaggttttatacgtacgtatactaactttgtatacaccttttcagttttctctttctgttttagtttttttccagtttctcttttttctccttatttttaagatgtgcgtatgcaaagttttttggttaatttaaccgggttttgggaaaaattaatttttttattttttttgtttgtttcccccttttttaaagggggtttttaaattttttttgggggggtttttttttgtttttaatacgacatatacaaactttgtatacgacgtatacaaacttttgatatatcatatatatatatatatatatatatatatataaacttggtatacgcgtatgtatatatatttttatacatataaaaatatattttttttatagtagtaccagcagtatactaatagtaggtactagtagtaatagtagtagtagatactagtagtagtaatagtatagtagtactactagtggtaattagcagcagcagcaggtgcggaccgcgcgaccagtctggtcgcgcattagctgcccccgactgataagagtacggcgttcttgccacgcccgctcgcatgacagcccggccctgtttcgcaaccgtatgatctcgccggtgtaggttgacatcatgggccgaaaccgaatcaaccccaacggtacggtgaacgaacgaacattaattactttacgagacaatcgtgccggcgagcacgtaagccgcgccgatggcgccctagcttctctagctagttctttaccatatatggattcatgcatggacacggcaagtaattaagttcctgaacaattaaacttgaggtcatcgttgtattcgtgtccttcgtcgatcggcctatatatatatgcaggcgtggcggtgaccacgcgggtggccaccacgggagaagatatatacttctatatacccctgcagcggcatgatcaccgtggcgtacgtgcaggccagtcgccatggcccaaaccagacgagaacgtaaagcaacgtcgtcgatctgtgtgcacccagccggcggccatcaccgacgttcaactgtgttctttcccaattttcctaacacctcctctcgaacatagccttaggctcagagatgctcgccgcaccctgcacgtgccaacggtcataagaaatcctcgagttttaaactcccaaccctttcccacgtgtgcaatacctcatttgatatttgattaatttcgttattacgtaatggaaaaattacaaaaaccaccccataaatcacttgaagtttaacatttcaccccataaatcatcttgttgcaaatacccacccctacttaatttgttgcaaaaaccatcctaatgtgcacacgtacttaatcaaatcaatttgttatcggtgctgtatggttatcacaagctaaactagccaagtaaatattgtccaagcgtttgcattagacttatttttcatatttgattgaacttttttttttcatatagcaaaactcagtgcgacaatgtttaagctctattttgcaattttatttgtggaatctcaccgaaaaatatgaagaacactctagaagtatttaattttggtaaagaccatattaacggctcacactttatgaaatcatattgatttggttaaacatgtgtttattgggatggtttttgcaacaaaactgagtatgtgggtggatatttgcaataaaataacttatagggtggaatgtcaaacttcaagtgacttatggggtggcttttgcaattttcccttacataattaatgcaattaatttaaacaaaacaagccaagcaaaagaagtcgagatcaactacatatatatgcacgcatggttagggaacaataatctccaacagaagtactatatatatatgccggtgtcaccgtgtcacgcgtacgtgttccggtgttcgttcgatgagtccactgtggtgctattcatcggttcactgtttgaatctgccggcgaatgcttgatagaatatggctgtcagagtcgtagatggccgaaccggatatggattttcatctttccagagtaagttctcccattgtttgtatattattttagtagttattaaaaaaatttaaaatgacttaacaatatagactaatataaaatatatcactccatacattcaagaccacattcgacttttacaagttaaaaaaaataaattgaaaatagttatcatatattcgtggctatatgttatttttgttacaactcgcggatattgaatttaacatgcatgttttggggtgatacatttcacataatcacattaatctatctttctaaattatttttttaaaaaaatttaattatttagatgatatatacgaaatgaggatatccctctagctataccccttgttggacgcgaaagcagccgcgcgccgtttgttcacgcggcccagacaccgtcaaagattattttcagcacatctggatggcacatgccgagacttcagagtgctcaccctgaataacctttgcctaatgtgctacacgtgttcagttacaataatcttcaaagatgctagaaagggttcggtgtgtaaaactccgaagcacccatctatatatatatatatatatatatatatggcgccacaaaatttagttagaaacagtcggattgaacttcacaatgattaccaccatttcaaacacaaagttgaccactaatgagccacggcaatatagcaaataagtaacttgattataatacacaatataaattaaatttaagatagaaaactagcgatcacaaaatttacacttaaataaattaaaaattacactgtaattattagtataagtgcagtataattttaatgtaagtacgatgtgtaattataatataagtgaggtgtaagtgcagtgtaattatagtattaaacactaatttctcaatgtaacttttcttatgggccaccatattttttatcaacatgtatttacattataagtccctaaaatttacatatgtaattttaatatattttcactgtaagtcacaaaattacatatataattcgtatgtaattacaatgtaactatagtgtaatttttattacttataactactttgaggaaagaacgagtaccatctttgtggtcagttggtcaaaagcgtgctgctgtaactcatcgatcacacgatagacttcccgccaccgcaccttcattgctcttggagagcactcgcacgaatctcgatacaccgccgcacgcacagacgtccgacgaaggtcgcgtcgcgtgcgcaatatttcaacgcatgtgtgcgatttttgtgcaaggagtccgtacgtgataactgtcagctcatctgtcatctgatccgtatacttgatcgagagatcccatggggttcggagttctcttctccggatcccctcgacacttcgtatccagcggccacgaattacatgcaccctgaacacgaaagcaccgtggcgtggacgcatggtgatcctgttcgcgatcgagcgacgaacgagagacattctcacctcctcgccgcgccctacgcatgcagtcgcagtggcatgaaatgcatcatctatcctgatcgagcagcctcgacagtgccatatctgaatatatatggccatcgccaatcacaccaacaaaatttgacatggacttagtcgtttcgtatctgagttccgtaactctaaaagcatagccatccctctttcgattttatccatctaaacgaaacggaagagctcgactgacagaactcaagtcacgacccgtttgttacaggtcgggttatggaaaaatttatcactccacaaaacatacaagtttaattttaacttatacaagttgtaataaaaatgacaatttttactaatagttagattttaatttgttatttttgttataacttatagaaatcaaacaatctcttcaagaaattgataaagcaaaaaagacatttactataggttggtaatgagaacatgcatggtgggaaacgtaattaaggccaattggtctaaggtttgttctcctgttcagtatggtggcctcgggatttcaaacttggaacaatttgctagagctttttggctagggtggctgtggttcaaatggaggacgccagaaaagtcttggataggaactgaaacaccttgtaatgaattgaataaggatctgtttgtggcatcgacgaaagtccaaattggtgatgaaaaaaaggggagcttctaagaatcaaactggattggtggtcaaagcctaagaagtcaagcgccgaacctctatataggcattctaagaggaaaaaccacactgtccaagatgccctgcaacaaggaaggatggatcaacaacatccgccacagcctcactattcctctccttgatgaattatttaatgtttgggaagttctagcacatgacaccccacaactaacatatggggcataagactcgattgtttggtgatggacaacgatgaggaatatagtgcaaaatccgcgtatcaattccaattcaacagaatggtatagtcgccatcaacaaagttgtcttgggaggcatgggctccagcaaaatgcaagattttcacctggctggtgcatcaaaaccaggtgtggatagctaacctgtttgcagatcaagggatgggcaaataactatttctaccaattatgttttcggaatcttaaactgccgatcaccttttgttcgaatgtccagttntgaagcaaatctggtttggagttctcacttggctgcgacaaaggcgtatcatcctgaattgggcacaaataacaagcgacccggaaacaacaaaacaaaaagggctcatatatctcttcttgctcgtcgcttagaaaatctgaaaggaacgaaactcaagaatcttcagaggaaaagagacgacggtgcaccaaataatcagtcgtatctaagaggaattaggttggtgcggtatagctcgaggaacacgctcgatatatacggattcaacgattgacgtctgtcttcagctgcagtgatcttcagtcttctccggccaagtgtagatggcccgtgtgtgcgcgactggccgagatcaagccagacttcaacccggccttcctgctcagcccaagaatttattacacgtgttttctttacctcaattagttattcttaactcatatctgggccgcacaggtccgatccaacagctgcaggtatcctagaaggggttggagttttggtcatggacacagcgacgatcgaggagatcatcacacgtgtcctgtgtcctctcctctcctctccttacgctcaagcctcgccggcgccggagttcccacgccctggccccgcccctgatccagggaaaacctgatgaaacaagaatgtgcaaagtaaatacttgctccgtcctaaaatataagcatttttagcgtagtgccaagtcaaccattttaaaatttaactattaatagaaaaaataaaaaaaataatcatgtaaaattgatgttattagatttatcattaatcaaactatcataaatgcaactctttttatttaaaatattttatttttatagatattgttggtcaaaatagcatctcaaagcctgtgtggaaatccgaaaatacttatattctagtacggaggggtaaataataaaccaggtttcagatctttgtgtatgaattgtgaccaaacattcgatgcttcaaagaaattgcagacacgaaactatctcccccggaaattaaaatatcagttttaatgaatttcgtcattttctaaaaaaatgggtcaaggtttgtttaaatttaaaatatttcctttccaaaatttctgagatcggaaattaaaatctcagttttaatgaatttagtcattttctaaaaaaatgggtcaagtttgtttaaatttaaaatatttcctttccaaatttctgagatctctgaaatttcgttgcccccggatagaaaggtttgtaaattcatgaaaaaaatactagagataggtgtggatatgaaatacattctcaccaaatgtcaaggctaaactcaactgtcgttatgagtaacaaaaaagacaacttaacttcgttaggagtcacaaaa

SEQ ID NO: 14886 - DNA, 2320 bp, Oryza sativa
atgccatacatcaattgatttatatggataatcaatacatccaaaatagtttacatcgtgtacacaataattacggcatgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtctgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccaaacggtcccctcgccaggaaggcaagttgttggttgatcgactcgttacccatgagatgttgtcgtagccacgcggggaaagtatcaatgtgatgccatgtaatccatgcatcggacttaccgatgttcctggcgcgaactagagccaagtgctcctcgatgtaaggagctaccaatgaagagtgttgcagaatagtgaaatgggctttacggaataaattgttgtctatcgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctgaacgagcacggttacgaacatacttcttcagaacgcccatgtacctctcgaaagaaaacatgttgtgtaggtacataggcccgagaatacggatctctttcccaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctttatatgctggcttccaggcccctttccgaacactactttaagatctttaaccatagcaaacactgttttcccgctgcgatgtttaggcttcgtacagtggtcggccttatgttcgaagtgcttgcctttcttccgtaccgggtggtttgttgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatg

SEQ ID NO: 14887 - DNA, 4382 bp, Oryza sativa
tagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcacttttgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccagtcagcatacatccattgccgatccatctacatgagtcaaaataaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcatctccgatttgtatgtaatcaccaaaataaattcaatagaaattttggcatgacctcccatcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttacgactttagtcccggttggtaagatcccgggggggcctgacatgacctgacagcattcgaaccgggactaaagatgatctttagtcccggttggtaacacaaaccgggactaaagatcaaatatgcccgttacccttttgaaccgggactaaagatcatttttagccacggtttttattgcatccgggactattgtggaaatcggccgatcgacgaaagatggtttctccaccagtgctaccagtatatactgatagtatataaaagggtatgttagaaatttgatagaaaataaaataatactttagtaatttttggttgagatagaatctaattgggagtacccggtcctggatcttatcgtgcactaggggaggagcatcctgagcgtcatttgatgatgaagcacgtggcgatagcacgatttgatgatagaataacgaagaaaagataaaattaccctttcaaactttataccacaatctaattaacaaaaaaaattaaagcaatctacaccgttagatcatatatacttgcagcagtatattgtaccgtaaaagtccgtcaggatgtttgtggacaacgtgtatgttctcagtattggatttttctttttgggacgaaggcatatatatggtggagctgaattactttaatttcaactgcttctactaatacattaattgacgtgcaatctcgcaaaagaaactcgtactgttctgatttccttgccagagtaacacagtgtacatatggtgtatagctgaatatattaatgtacttgtaatgttttgttttccttgctatgtatatgcaggcctgatgacaaactggacgaccagaaccaagagctggccaagagcaaggatacaccagctgatgctgatcatgaaccggtggaagcatcgtcgtcttcctcaccaaggtcgtcgtcggtgccatcgcctccagcagctggttccccaccatacattcacccggaggagcctatcctctcctgatgggagcggcaagaagatggctgtgcaacgcctgagctttgtgtgattgaggtctgaatctttttttttcttttgacatttgattgtctgaatcctccgggcttgtttggcacagctacagctccatctctcctggagctgaagcttagataaacagtttcagctccacttaaaataaaaacaaagttgagtggagcgctctcacaaaagctctatagagatgtggagctgggttttgactactccacaactttcacttcaaactcatctcctgaagctaaattttggagttgaacctctagcaaacaggaccggagaatcagagacatgatcattagtattcactagcaacatgtgtataagctactagtacttttttttttagaacagctactagttctagtttgtgcttgccaacgtattagtatccacatcatagatcgatcattaccactttatcatgttctactacagttagtcgtctttactagtactccctccctcagttttttatattataaattatttaactttttattaagtaaaattgtattaaatttgatcaggtttatagaaaaatttaacatctaaaatatcaaattagttacactaaatataacattgaagatattttaataataaaatttgttttgtattgaaaatactaataaattttcctatgaaattgatcacacttaaaaaagtttgactagaaaaaaagtcaaataacttctaatatgaaacggagtgagtacatactaatgagagctaaagagtacaatgaaaacgaatggaagaaaaaaaaagaaatgaatggaagaaagaaaaaaagagaggagctagtgtctggcggtgacaggggaagtttctgaacctcattggttgcccatattttgaaaaaccattctaattttgaaggatccaaaacggaaaaagtcttgtttgacctttataagactagcccaaaaatgtgaatcccccgctttccaataggcttgagataaaggttgtgatcccaaatatttatagcgtaatagttgttgctatattccatcggtgataaagtagtttgtataaccacttactaatcaacactttattctttacctcgaggtcatgaattcctagccctcctgttcttagggacgacaaataatgtcccacttagcaagtcggtatttcttcttatatccatctccttgccaataaaacctagatcaaaggtaattaagttttttaagtaccccactagggattgcaaggaatgacatcatatacattatacattagaagactgctaagtactgagttaatcaaagtaagtcgtcctcccaacgaaagaagttttcttttccagctacttaatttcctctcaaatctctagactacttctttctattccgtatttctcaacttcctataattgatcgaaatgtcaagataacggaatgggaagttgccgacctagcagccaaaaagttggttgtattgatcactatattcaagtgcttcacaaaaaggaggactgcatggcggatcctggtcactggtctttaggacctgctttatcaagaattaaaaactttctgcagggaagggaagttcacatcaaatggatccccagagatctcaacaaagttgcagatgatttggcaaaatcggcaagacaagctcaacctagcagtcgcttggcttgactgttctaatgtttctcatatttgccaaagggatatgtgccctgttaaaagaggcattatcaatgctccaaagggagatgcaactgtaactcaatgctatatgtttctaaactctgtttttaattaataaaatgtatgagttctaaaaagaaaaaaagaaaaaaagaaaaggctttaaggcatcccactcgtttcatc

SEQ ID NO: 14888 - DNA, 1627 bp, Oryza sativa
actattcttctaaaacattaactaaaaaaaagtggtacagaaataaaggttgctataccaagttcaggtgtattgttgcacttgaaagaatgttgttgctgtgagctaaacacttctaaggtactgttatccatggacgaaactggcatatccacactttctaccgatggaacgtgtggatcaataacaacttggatgccttcaagttgtcctgaagaaagtttagagaaaatctaccttttgaactgataaaacacaagatatgtgcaatagaaagaaaagaccaactaccatggtgcatcaagttcttgtccaaagtgtctggctggaatctatatggcacaccaatgtctgataatccaacagatccatcataggttgatgaaatttgcggatgcattccttgcacatcaagttgttctgtgagattttgaagaatcaagaactaatcaagaagcatttaacagaaactaattccagcagcaaattatgatgattggatattgggagcactcaaattactcaagagagggcaggtcgaacctaccttgtagtgtatggcttggttgcattgagaatgattcctgaaggcaatagctgtcatttcttatagaaagagcctcatgttcatgagacacactgctctctttaaggcaactagagtaaactcctggtctacatttctgagcatgagcaatgatcaaatcccaatcttggtcggaaatcttccccaaaatctacatagggtgatattaaaaaaactatcagtaacattgcatagataataaattagctagcaaaataacaatgttaataatcaatctcatactttacgcagatcatattcgctattattgtagaaagataagaagtcctccactgtcttgataccattctgctctagtaacttgtgcctgtcaccgttctttgcaattttactcaatttatatacagcatcacgtggggatggattgggattcttctttgttactgcagataaagacatttgatgtagtcaccctggattaggatagtttgacttggaacaatactcttatctataaacttggtcgaacataggatagttttacttaggataaaaccagagataccccgtgtgaatgcatgggttgtggattaagttgttctgttcttaagtatttaaacagtatgaagcttacatatatatagattatgtaacataaatagcctgtgtgaatgcatgggttatggattagtagtcataatagttaaattgttcttactactcatctgcttgccccttccctaaatgttaatggatgtactaatgctagaatagaatggcacgcgtgaactcacagtatccccgaacatccttcacggcaaaagattcagttactccttcttgaattcttactgagattctttcatcagctgccataacccccaacttgaactttctgcttggaacaaaactagaattgtcttggaatttggcactattgagataacccacaccattttgcagtctaaaatacagcttcccagacagcaaatggcctttatgaggtcgtccaggtactattttactatggaaatactctttagtccactgtcccttgttatcatcgtcaaagtcaccgtc

SEQ ID NO: 14889 - DNA, 1278 bp, Oryza sativa
gaatttggcactattgagataacccacaccattgtgcagtctaaaatacagcttcccagacagcaaatggcctttatgaggtcgtccaggtactattttactatggaaatactctttagtccactgtcccttgttatcatcgtcaaagtcaccgtcaatggctacaatatgaactctcatcgaagaaaatggttccattgttacgatcttgtcgttatgatcatatatggctacctgaagggggttctcatcatctgcttctattttgtgtgttgagtacttatcgttactgcatgaatttacaaattgtaatcgaagtggcacggtgcagttctgatcagaatcatcagataacatcctgaaaaatagtgcaaagaaatcaaacacataatgatactaactttaatttatggcagttattatgtgttctcccaagaaacaaagagatataacaacgatacatatatcttatgcacatggaataggcgtactgttcctttctctcaactcttggcttggctactttctcaagaaaaaagatacttgttttttttcccacatacaccaacaaatttttataagagcaacttggcttaatttttgtccctcaactctaaaattggacaacatttttctctgaactctcaaattattaaaaggaaaaagtcagttttactcccctcaagtatgaccctggagcaaataaccccctaacctttaatttggtttacttaaccccctaggttcttaaaaccggatcactattcacctttctaatctaatacaatccgctttgctgatgtggcacatggattaggtggttttgcttactaggttggatctaacgtggagaaagagaacccaggagattaatcacacgtcgtattctcctccatgcgttggactcttctccctcacaagtcctctcatcatctcctctctcccttccgacggcggagaatccaggtgatgatcgtcgcagataggcggtgctgatccgtgagatcgcagccccgtggtgcgtccctccccctccctcccttcctccctccctcctccccactccatcttggcatgctttaggtttagggttgttctagaaggggataataagtgcgtgtggcagttggttgatgaaatttttttggttgatttcgttggtggtagggcactactgagggttaggttgttgctatcccttgctgtttttttttcttgcgagctcattatccatcgtcagatgccggcgctcggcgtgtgcgtcttgaagccgtcgcg

SEQ ID NO: 14890 - DNA, 2771 bp, Oryza sativa
ctgtataagggactgttttttggttgatttttattttatcttgggatgagttgtttatgatttggtagataattgctgcttgattaatgtttcattttttaagataagtttactgatgatctcattgttgccatgttaggtgtaatggataatttggatgtactttgtatccggtttcactttggtggggaatttgattatgatggatattctgtggtttataatggtggtcaaactgagatgtcatacatagagagggacaaggtggcattgccagagatcaaaggataccttggagaccatgttttactaagtgaagaagatgaagtgattttccattggttatttccaggtgctgaactaaacaatggcctgaaagcactatcagatgataaggaatgcttatatatggctcaatgcataatcatgggtgatgtaagctgaaatatatgctgaaatactcaagcacaatgaagatgataatgttgtgcttagcaatggtgtcagtgatgacagtgatgttgaagatgacattgaggaagaatatgacagtcatagtgatgctgaagattctagtgaaacagatggtattgctgaagatgatgaggagagatctgaagatgatgaggaagcacaagaaaatagacagcatgccaacaaggttaagaagaatccatgtgccactattactgtaaccagtgacaacgctgttcttgtcagtgacccaccaaataaacaagatgataagggactggatgatgacactgatacaccatttctggactcaagtgaagaagcctcttatgatgatgcagaagatggtgaagcaataagaaggaagagtagatttccaaagtatgatagcaaagcacacacacctaagtttgaaataggcatgacatttgcaggaagagcaaagtttaaggaagcagtaatcaagtatggtcttgtaaccaacaggcatatcagattccccaaggatgaagctaagaagatcagagctagatgttcatggaaagattgtccatggttcatatttgcctcaaatggaacaaactgtgattggtttcaggtgaaaaccttcaatgatgtgcacaattgccttaagagaagagataacagattggttactagccgaagaattgctgataagtacgagcacatcatcaagtctaatccatcatggaaactgcaaagtttgaagaagacagtgaggctggatatgtttgctgatgtgtccatctcgaaagttaagagagctaagggtattgtcatgagaaggatttatgatgcatgcagaggtgagtactctaaagtgtttgagtaccaagcagaaattcttaggagtaatcctggtagcacggtggctatttgtttggatcatgaatacaattggccggttttccagagaatgtatgtatgttttgatgcttgcaagaaaggttttttagctggatgcagaaaagttataggactagatggttgttttttcaaaggtgcttgcaatggtgagctgctatgtgcattaggaagagaccccaacaaccaaatgtatccaatagcatgggcagtagtcgagaaagagaaaagacacttggagttggtttattggactacttcaaaaagatctgaatattgatcctcatggagctggttgggttattatttctgagcaacaaaaggtaatgcatccttgatatctacttatttttatatgatcaacaaaaatacatgaatattgatcctcatgtgttttgtttaccaatgtagggacttgtaagtgcagttgaggaatttttgccacaaattgagcacaggatgtgcactagacacatctatgctaattggaggaagaagtatagggatcaagcattccagaagccattttggaagtgtgccaaggcatcttgtagaccatttttcaacttttgtagagccaagcttgcacagctaactcctgctggtgccaaggacatgatgagcactgaacctatgcactggagtagagcttggtttaggatagggtccaattgtgatagtgtagacaacaatatgtgtgagagcttcaataattggataattgacatcagggcacatccaatcatatctatgtttgagggcataaggaccaaggtttatgtgaggatacaacagaacaagagcaaagcaaaaggatggctaggtaggatatgtccaaatatcttgaagaagttgaacaagtacattgacttatctggaaactgtgaagccatttggaatggaaaagatggatttgaggtcactgataaggataagagatacacaattgaccttgagaagagaacatgttcctgtaggtattggcaattggcaggtattccttgtgcacatgctataactgcattatttgtgagctcaaagcaacctgaagattacatagcagattgctacagtgttgaggtgtataacaaaatatatgaccattgcatgatgccaatggagggtatgatgcagtggccaattactagtcatccaaagccaggaccaccaggttatgtcaagatgccaggaaggccacggaaagagaggaggagggatccattggaagtaaaaaaagggaagaagttatccaaaactgacactaaaggaagatgtagccagtgcaagcaaactacccataacattagaacatgtccgatgaaaggaaattcaggaaaaaagatatcagtacaagagagagcaagagaggcaagtaatttacatgctacatatataagtggttgagtattgac

SEQ ID NO: 14891 - DNA, 851 bp, Oryza sativa
aagaagtgaagatttggttgcatatggctgtaggaataagtcttggctggttggtcttggtcttgtggtgccttttcctgcttttcagctttctaggacagcatctctactttcagtttggatgctctaggacagttaggacagcagtttgttgagatgctctaggacagtttgttgggatgctctgctctaggacagtttgttgggatgctctaggacagcaccctcttagactagcatggctgcatggctcttagactagcatggctgctacaagcagctataaatatgtatccaatcctctttgggaggatatggcttttgtgctttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcaccggttgctcctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagct

SEQ ID NO: 14892 - DNA, 2049 bp, Oryza sativa
  unsure (1)..(2049): unsure at all n locations
cgacaaggctgatgggtggtacctcgacaccggcgccacccatcacatgaccggccgacgggagttcttcaccgagttcgactccagcgtccgaggctccgtcaagttcggggacacctacggcgtggagatcaagggtgttggctccgtcaccttcaccgccaagtccggtgagcacaggctgctcaccagagtctactacatccccgcgttgaggaattctatcatcagcgtgggacagctggatgagaacggctcacgcgtgttggtcgaggacggactcatgaggatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgcctcgaccacgtggagcagctctgcgacgtctgcgtggtgacgaagcagcggcggctcccctttccccagcagacgagcttccgagccaaggagcggctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacggcggctgaattcgtgtcgtactgcgctgatgagggcattcagcgccactacaccgcgccgtacagcccacagcagaacggcgtcgtcgagcggcgcaaccagacggttgtggggatggctcgggccctcctcaagcagagggggatgctggccatcttctggggggaggcggtggtgacggccacctacatcctcaaccgctcgcctaccaaggccctcgatggtaggacaccgtacgaggcttggcatggcgcaagccggcggtctcccacctgcgggtcttcggctgcctcgcgttcgccaaggagcttggccacatcggcaagctcgacgacaggagcaccccaggggtgttcatcggctacgcggagggctcgaagacctaccgcatcctcgacccggagacacagcgtgtgcgcattgcgcgcgatgttgtgttcgacgaagggcgagggtgggtatgggacaaggcggtggatgatggttcgactccgacgtacgacgacttcaccatcgagtacgtccacttcgagggagctgggggagtaggcagctcttctcaccgagcgtgcctaccccagtccccgagcctccaccgactccgacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggggttcgttactccgctctcccacgacgaggagcgcatcgacgcgtaccatgatggcgagcagctacggtaccgtacgatggaggatcttctcggcgaccagccggtgccgggactggtgcctcgcaacctggaggcgcagttgcaccttgcgtgcgacgacggtgagcctcggtcctttgcaaaggccgagaaacacgcggcatggcgtgccacgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacccggtttcgtgcagcaggaggggatcgactacgacgatgccttcgctcccgtggnnnnnnnnnnnnnnnnnnnnnnnnnnnnnnnnnnnnnnnnnnnnnnnnnnn

SEQ ID NO: 14893 - DNA, 1486 bp, Oryza sativa
ggcacgtctactccgacgccagctcgtgttgagcgcagcccggtggggttcgttactccgctctcccacgacgaggagcgcatcgacgcgtacatgatggcgagcagctacggtaccgtacgatggaggatcttctcgcggaccagccggtgccgggactggtgcctcgcaacctgaaggcgcagttgcaccttgcgtgcgacgacggtgagcctcggtcctttgcaaaggccgagaaacacgcggcatggcgtgccacgatgcagtcggagatggacgcggttcagaagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtctgtgcgactcctccttgcgctggctgctcaggaaggctggggcgtccatcacatggacgtcaagtcggcgttcctaaacggcgacttgaaggaggaggtctacgtgcaccagccgccgggatttgtgattctcggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcattcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctgacaaggcacacttcgtcgggtacagcgacagcgaccacgccggcgacattgacaccagcaagagcacgagcgggattctcttcttcctcggcgagtgcctcgttagctggcagtcaatcaagcagcaagtggtggccctgtccagctgcgaggccgagtacatggcggcatccgccgcttcgacccaggcgctatggcttgctcgactgcttagtgatctcctcgg

SEQ ID NO: 14894 - DNA, 3738 bp, Oryza sativa
aaccccttgggaggatcaagttccttgagctttgctcccggatcgggatggctcaactttcccacaagacggcgcacaagacttagggggagaatgtaggaataagtcttggttggttggtcttggtcttgtggtgccttttcctgcttttcagctttctaggacagcatctctactttcagtttggatgctctaggacagttaggacagcagtttgttgagatgctctaggacagtttgttgggatgctctgctctaggacagtttgttgggatgctctaggacagcaccctcttagactagcatggctgcatggctcttagactagcatggctgctacaagcagctataaatatgtatccaatcctctttgggaggatatggcttttgtgcttgtagggtataggaaaataccacgagttagaaaaaacaaaaataaaagaggtctaactaatagcacatttttcgagaacatgtgggagccttggttatcatttcactgagagagccttgctgtggtcttcaaaattcaatcattttcgtcattagatatctagtggaactccatggcaaaggttaagccagcaagcaagctgaaccctttgatcatgtaaatcctccaatcggcaagcaagccaattataaaactttaaagaaagaagagcggctacatagataaattaagatcatcatggttgttaaacccatagtgatgacagcatgtgcaacaccatcgcgatttttggctagtaaattccaaccctctccctaactccatcaactttgcaacagaaatgcaaatgtttggccttttgcatatgctttaagtatataatcttcttttctttttaatgactcgggattatgacttccaagtataaaatctcaattcaattgaaaacctatgtgacaaaaggaaaacaaagcaaaacaaagaaagatgcaaccacagtgtttactagttctttaccacacatttcatagttatattcaatttgaaattagtaaatggaattgtatattgcaacagaaataaaaattactgtttacactgcgtaagtttataggtgtaaatataacatatatgatacgacaaaatgaaaaactgaatgaaatgtgcttcttcatttataaataatgcaacatcatagcattagttaaaatagcacaattttttataacaattcatagctcaaagtttcaacattgcaggtatgttgtaatacgattcgatctatgtacaattcaaaatcttaatgtaaacagaatgtgttaacacaaacattaccaacctactaggtgcagcgatttgctgatggtaaccaccaaatccacttcttacctgacaatagagtttaaaggcattactttcaagtcgtaaaatgcaaattcatttgcaacaataatggaaccaattctgagaaaacccaataatgaaaatatcttaagtacgaggtagttcgttaacccattggctcctgtcctttattctgaaatcatgcacatgcgtgcatattgccacttaagcactgagcatatacataatattctccaacaaactatttttggggatcccaacatatatccatatcgggcagaaactcttttgtgtcgagttttttctttttaagattgaaaagtgaatggttttgaaagttcaagattgtatggtgtctgatattaaagtgtggtttgatgtggaagttcaagtccatgagataaaattcttcgtattggaaatcaagctgtgcaaacatttcatcccaaccatgaagactgaagcatgcagcttttgctctttgggactgaaacacaaattaagctcttaccgctgtaaggctggaaactttttcaacgagctcttgaatctccctaaacagataatccatcctctcgttttgttgctgtgtcattcgtagtatctcctggagcatgtatgtctgcttgtcactgtcatgcacacgaagaaaataattaagctcggtttttttcaatactttcttctatggaaactaggtgtatctactgtaatgtgtagtctggtaccctctctaaattattattttgttttcgataaatcaaacgtagattataaattactccctccgtttcacaatgtaagtcattctagtatttcccacattcatatttatcaatatgaatgtaggaaatactagaatgacttatactgtgaaacagagaaagtaccagttttctcaagtggcaactccctacgcacagatgaggggagagagtaagagagaggatttatttgttaactcaaatggtaggcagaacaactaaaggtggcatttcaaatcccaccgagacaagttgctggtcagctcgtctcattagtcgactaattattacagtataatttctctaataacattttctttatttattagaaaaccttttcaagttatttgttagttttataatatataataattaatccatgtattaatcatccggctaatcagctcacccagccattttatcttttagattgggtcaatttcattggtttgcccacaaataattgtcataaattcagtttcatctataaatttctgatttcagactaatcaaggggggagaagaaattatatcaacaagcagcatagcacataaacaaaaggatttgtgaatagatagaagtatagaacaaaatactgcaaaaggtcaaacataaatggatcaagatagtagaagttagctcactcgaaaccacaggagcttcgtggtcgcttcgccggcggtgatccgcgtgatccttcgtcccctttgccatccttctcctcacgatcctgaggccaggccacaggcatcgcccacggagacactgggggagaaggaattaaagaattaatgttgccttccagtgtagtccggaggccggaacaagaatactggagtagactatatgggacctgacgaagatacctttttgtttctttgaatagcgagggcaggaatactcgtgtaatcttccttctgacacacggcttccatagattatttttctttgacaaaacacagcattgatagctctgtttacttttaaatcaatccagtctctattatttttggagagatcagcatagtttcttcataatataagcatgaatgttctgtgaaacttcagtcagttgacatcaggatagcactcccaaatcaacatggagcaggtaggtatagtgtgcgttcgattccctgtgtaatctatggggtcaaaacatggctcctattatttcctaagcaaaagttgaaagaaggaaaactaaagaaaccgagtctaggtactttattgtctaacagatcatttccagatgaagcttccgtttcagcttccaacgaatgcaccaaagtctatctactatcccactggaatccaatgcgtaaccctaatatatttccaatgatcttggtgggttcagaacttacgattttgctggtgcagatcaagcatatgtgcaaacaaaagacgagactgtgtttgggttgtgcgagactttcggatggagacaagacaaccgcatctctgcctttgcggcatttctccgaacacctctgcggcgcttgtctcatctttggactcctcatctcgcatatcaggcgcatcctcaaactggtaagcagagcggtgggaaaacgagacggagttggcggcgagcttgatctcgcgccgaccgttgtcgcacccgccattgctgcgccagcggctgcggcagg

SEQ ID NO: 14895 - DNA, 708 bp, Oryza sativa
  unsure (1)..(708): unsure at all n locations
ttgttacacgctccacaaattctctcttgcattctctgtgttcgtgcgctccaggtgttcgtcgagggttctcgtgcccagtttcgcgtgtgttagttcttgtgctgatcaagtggacgctaacaactaatgctctggcgtggcgagcagggttcactttatcggtttagctcatttgatcggaggtcaccgaaatcctgaatttttggtctgaaatttttaaaattttgaacacaatttagttgaatttgaacaaatattaccaaaattcatgaaaaatttgaaaaatttcggccgaagtaatatcgtatcggagtggaccgaaatttcggaccctgtggcgagcaacaggtgatatatttatcataatatatttttttgcggggaaagagaatgctttattgattactcatcagtgtgattacaatcatttgccagagccccaaagacacaagagggagcctgcatacgccaaacagctgaatggttcgtacacatggcaaaattagctagatcatgggctactctattgcattctcttctaatcttctgaacacggaaatcaggcagagcttggagtaataacttaatactccctccgtattttaatatatgacgccgttgacttttcgaccaacgtttgaccattcgttnnnnnnnnnnnnnnnnnnnnnnnnnnnnnnnnnnnnnnnnnnnnnnnnnnnnnnn

SEQ ID NO: 14896 - DNA, 1193 bp, Oryza sativa
ctcacaacggcgacgaacaacttttctcttgacagaaagattggtcaaggcgccttcgctacggtgtacatgggtaggcttcccgacggacgcgaggtggccatcgaacgcacgctcgaaacatccggcatagggaaaatagacatcatgagagagctcagtatcctccgctccattagccaccagcacatcgtccgcgtctttggcagctgtgtgaaggagaagcgccagctcctgccaccgtttcggaaaaaggaggaagagatcctactcgtcctcgagtatattgagaacgacacccttgacaaacacctgcacggcccacggtcgtcgtcgccggtgatgacgtcctggaagacgcgcatcgagatactgctaggtgtgtcgagggccatcgagtacatgcagtcctacggtgagcggccggtgatccaccgtgacgtcaagccgtccaacatcctgctcgatgcgagctgggcgccgcacttgacggacttcctttgggcgctcacatgggaaggcccaggccatcaggagaatattattggcacctatggatacttggccccggagtgcgttatagcaggcactctaaacccgacagtcgatgtctacagtttgggtggtgggatgctggaggtattgacggggaaaaaaccatatttctctaaagaagaatgggaaaaggagaagacagaagaacgtgtggaaggaggagaagagagaaaaatgtgagcaagatggaaagaacacagaagaggacaaggaggagagtgaacgagaagaagaggagaagacaacagaagaacaacatgagtggcaaaagcgggacgggtggtctagtggtcacagcttggcgtctttaacgccactgattgaggcgggggaggtgtggaaggtgctggacaggcggccggcagcggagccaacggcgaggcagctggaggcggcggaactggtggcgcagacggcagctcgctgcctgcggctgcggtgggaggagcgtccagccatttcggaagtcgtggccaatctagagaaggcgctcgagctcgtccgttgcgacgggtaggcggtagcatagcgtgggctcccgagacatcttatgtgaataattgggcaatgtatattctcatcatgtaataattaacgctgttgcttctcttctcttttttttttgtgcgcatacacaa

SEQ ID NO: 14897 - DNA, 7217 bp, Oryza sativa
cgctgccactatacatcctctatgacccatctgccgcctactttttattgtcattgggactctaaaaatcgaatataactatcgttggaatttaatttttacttatagaagtcccaccaaccatcgacgggtctgccattgtactcctgtacgacccgcccgctgcctctcatttttgttgtcattgagattttaaaaattaaatatgattatcattggggtttattttttttattttctagatgttccgtcaaccgccttgaccgattgcttcacgacctgcacgtcgtcctttcttttaatcgtcattaggattttatttagtgttttgttaatagtttttagatgttacatcaaccgccaccactctatttctttatattcatgttatttaattaatatcgtcatgtgttttagattactctgatgattaaaaaaagtcataattccaataattgaacttcccatggtaatgtactaatatgtgctaacctcactgtttatttaatgtaggtttagagagtaatatatgacatgctaagctgctatgatctcattgatgtcctaattgggtttagtcaataagatggatgcgtccaacacctcgcacgcatgtgttattgtcgtttgtttttcatgtgtgcacgcatcatattgtcatgggtatggcgcatgagacagacacggatgctagttttacacgtgattaccaaattataccacaaacaaatacaactcagttaccgatttacgacttaatctatctatctatcaactccatccgtttcagaatgtaagtcattctagcatttcccatatttatattgatgttagtgaatctagacatatatatctatctagattcattaacattaatatgaatgtggaaagtgctagaatgacttacactgtgaaacggaggaagtattatctatctatctatctatctattatattattaaaacagctttgaaaagaagcaccactttcactgtggaggctagaaattccaacattaatcggagaaaaagaaaaaaaaaagaaaaggagagtacaagtagaaatacaatctaaaaatagctgaaattcagaattaaaaataagctatattgaaagaagtttccatataagaacccaatacgagattaatcaaatttcgaaatagaataaaatccaaaattagaaaaggaaaggagagtccgagtagaaatacaattttaaaatagctgaaattcggaattaaaaatatgcaatattgaaagaagagtccatataagaacccaatatgagattaatcaaaattgggaataaaaataaaaataaaatatgaaattagcaaaaataaaaaagaagagtccaagtatgaatacaatttaaaactaactgaaattcagaattaaaaataagaaatattgaaagaagagcccatatcagaaccaatacgagattaattaatattaatttggaataaaaataaaaataaagtctgaaattagcaaaaagaaaagaagagttcaagtaggaatacaatttaaaattaactgaaattcggaattaaaaataagcaatattaaaagaagaatctatataagaactcaatacgagattaactaatatttagaataaataataaaataatattcaaaataagaaaaactaaaagagagttcaagtaggaaaacaattttgaaacaactgaaattcaaaaaaaaagaacactatacggtattaattaaaatttgaatttttttctaaaattagaaaaagaaaaaaattcaattaggaatacaatttataaataactaaaattagtgataaaaaataaagactgttgaaagaaaaggctatctaaaacacatgacgagataaattaagtaacatgcatataaaggagtagagtaacagcggcgtataaaaactgttaataaaacacaaaatagaatcctaatgacgattaaaaggagggacagcaggtaggccgtgaagcaaacaggtaaggcggttgtcgggacttctagaatgtaaaaaaataaaccctattgataatcatattcaatttttaaaatctcaatgacagtaaaaaggagaagcagcggacggggtgtataggagtatagttgtatagccgccgacggttggtggaacttctagaaaataaaaaatgaattatgaattccaacgatagttatatttgatttttagaatcccaatgacaataaagtgtaggcagcgaatggactttagaggagtacagtggcatcatttgacgggacttctaaatattataaaaaataaaacccaacaagacaataaactctaaaacctacaaggttcattttttaaaggttcggaacttctaaaaagtaaaaaaaaaaccaatgataatcatgttcgattttaaaatctcaatgacaaatggaccgtagagtagtatagtggcatcgtttgacgggacttctaaatattataaaaattgaaacccaacaatacaataaattctaaaatctacaaggtccattttttaaaggttcggaacttctaaaaagtaaaaaaaaaacccaatgataatcatgttcgattttaaaatctcaatgacaataaataagggaggcagcgggcgagccataaaggagtacaatggcaaagccaccaacggtttggcgggacttctagaaagtaaaaagttgaactcgaacgataattatgttcgatttttaaaatcccaatgacaattaaagagaaaaaatagtgaacgggccgtagaggagtataatgatagtgtttgacggaacttctataaattataaaaatgaaacccaacgagacaataaactctaaaaactataaactataagatccaatctttaaaggtttcaaaaagaataaatagaaatagtggtagatcgagtaagcaaataaagaacaatatgatagaagtaaggggtaacagctggtgtgactttttaaaactatataattagaaatacggggataataaggtttggttttcaaaatcttaagataaccagatagctatttaataaattttaagcaaaatcatactgaaaagggattgcctacacatttgtcgggtgatttttaacaagaaatcacccagattttttttacacttagatttatatccaacggactataaaataaaataactaatacaaatttgcttattcaatatttttatcaaaattatagtgcacttacatatcatatcaactaaatttacatgtgtaattttagttatatagaactgtaattttatattttaaatacttacatgtcatatcaactgaatttacaaatgtaattttagttatataggactgtaattttatattttaaagaaaataacaaatacatatttacttacactttatttttataaaaattacagtgcacttacatgtcatatcaactgaatttacaaatgtaattttagttctataggactgtaattttatattttaaaaaaaataacaaatacatatttacttacactttagttttatcaaaattacagtgcacttacgtatcatatcaactgaatttacaaatataattttagttagtgtaattacatacaagttgcagtgtaattacactatgagtgtattgtaattacatctgtgaaatttctagaaaaaaatttatcggcaaatatatatataaaaaattgaatagaataggtttctagcgatggtagatttgttaggcatggccgcatggtggtgtaatctagtgtgggatcctagctttggcttggttcagatttatgcacaagattcaagtgcagagaaggtcgtcccgtccggcgatcgtctccactcatcatgcccaaagggacgagcacagtgcgaacaagatcatcccgaccggctgaccacgcatgcagcctccaccatcgtgcggtcagcaaatccgtaaatcctggagaagatcacactcaatttctcccttaaaaagggcccccggggtaaaaaaaaaaaattttttcacccgggggttaaaaaaacctttttgggaaaaaaaaaaaaaaaataatttaattggaatgtcttggttataaggggtcgctagccgcgcaattgcgtgggccacccagctagttagcttaatcagcaggaaaattagatctctattctattctcgtagagttgtattacctataaaaccttttctatttataaattaatttggggactatctatacaacgttcgactgaaaattagcctaaaaatctgtcaaatgtaactgtaacataattacaatgtaattttcataattacactatatttatactataattacatatgtaattttcataattacactatatttgcactataattatatatgtaatttgcatgtaactcgcatgtaattatagtataagtaagatgtaagttcaaactagatcataaaaatattgtagcccaatggggcagtcacgccttcatcccatgaggtcacaggatcgatccctaaatatgattttgtttttcttcctaaaagcacatatcttgatgcgtattagactgttagcatgaatctaagacacatccaacggtttagaaagtgaaagatttagccatcaaaaatctgtcaataaatatttagcaatccgattaatttggtctttttttttcctttcccctcttattaacgtgaacaaacttttgcgtttatatcacttcaaaaattaattatctattctgatttggattcaaggtcagtgtcaggatgtcatgtgattggttcatcaattgctacggtttcacactcctatccgtttcatctctttaactttttaaattttaattaaatcttaaccgttaatattcaggtatatcacaatcctatgcaggttggtattttcttccttttgtttaattaacgtgataatttctttacatcaaatatatcacaatttaagggcacagatattttattatacatgcatgtataattagctagatttagtgtacaactcttatcttctgtttcttatagataaaattgtagtagcattaaaatttagtcctatcataatctattggtatagattttaatctaccattgagcgcttaatagttaagctaatttttgcttggccatatgcatgcaaatacatgcatgtccgattcctagtcaaattagtcaaagttgccttttttattttaaggatattggctggtcccaatctctctaagatgttttttttgggctcacgtattttcctggttgatctagaccatccttttttttctagacaaatacgatccaacgacacatatatttttcctttttttccgattaacgtgggaatttctagcctccacagcgaacgtggtgcctcctttcaaagctgtttttaataatataatataatatataatggataaatagatagatagatatatagatagatagattatatacaaaggcaaagcttttgtgcccttatctatctctactattataaaaattgaatatgtttttaccgatattttggtatatcatccgtgtatgagtcggttcttaagttcgtttgcttttggaaaaacatatccgtatttgagtcggtttctaaaatcattcacttttgataatacagaaggaatcatataagaaatctatttaaaataactcgcatgctaacttgagacgattggactcctaactgcagcttatgattttctaaaaatatatatatccaagagcgaactcccaaaataaatttcattttaattaaaccatataacaataataatattaaaatagatttcacccgttgcaacgcacggacattttttttctatttttttaaaaaggcaaagcttttgtcggccttataaagaaaaaaaaaatcatttcacaatccacaccaacccatttccagaaaattcctctcactgcgtcatggcttggcgtctctccttcctggaccgacccttttatttgtccatccataataattccgcgaaaatctggtagcaagaacacaatcctcctgagttgagagactactgccatagtgccatgcatggcgctgtggggagggctggggcaagcggcgacggtggcgcagctggtcggggcggacatcggaggcctcatcaccatgatcatgcaggcggcgatgacggctcagcagaacaaggaggagtgcgagcagctccccgccgcgtcttcaccatcgccgagctgctgcagcacctgcaggatcccgatgtgctgcgacggcctgagatccggcggccgctgaccgggctcgacgacacgctccgggaggcgcgcgagcttgtgctggcgtgccaggacaagagcgccgtgtacaggttgtgtacaggttggcgatggccgggaggcaggctgaaaagttcagggatgttcagagcaggatcgactcctacctcctgctcttccccgtgatcagccacatggacatcactcgtcgtctcgatcgaatctacaacatcctggttccgaacgacatggccgggccagctatgtctcctgtctccatgccccaattccccgtcccagcctcctaggtacattcgaatgcatgcataatataacctcaaactttcaattgcaatttgtacttggctccaaagggaagcttagaattgaactctaattttgcctttcttccgttatctgcacatctctgtactaggatgctgctaagatgtattggaaggaaccacatggagtccaagagtttagttttaacgagctcgcaaaggcgaccaacaactttgcccctgaaagaaagatcggtgaaggtggcttcggctcggtgtacatgggaaggcttcctgatgggcgggtggtcgccatcaagcaccgttgtcggaactcagatcagggtatggaggtgttcatggtagagatcacaatatcctctcccccatccgctacaagcacattgttccactatatggctattgtgatgtgttggtcgaggagaagcagcggcgcctcctgccaccgttccggaaggaaaaggaggagaaagagcatctgcttgtctatgagtacatggagaacggctcgctggatcaccacctgcacggcccaacgtcgtcatcgtcgtcgtcgccagtgatggcgtcctggaagatacgcatggagatactgctataggtgtgtcgcgggccatcgagtacctgcagtcctgcggtgagcagccgat

SEQ ID NO: 14898 - DNA, 1548 bp, Oryza sativa
  unsure (1)..(1548): unsure at all n locations
aagagagaaaattgtgagcaagatggaaggaacccagaaaaggcaaagnagaagagtgaacgagaagaagaggagaaagccaccagaagancaacatgagtgccaaaagcgggacgggtggtctagtggtcacagcttggcgtctttaacgccactgattaagcgggggaaggtgtgaaaggtgctggacaggcggccggcagcgaagccaacggcgaggcagctgaaggcggcggaactggtggcgcagacggcagctcgctgcctgcggctgcggtgggaggagcgtccagccatttcggaagtcgtggccaatctagagaaggcgctcgagctcgtccgttgcgacgggtaggcggtagcatagcgtgggctcccgagacatcttatgtgaataattgggcaatgtatattctcatcatgtaataattaacgctgttgcttctcttctcttttttttttgtgcgcatacacaattaaacataccaatgtggtgtgatcaacgaacagaatcttatctttttttgctgatttctaatgtccacttgtgcagctgtgctgaaccaacaacccccccggatcacttgctcttagcttgtgctgtgaattcaactgttaagctaggtgcctcccaatatcttcctgttcacctgtttgagtgtaagaaatagttgaagacgcacgaattttaactggttttgctcccattagcaccaaaaaaatcaacaaaatataaggccttgtttagttggggaaaatttttggatttggttgtcaaatcagatatacgaacacacatttgaagtattaaacatagtctaataacaaaacaaattacatattctgtcagaaaactgcgagacggatttattaagcctaattaatccgttattagcaaatgtttactgtagcacttcattgtcaaatcatgacgcaattaggcttaaaatattcgtctcgcaatttacacgcaatctgcgtaattatttttttcctatatttaatgctttatgcatgtgtccaaacattcgatatggcagcgtggaaatttttgttttgagaactgaatgttccgaacgttagcagccctgctactgctctttcttcgtattgtccccacaccttctccctgctcttaaaactaagaatctcatgcatgtctgtgcagcagaatcctctgtccgtctggcctgttgcagcaatatcctgcaggactaaaatttagtcttcggatcaaaacaccacctaaagctgggttcatagggctcaccggctcagaatgtattcaatggatgattgcaaccgacgtattttcccggaaatgtttatcaaaaacctgataatagttggggtttcaaataaaaaaaaacctgataatagttacagtctgcagtaacggacactgggcttcctttgcgcggcatttcatcgaacacttggagctcaagaccaatcataccagtataccgtagcctctccggcgagtcaaaccttccgctccttctctctttcaagagagctcgaggcgaccgcaaagccatggccggg

SEQ ID NO: 14899 - DNA, 18869 bp, Oryza sativa
  unsure (1)..(18869): unsure at all n locations
cattcgcggccagattatttaacactgaaccgataatgctatcaagcattctataaaacagagtcagtgatcacttgggtgttggtatgttcatgtgcatgccgcaggggacagctaggatgcggcggcgttgatccggcgaggcgaacatgagtcggtggatgggggcaaacatgggatctcagtcgttcgagatggacggcggcgagcaacttcagtcatgttgttcatgtcaatggggttcggagatgaaaactccgaacctctctagcatctgtactgcccatttgataaagctagtgtagtcgtagcacagtaaacttagccttaagccaactgccagaagtttgtttatccacagaaggccttaagcctcttctctctctatttggttgatgcgattagcactcccatgcagaaacgcccttcagctggagctcatcagtcggttgatgcaattagcgctcccgtatagaaatggccttaagccggttgatcctggaaagcatgaacatgttgctggtagcaatgtggcatctctgccttattttggtggttcgtatggttaggtaagcgacgcacatgtctgaaatgatgacacagttgagaattttaaactcgaatgtgtgtggcttaaacaatccagctagagatgttgtctaagagacaactgaatttcctagagtacagatcttatgtcgataggaaacaaaattaagtaaatgtgaaaagagataggatttttttaaatttttaattctattaatagacctttccaaaaactgaaccttttggccacgctagcagcgttgttttgccaccctagccatggtggcgtggcaaaagctggacaacactgccacaccatctgcgcgtggtgtcacaaagtgatttggccacgctaggcgggctggtgtggccaaaaggtttagatttgaaaatacttttcggaaaggtctattataaaataaggtctaaaaaataaaaaaatttcgagaggtaggggtaatagatggtagattttagtatcttgcctgcagatggaattttgtgtttttttttaggctatgataataacgcgtcctgtagataaacatatttttttggaacatgccaaggtgtttttttaggtagtagagcgagtcaaagagacaaaatccatagaaaatcaaatttttgaagattataattcgcccagatttcaacaaactggaattaaaaccgttagtccatatttaagaatactagagcgctcggacaaaactatcatgtcgaacacatacgtgttcatgtattagttcataacacgtgccatgtgttttaacagagccagcgacatctagcaaattaagaactacttactactagataacaatgtgaactactaaataaaaacaattaagttcgtctccggtgccgaaacagagaatatcaattataggcaatgtaaaattatccctaaccaaaaatttcctgaactactctttataccgcgcgctgcagccctacagtctcatacaaatcatccaaatggacgtatcaaataaatattacactttatttatttctaataagatagcttactataaaatctcgtataaacctgactaacgcaatcgaccacatcgacaacaactattcatcttagcccacaagagtaaaatgtattttgcaaacctttctaacccaaacaaccgcaccacaccctaaaggaaactgctcaccgcagaaaagatgtataccatttgcaacataataacactgaaaattttagcacatatagagacaatataccgagaaaaataagtactataatatattaacataaagaagaaataataaatatgctacctttttattatgtattagtaaataatatatacgggctataaactagccggtgtgctaacaaacatgtttattttctaattatattttcagaggaaacaaatagttctggagagagttcaaaccattacactcattaataatagtcatgtcctatgttctacaaatcataagatgaagttattatacacaataatgtggaaaccatcttaaatgcgaatacaattatctcatcattattcatgtccttgtgaatttgtgaaaaatataaaaataatttgtctaagcgactcgtaggatatgagttataaggatggaaaaaactagaggatgtatagtcttgtactagtggcacgaaagctgggacgaacaattgtagaacgtgagtaattattatgaatattatatacaaatcatttgcttatacgataggagctaatgcaatttcatatcaaaaatggtggatgcaatctctaataataaagaccggaaaaaccgaagactacaaatcaatcagataaagtttattaaatttcataaaataaggctttatctgtgacagtaacacgatatgtattttcatcccttaagaatatccccgttttcacattgtcattcaaataatcactaaacaatgtgaatttttttaacaagatagattaatatatgatatatcactctacaaatacgcaatttcaattcaatatatacaaattgtaacagaaataactatgaatattctctgcaaatagaggaggctttctcttgctatgctatgattatttagctctcatgctcatgctcacacattctcatagcatggcaagagaaagcctcctttatttataggcctacctagccattggatctttgacaaggattaagacacttatcctaatctagagttttcacttcttgctaaaaatacacatgtgcatccactattattaaaaatatatatttactaaaagtgtttctgataattttattttactattgtagaccatttgtgaagaaacatctagtccgtaaacattttggaatattcaagaagatttgggttgtctgcttttactccctataattaaatctaactagtgtgaaaatttagaccctctttggagaaagaaagaagttctcaaattctaccatgatttaatttatgggaaaaaatcaattcataatgaattgaaaaacaaaccatctaataggttaatgcatatgttaacttggtaagaactggttggtggatctaagatgaaaacaatcacggaaatttgccaattgattaatatggtcaattttcgactgaaatttctaaagatatgctaccagtcccgaccatttttatccctagatctatctatattttcatgaaaaacacaacatgcaatagctgccaattggggtctgtctatacttgcatgttggaaaagcaagacatgtaaagtcaataacttaaatctaggtagtcaagatccaccaaaaagaacataaccagatgagctaccttgaaagattttttttctcagttgatgtgatcgatcgaagcaactccgtactccttaccaagttaggtgtgaattgtcataccactgcaggccgatcgctcctgtgacgccgtgtggcaacaagtacttccttctcatggtagaagacaagagacgctacatgtggctcacgctgctcctatccaaggctgcgatcaatcgattcaaggcgtctgcgaaggttgaatccggcgacgcctcaaggcgctgcacaccgattggggcagtgagttcacctacatcgccttcaccaattactgcgcaaatgaagggagtctagtgacagctcatgaccccctactccccaccacagaatggggttgtagaacgccgaaagcaaaccatggtggcgatggtgcgtaacatgttgaaggcgaaagggttgtcggatgcgttctgggggaggcatgacgtcgtatgaggcatggcacgcttcctccaggttgtgcactatctgcgcgtgttcgctgcatcacccacatcaaggtcgtcatagctcgtcgatgatcttcatcaggtacgagcccggctccaagttttattgtgcgtatgattgttgacggtcgttagcgatcagttccgaccgtcaatatcaccaaaatagagaactagttatgcttgcaatgcatatccatgttagaataataatattgcactagtgtttggttcactaaccttttgcagagaataaccataaagtggaggagatttgacatcaactcagacgataaatcaatcggacgatgttaggaaccagacttgtgcatgaatgggccaagaactcagaattgacacgatgaattgggcgaaaattcacaagtctccgaagaaaagcagcagaggaggcccccagccaaaacttgggctggttgggccgacccttggttcgaccgaatcccccagcgccgttgatgcagggttgcgactgaacgctgtggattagctcccaatgacggttggagggtattttcgaccattccaaccgtcattgggaggctatataaacccctccctctcttcacttcaacacacacctcaagcaaagctctctcctattctctcaagtttagtttagtgttcccaagctagtggaatgggaatagagtagaaatcagagggtttggctctagtagctcttctcttctcttgtgtaagctttgcactttatttagaatactctcctttatacatttatggtattgaaatactttccgagtatatgaatgccaactttacattatgtttatgttatactgattatactgctagcttatctgggagatgcatcggtacaggtataatgtttgcttatacaattactctatgtcatgatgatattatagtagtatctggtagtttaggcgtggcgtctaggttacgggatatcattatttgaggttatatgctgcggatgagaggtgggccgctgatggtgacagctcagtacgggtattcctctgcgcgtgtatatagtcctaagttaatttcctccctttcctagggagggtactcatccgtatttagccccggttatatggtcatgacgggttgtcgtaaggaactcggctgtcaggggtgacttctcaaagtaccaggagggcattggatagagggtattagttagtatgtcagataactaggatgtatgtatactagaagtataggaattgattctctttctcttttctttccacttagcttagatattttagtatgagaataagtagctccctgcttgtgtgtcactctactgttggattatcttaacccctgcttagactatgattattacaagcaacatataaattattagtccggttatctctactatgatcttcccacgggattaaataaatacgatacccttggaatactctcgggtgaaatgctacaatggtatatccgtgcgcttgcggatgaactctgtaaccataatatattaggagtatttctgcgccattgctgggaattatatttctagcaatgtcattaagaaataccaacaataatctggtgtcacaacgaatatgcatgacgtgatgtcgtgttcaacgaggcagcctagtgggactgggaccagaatgacttgcaaggtatgccattgtctgaaaatggtttcccaatgcaatacttgtcaatgcctattgccagattgtccctgccactgtgtcgaacaccttcggtgcaagttggtgcggagccggaggcagtagaacccgatgggccggcacggacgcgagattcgcctcgccgcctcctaacttggaagagaaccttggtgttgatcatgacgatgacacgcccctccgtttccacaccgtcgatagcctactcggtgaggcagcggctccggggttcgcgatccgtgagctcgagatcaccgaggagcttctcctcagtacaccgacgaacccacaagcttcaaggaagcgaagctagatcaatcctggcagaaggccatgttggaggaaatgcgatctatcaatgacaaccacacattggagcttccctctttccctgtcggccaccgtgccattggcctgaaatgggtgttcgaggtgatgaggaatgaacacggagtggtggtgcactacaacgcgaggctagttgcgaagggttacttatagccgccgggaatcaactttgaggaggtcttcgctccgatggcacggatggagtcggtgcacctcttactagcaatgggggaaaacgccggctaggagatgcaccacatggacgtcgagatcggagtcgctcaggtggcatcggggttccaggggcgaattcttatccctggagattagttgaggtagttaggattgcatgtgcacgtttgctttggattcttttccttctatatttgagtccgagctaggcgcgccaccagagcgcgtcgtgcgccacgatcgggggtgtttgggatggcactcacctcaaccggccgtggcgcataagcaggatcgtggcccttaatccacggggtgtaatctagcataataaaaggagaagtaaaccgaaaagtagcaagttgttacacgctccaccaaattctctcttgcattctctgtgttcgtgcgctccaggtgttcgtccgaggttctcgtgcccagtttcgcgtgtgttagttcttgtgctgatcaagtggacgctaacaactaatgctctggcgtggcgagcagggttcactttatcggtttagctcatttgatcggaggtcaccgaaatcctgaatttttggtctgaaatttttaaaattttgaacacaatttagttgaatttgaacaaatattaccaaaattcatgaaaaatttgaaaaatttcggccgaagtaatatcgtatcggagtggaccgaaatttcggaccctgtggcgagcaacaggtgatatatttatcataatatatttttttgcggggaaagagaatgctttattgattactcatcagtgtgattacaatcatttgccagagccccaaagacacaagagggagcctgcatacgccaaacagctgaatggttcgtacacatggcaaaattagctagatcatgggctactctattgcattctcttctaatcttctgaacacggaaatcaggcagagcttggagtaataacttaatactccctccgtattttaatatatgacgccgttgacttttcgaccaacgtttgaccattcgttttattcaagatttttatgcaaatatgaaaatatttatgtcatgcttaaagaacatttgatgatgaaccaaatcacaataaaataaatgataattacataaattttttgaataaaacgaatggtcaaacgttggacaaaaaagtcaacggtgtcatacattaaaatatggaggtagtataatactctggaggacatggcaaagctgcgctccatatactgaccatgatatgctatcaaggtctgattcagttccaatatatatagagggacggtcgacggagattcagtgcccgtgttggtagcaagaacgtaccaccaccgctgcgcgtcgacgcggcgcggcaggcggcgatccaaaataggggtcgttttatcttgcagttttgagttttgagacgaaattgcaaaaatactatcagtactaaaatctctgatccggagaaattaaattcgtatatggaacatgcaaagctttctcgtttctcgttagggatggatcaaatcactttggcaataaaactcccaataaaactttcgattctgaacagtgaggccgtgggtggggttcggagaagaaaactccaaactcccaaggatatcttgggccgtttgatgcggcccagacgactcacactgtaatatccttggggaatccgagaaaggctgtacggttgggcttgagccggaaagtttactactccctccgtttcagaatgtaagtcattctagcatttctcacattcatatttatgctaataaatctatatgtctagatttattagcatcaatatgaatgtgtgaaatgctagaatgacttacattgtgaaacggagaaagtacaagcaaatgcattgatgtcaaattcaattggtgtgtgactggacatggctaatgaggcatatgcctgtaacgttcttctcttcttcagggagcagggttgcagcttaattggaatcttctgcacatcagcacatccacctcattgtcaaattaaattcgacttcaggtttctcaaagaaacgtagatggaccttagaatatcattacagggcatacgcatatactttattcaagcttattaattattactccctcgctcatgcagatcgtatgaagagcatactgagatacaagatggaggaaacatgaaggactacagtacatagacatgcagaaaagagaaagacaatacagactcgatggtgatcacactacactacaactgaatgattgaatccaatgaagcttaggaacggtaagatatacatgtccaaatctgaatttgatgaagaaactaaactaattaaccgatcacatcaaggagtagtaggggacgagggattaattgttccgtccagcgtatcctgcggggctgtggcgaacgccagaagcgagccggtcgatcgtgtatatatatactaatataaaatatgatagtcataagaaaatttggaagtttaaaatacccctgaagataaaaatctttctctggctcatgctaaagggtaaaatcttgactaaagacaacttgtttaagagaggatggaggaaaggtgacactaagtgtcaattctgtgatcaacaagaatccattcagcatctctttttttattgtgttatggcaaggctgatctggaacattatttcctgtgctttggatttgaaacctgtttctgatagcaaccagctgtttagttcctggatttctgcttttgggaagaaacttaaaaaacttgttgtcactggtgtggctgctgtgctttgggccatttggaaatctagaaacaaagcctgttttgaaaataaactacctaatgacccaactgatgtgattttttcggtttgttattggttggaatcttgggttccattgcagagactggaggaagatcaaagaaagctgctcttgggggccaaactcataaaacaggtggcaagtgaaatctttaactccaagtatggatggagggccgctacaagaaggattggatgctgaagatgtctctcttgctttaggtctggatgtcagatgcaactacaaaaattaggttttgggtgatgatcgctgtatctctgaatcaccagctggttatgtttcagggttttagtccttagagctatatgctgttattttgttttgtgtgatgtcatctacaaatccagctatcttggtagcttgtctaagactgctctgtatctgaacctgaactttgtagttcttcatttctagtaatggaaatgggggcatgatgcccttgatcaaaaaaaaaaaaatatgatagtcgtgtgccaccatcaccaccaactatcatatgagattcacgaacggtgagattaaattttacttgtttttgggtccttatatacatacatacatacatacatacatacatacatacatacatacatacatacatacatacatacatacatacatatatatatatatatatatatatatatatatatagacacacacacacacacatttatatatatatacacatatacatatatatatatatacatatatatatatatacatatatatatatatacatatacatatatatatacatatacatacatatatacatatacatatatatatacatatacatacatatatatatatatatatacatatatatatatatatatatatatatatatatatatatatatcatagaacccgtcgaaagaaaaatatgataatagaataatatggaatttttttttatctttacgaaatggtagcaaaattagcacaatgataatttattacttcctccgtttcatactataagactttttagcattacccaaattcatatatatgttaatgaatctagacatatatttgtccctagattcattaacatttatatgaatatggacaatgctagaaagtcttataaactgaaacagaggtagtagataattaggaaaaaataccagagcgcctcggaagagaaggatatggctcatggctataggtcaacgtcactggactttcgggtaattgggtttgatcgatcacttgctttcttctacaaggttttgcgatattttttttgcaaattatcaaggggaaagagagagacagctatggaacaagctagtctagattatggatatgtacttcacttaagtcaattttggtgatgatgataggtaggagtgcaatgcagacatgcagtagctagctaaatgactgaagctggatatgtaaaaaaatatcaggaggtgccaataaacgggattatcgaaaatatcgaaattctatcggtgataaggaaaaaaaattggacaaaatttattaaaatttggctaaatctatgcaggaaatcaaatagattatagaccagttggtataaaaaataacatatataatttgcaaaatgaccacggtaagtgcagagtatcatgcatgtagacggtcaaagattataatgtcactcacgcatacagattttaaaaaaggctaatattttaagacaatactcattgataggggtgggcagaaaaaaccgagaccgagaaattcggtgctaggcagtgaaagaccgaattttattcggtcaattcggttagtctcctcggttaacccaatagaccgaaaataccaaattatcaaaaaatgtctaaatgcaacctacaatccactatgtttaataggattaaactcgaattttcacatccctacttctaagcatgcttacgaatttttttgtgatttttgtcttgaaaatttccattatttctttacatatatgaaaatgttgttgaatttcggtcaggactaagaccgagaccgaaagaccgattctgaatttgtcggtcctgacatttttacgttgaaattcggtcttcacttttcaaagacctaaaagaccgaaagaccgaagactgagaccgaaatgtttggttagaccgaatgtccacccctacccattgagaaacctgaaatttagaaatatcggaccatgtttcagtgacaatttgagccacctggatctgttattcgtgaatgatttaactagcctctctgcttctccagccaatcaatcatcttttgctggccggtcgctcccgtccaacaacgccttattgtgaatgtgggttggtgctgaagcctcagctgacgactgtcacactgatgtgtgctctaccttatgcataaattcccctgctgctcgcagtcttagccagatctaggttcgtagcgtccagcttctcaggcggtgacaccacaagttggctgttgtaatgtatggaaagcaaaacaaacaatataaagagtattcatttatttaaaacacatcacaaattaagtactattcaatgagattggctctgctggtacctcatcttctgattctgattataagtaaacgccgacgcaatatccaaacaagacggtgaggactataataccaagccaaaccacaacgatcccaacaacattaccgaaaacatggtatcataccacaccgatcctaacaacatcaccgacaacaatcctaacaacatcaccgaaaataccagcgaaaaacaagggtaaaactgtgatgaaggcgaacacgacgaggaaaacgtgaaatccacgtaccaataagagctcatcgcagcaggtgacgcgtgaccaaagtcgtcgagaagaagagataagccatggtgtaggaaaatcacgcaggatatcctccacatggtaaccatcatcatcaacattagtggcgacggtggagtgcggccataaaatcatccaagcaacatataatgtcgggacaagcaatgtcatggagatcaccgccgccgatgagatgatcacggcgcgcgtgtactaaatatatatagttctaaggagagctcaaaccattacatagaacattcaacttttagtaatgttatggtgtgtcctaatgttgtactagtcataagatgaagctagtacacacaatcatgtgcacatcagtttaaatgtaaacacaattgtcttatcattatttatgtctttgtgaatttttgaaaatataaaataattaatctaagctattagtaggatatgagatgaggaaaactaaaggatatatagtcttgtacaagtcacaaaaacaattgcagaacatgagtaatcactgttaatattatatacaaatcatttgattatggaataggagccaatgcaatttcatataaaaataagaatcaaagactgcagatcaataagataaagttttttcaattccataaactaaactaaggctctatctaatacagtaacagcaatatgtattttcatctcttaagaatatctctcgttttcatattgccattcaaatagtcactaagcaacatgaaaaaatttaaactaaattgcgtctacactacataaacttggtaggtgggtgcgatctagtgcaaaaacttgaaaattgagcatataggtgcaacaacttggctagtgcgtacattttggttaaaagattaatattccacaccatactttttatgccatataaaaaaagccacccatgtcatctcaataaggatctacatatattatgtattgcttttaattaatttgttagttataataataaaatgatctatcgatttgaaaccgaaagttatttggttatcaaaagtaagtacatggaaataacataaatttccgagcgattcaattaatcaacatattcattatcttgggttatgaatatggcaaaacacgaaattaaatccataaaccaatgatctagaagttaagcttataataccatgattaatcaaaggtatgtatcaatgtttttgactaaaatgcacgtgattgtcaattttatgtaccaatctactcatttttcaagttcttgcactaaatcacatgcacctatcaagttcttgtaccatgggtgcaatttactaaaaaatttaataagatagattaatatatgatatatcactttaaaaatacacaatttcaattcaatatatatacaaattgtaacaaaaagaacaaatatgactatgaatatgcaggagactttctcttgccatgctattactatctagctctaatgctcatgctcacattctcatagcatggcaagagaaaacctcctctatttataggcctccgtagccattggatctttgacaaggactaagacacttattctgatctagagttttcacttcttgctaaaatgtgaggatgatcatcgtggcctcccggtccctgcggtccctccccgggtcctcgctgagcttgctcacctcggcgcggcggaggaggtcgctggtgtagtgcccgtgctcctcctcagccgccgccgccgccggtgctcgtgtcacatccccgatccggtgatcagcgtcgacgaggctcgccttctcgcctaggtcggagtgcgggatctcggtggagatgacggagtggtcgtcgatggcggcgaccagggattcggccatgtcggtggtgcacgacgagattagggttttgagcgaggtgagtgttggggatattggagggaagcttcatggctgtttcgcttcgactgccctctcctccttttcggccgttggccgcgataaatgaggccctgttgagtttccaaaacaaaatttttcacgctgtcacatcaaatatttggacacatgcatggagtattaaatgtagaaaaaaaacaattacaaaaattgcatgtaaattacaagacgaattttttaagcctaattacgccatgatttgacaatgtggtgctactgtaaacatttgctaataacggattaattaggtttaaaaaatttgtctcgcagtttcctggcggaatctgtaatttgttttgttattagacaacgtttattacttcaaatgaaatgtgtgtccgtatatccgatgtgacatcccaaaacaattttttttgccaactaaaccaggcctgagttgggttctgcgcttccaccgcgggcaggacacaattaaaacagttttgcccccattaaaataggacacggtcaaacctagccggcggggtgggcgtcggcgagcgagcggcggcggcggcaacggaaagtgggctaggcgcaacccctccctcaagccattttcaccgcaggcttccgcttccgagctcgaaggtgagcgccaccgcgaggaggggaggaggaagcgggggcaagggtttggtgggttggggattgtcgcgtcacgggggacgggattatggagtaccatatgaaatctgtgtgcgatttgaagcatttgaggttgggcttcaaattttctgcaatgtccaattgtgtccaatctatctattatctattattattttattaaaatagctttgaaaggatgcaccacatctgctgtgagagctagaaattcccacattaatcggagaaaaagaaaaaaagaaaaagagtgtccaagtagaagtacaatttaaaaatagctggaattcggaaataaaaataagcaatattgaaagaagtttccatataagaacccaatacgagattaatcaaaattcgaaataaaaataaaataaaatccaaaattagaaaaggaaagaagagtccaagtagaaatacaatttaaaaatagctgaaattcagaattaaaaataagtaatattgaaagaagtttccatataataacccaatacaggattaatcaaaattcaaaaaaaaaataaaatccaaaattagaaaagaaaatgagagaccaagtaggaatacaatttaaaaatagctgaaattcggaataaaagtaaataaatccaaaattagcaaaagaaaataaaagaagagtccaagtaggaatacaatttaaaattagctgaaattcgaaattaaaaataagaaatattgaaagaagaatccatataagaacccaatacgagattaattaaaatttagaataaaaataaaataatatctaaaattagaaaaactaacatagagttcaagtagaaatacaattttgaaacaactgaaattgaaaataaaaaataaaaacattaaaataacacaatacgatattaactaaatttttttaaaaaaaattatgaaattagaaaaagaaaaataagatttcaattaggaatacaatctataaataactaaaatttgtgataaaaataaagattattgaaagaatagaccatctaaaacacatgacgagataaattaagttacatgcctataatggagtagagtggtggcggtttatacgagatataaaaattgttaataaaacaccaaatagaatcctaatgacgattaaaaggagggacgtcaggcaggccgtgaagcaaacgagtaaggcggttgccgagagttctagaaagtaagaaaaaaacaaatcccattgataagcatattcaatttttaaaatctcaatgacaataaaaaggagaagcagtgggcggggtgtataagagtatagttgtagagccgctgacggttgacgggacttctagaaaataaaaaatgaattccaacaatagttatatgttcgatttttagaatcacaatgacaataaagagttggcggtggacgggctgtagaggggcttcccgggaggagacggcgaagggacgcgcgtccgcgggaggtccgggatgggatggcgaggtgatgcccgcgacatcggatggacggcgacgggacaggggatgacgagggtgatgtggcgccgtgtttcctggaaggaaaccggagcgagagcggcttggcgcgatgcggttttgggacggcgcgtgtgttggcgcgaggagcggtacacgggaaggtggctcggtgtattgcggctcggtcacgaggcgaaagtggtgcgacgctgggtgagacatttcgtcgaacaccttgcgtgcgtgagctggctggcctgaggaggaagacaaacagtggctgggctgagctgggccggcctgctaatgggaggagaagagaggagaggatggaggggagttgggccaggaaagaaagagaggaggaggcccaaattgtactgtgatatttcacaattatctcaaggatttggggtttgaaatttggggagatttttgggaggatttgaatttgaatctgccctagggtttcatggaaatttgaaggaaattctaagagaggattgagatctaatttggcacaaaaacaattaagaaccaaactaaactccaaattttaaatgacaaacttttaaataaaagcacataaaatatgggtgctacaaacctacccccttaaagaatctcggaattaaaaataagaaatattaaaagaagagtccatataagaacccaatacgaaattaattaaaattcggaataaaaataaataaatccaaaatcagcaaaagaaaataaaagaagagttcatgtaggaatgcaatttaaaattagctgaaattcggaattaaaaataagcaatattgaaagaagaatccataaaagattaattaaaatttagaataaaaataaaataatgtccaaaattagaaaaattaaaagagagttcaagtaggaatacaattttaaaacaactgaaattgaaaataaaaataaaaacattaaaataacacaatactgtattaactaattttttaaaaaaattctaaaattataaaaagaaaaataagatttcaattaggaataataagtacaatttttgataaaaataaagattattgaaagaaaagaccatctaaaacacatgacgagataaattaagtaacatgcctataaagtagtagagtggtggcggttgatacgacatataaaaattgttaataaaacaccaaatagaatcctaatgacgattaaaaggagggacgtcaggcaggccgtgaatcaaacgagcaaggcggttgccgaggcttctataaagtaaataaaacaaaccctattgataatcatatttgatttttaaaatctcaatgacaataaaaaggagaagcagcgggcggggtgtataagagtatagttgcagagccgccgacggttgacgggacttctagaaaataaaaaatgaattccgacgatagttatgttcgacttttagaatcacaatgacaataaagagtaggcggtggacgagctgtagagggcataatggcatcgtttgatgggacttctaaaaattataaaaaataaaactacatgtccaatttttaaaggttcggaactactaaaaagtaaaaaaaaacaatgataatcatattcgattttaaaatctcaatgacaataaagaagggaggcagcaggcgagccgtagaggagtgcactagcaaagccgctgacagtttggcgggacttctagaaagtaaaaatgaacccgaacgataattatgttcgatttttaaaatctcaatgacaataaagagaagacacagtggacgggccatagaggagtataatggcaacctttgacgggacatctagaaattataaaaatgaaatccaacgtgataataaactttaaaaactataaaatttaatttttaaaggttccaagaagaatgaatagaaatagtggtagatcgagcaagcaaataaagaaggagatgacataatgggtagcaacaggtgtgacttttataaactatataattagaaacacaaagatgataaggtttggtctttcaaggtcttaagacaatgagatagttatttaataaattttaagtaaaatcataaaaaaatatatgattttgtttgggtgctagccgcgcaattgcgcgggccactcagctagttgtttacattgttccgtggatgtcaaatttactgctaatgtacaacgttgcattatatagacgttttagctttctggtgaactcttgttatttctaggtccacatgagaattctgaactttctgttccggctaatgggggaaaaacataattaataaataaatatgggaaatggtatatatgtcctatttaacactgttaactcctacatttaaaataggggtaaaagtatctttcggttaaaaaagtggaaataggagaaaaatcaatattagagatagtgaggaaaaaggaaattgtctctaagaataactgtttgaggtcaaacacacgtataataaattctggggctgagcaagaaggaaggccttgaagtctggctgatctcggccagtcgcgcacaaacgggccatctgcacttggccggacaagactgaagatcacgtacctcgatcgtcgccatctgcagctgaagacggacgccacgtactcgtcgaatccgcatcgagccgagcgtgttcctctttctccatctccatgatgaataacacgacgattcgaacatggaccagattgtctcagcctcggcgagagctccggcgccgtgtcgtaaatacatcgagtaccggtatcaatggcgcgcggcggcgccggcgggcagatagatatacacagttccttccatctcgttcactgttctagtgttctcagagcactggagcctccttccttgtcgtcgccggcgcggcgatgatagagtggtatgggcaggacatcgtgaagtatcagatgttacggcggcggcggcggcggcgcggcgctccggcaactcgacgaggcacgacatgaggccgcggtggcgctcttgggggttcggagtttcaaactccgactccccgttgggctatctgcgaccgtttgatcaggcgcgtgcggcctagataagtgggaaaatatgtagtgcaaaccacatgcagtggaaacttggaaacnnnnnnnnnnnnnnnnnnnnnnnnnnnnnnnnnnnnn

SEQ ID NO: 14900 - DNA, 3105 bp, Oryza sativa
  unsure (1)..(3105): unsure at all n locations
cggacgtccatttctcgatccaacggtagtttccaagtttctactacatatgtggtttgcactacatattttcctcagataagtcaaatattattcacagcataatacttgggccgaggatggctgttggtctgggcttccagtcacgccaaaacggcccacagagtccactcataggatagctaccattattgttcagagtttcagatacgaaaatacaaagtctacaagtcaatgcagttatgtcagataaagttgatgccgtgtgattggcgatggcgatggcgatgttctcgtcctctccagggagaatggtttgggagcttggaatcatctgttatccaccttgtcaatgcgtctcaaaatcgatcagcatcatcttcagaaattcgccaaaaacgtgtaaacagatatgtgaccttataatagcattccagatcatacatactttattaaaaaaaattattactatgcagagcatctgaatgacatagcacacagaactacttagaccctgtttagatgggactaaaacttttaagtccctatcacatcagatgtttgaaaattaattataaatattaaacgtggactattaataaaacccatccataatcttggactaattcacgagacgaatctattaagcctaattaatccatgattagcctatgtgatgctacagtaaacattctctaattatggattaatcaggcttaaaaaaaattgtctcgtaaattagctttcatttatgtaattagttttataagtagtctatatttaatactataaattagtgtctaaatacagggactaaagttaagtccctggatccaaacaccaccttagtacaaaaatgaagcaaacctgacatactactagacttgactacagacacggagaacgcaatattacattacacagtacagtagagactcgattacactacaactgaactcgatgaagctaggaacggttagatatatatccaatctaaatttgatcaagaaattaattaaacacagccgagataatatccaaacccattccgatgctaccccaaatgcatgatgaagaaatccattatccatgtgttatgtgtatcatcacttggtccatggatttcaggatgcccaaatatatgcaatgaaaatgaagctttgatccgttcgggaaatcatgcagtaccctttgtacttgatctcgaccagctctcgccggcgccgctacgattcttacgatttcgccacggcggcgccgccgccaccgtcgccatcacaggtggtgatggatatatcaagcacgagctgcgccccgcgcagccgccggagctcagatgcttgcatggcttcctccgtccgtggctcacatcacggagcaggaggtgggatcctcctccatcgaggggtagaatgggacgccgccgccggcgccggcgcgggggcgaaactgcggctgctgcggcggcggcggcggcccggccgccttcttgcctctcctccgtttgcctcccttccctccgttctgctgctgcccgccgcccttgttccatccaccattgttgttgccgttcttgccggtgttgaagatctcccgctgcgactgcgtcgacgaaccaatggagaagaagattggtcagctcagctcgatcaattggataaagaaaaaaactaggattagtttgatgattcatcatccatgtgtcttactgagttgtttgcgcggcgttgattaggttgatcgcgagagccagcggcgacggcgagcttgtcgagcttcttctcgatgcggctgccgttcgcggcctggcggtcgatcttctcctcgatgcggacgccattggcggcctggaggtcgacgaggcagttgctgatcctggcgttgacgtcggcgaacttggcggcgagcccgtcgccggtgacgagcatgagcggccaggacaggcagccgccgccgctctggcaggactcgacaagctggagcgcgtcgtcgagggcgcccctgagccggcgcaggatgttcgccgccgtcgcgtcgcccctcgccaccgccttggagttggagtccggtaggatcttggcgacctgctgggcgcgctcggcgagctccttgcagctcgccgcgttccggcgagccgtgctcaccgccttcgagatcgcctgcaccactttcacgatcgcgcccaccgagtccatctcttgatgacttgctgatcaacgatcacctgctgcttggtttcgctaatgttgttgggtgttcttgcaagaggtggaagacgagtagcgctcaacttattgtcatgttgccattgacggctgggccacacggagttggtgctacgacggcacaacgctaacgccagaatgggaaatttaactattcgccactcttatgacatggcaattaacgatttgccacaccctgtcaatgacatgtgggccctcgtatgtctatgacatgtggacctagtggcaaatcgttaagcaacatccgtaagagtggcaaatagttaaaagcccccgccagaattggggttgggatagtaggtaatttttcgtttaccattaacacttttatataagagatttgttctagtccaataaaatatatctgaaggtatcgatacctcacggtacggtacgaaattgttttcgatgactggtacctcaagactctcttcgtgtatttgcattttgccgtgcgatgcaggaccgtctccaaatgatgagaaagctatgacccgtgatcaagtatagtgttgcataagacaagacactgtgacggagtatttggactgacgtttactcactcagtggaaaatcagtgggctgagtagaggatgactacaagtcaacggtcaatggagcttcggctacgcggtggttagttttggttgcttgctttccccgcggtttcttgagaaaatttgcaaattgccaaggagacgggcatggagtagtttaacaattattctatttcgccacgtttacttcagtgaggatgataggagtacggggcatgagcttactaaaactagcaataatttttttaatannnnnnnnnnnnnnnnnnnnnnnnnnnnnnnnnnnnnnnnnnnnnnnnnnn

SEQ ID NO: 14901 - DNA, 17396 bp, Oryza sativa
cggcgtcggcgcgggcgcgcgcacgcgaacacggcgcgtggaagcggttttgcgagcgggaagctcgcgcgagggaaggggcgctcggcgcgggcgactcctgcgcacgcgcgcgcggcgagcgggcggagcggaagggagcggaaaaagaggcgctcggcgcggctctcgcacacgcgagcagcgagcgggcgagactgagcggggggggaggagcgcgccggggggagagagagagagagggagagagagagagagatgggccgaggaagagagagatgggccgagcgagattcggcccatcgacctcgggggaggcaaaatagacttttgcggaggaatttgattggaaggatttggattcggaattgaacttgacgatagatcggggattgagatcttgagatggcacggacactagacaacaagcaaggaatcaaatttcgcaattagggtttttaagagataattttcccgctaggcgccacgacggaacgggcgctacagaccaacccccctaacaagaatctcgaccccgagattcagcacctaagggagcagctccggaaactcggcgcggagaagatcttctcgttcccaggttgcctcatcttcagaatgattgctccattggactttgtagaacttgatggtcttccttcgagtctgacgttctgcctcttcaagaaccttgatcggtctttccttataggtcagattcttttccagctcgatattacccagggggacttgctcttctggaactcgaagacatttctttagctgggatacatggaacacgttgtgcacatctgcgagaccttcaagtagctcaagctgataagccacttcgccacgtctggcggttatgaggtaggggccgatgtagcggggtgctaacttgccggacatcccaaaccttctcataccacggaggggtgatacccgcaggtacaaatgatctcctttttcgaactcaaggtcacgccttcgattgtcagcgtaattcttctgacggttctgtgctgtcttcaaacgttctcggatcagcttaacttgttcttctgctgacttgagtatgtcaggaccgaataccagtgcttcgcccacctcattccagcacaagggggtgcggcactttcttccgaacattgcctcattcagcgacatctgaatactggcctgataactgttgttgtatgagaactcggcatacggcaaacaacgatcccaagtgccttcgaaatccaaggcacacgcacgtagcatgtcttctaggatttggtttaccctttccgtctaaccatcggtctgcggatggtaggctgtactaaaatttagatcagttccgagggcttcatgcaactgcttccagaaccttgaggtgaactgagtgcctcggtctgacacaattttcttgggacagccaaatctacatacgacatgggtcatgtagagttctgccagtttctttccatcataggtcgttttcactggcacgaaatgagctgatttcgtgagtcggtccacgattacccaaatggagtcgtatccgctaggggttcttggcaaactggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggagtaggcggactcatgagcttcctttagaatgagatctcttatctccttcttggccggtacacagatgcgtggaccgcaccaaactgtgccttgatcgtctatggagaaattggtgtctttcttctcctgtattctttttattaactcttttatcccttcgtcgtctttctgagcctcccggatttgcgactctagggtaggctgtactgtcaagctggcagggacacctgactgtaccacggtcagccttaacttctccaattctctgcacaggtgatcttggtcaggccgtatttgagctacattgcaataggccttgcgacttagcgcatcagcgaccacgttggctttaccaggatgataatgaattcctagatcgtaatccttgattagttctaaccatcttctctgtctcatatttaactcggtctgtgtgaagatatacttaagacttttgtgatcggtgtatacttcacatctattcccgattaaatagtgcctccagatcttaagagcatgaaccacggctgccaactcgagatcatgggtgggataattgacttcgtgaggcctgagctgcctggatgcataggccacaacccttcgttcttgcattaggacacatcctaagccttgtcttgatgcgtcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaatccttcaatgaatcttcgataatatccagctaagccaaggaagctgcggatctctgacacattcttgggcgggttccaagcaagtacagcttcaaccttgctgggatctacttcgacaccgttggaggaaatcacgtgtccaagaaatgctactcgatccaaccagaattcgcatttcgagaatttagcaaatagttgatgatctctgagcttttccattatcagcctcaggtgttcagcatgttcttcctcattcttggagtatatcaggatgtcatcgatgaacaccacgacatactgatccaggtattccataaagattttgttcattaagttcatgaagaatgctggagcattggtgagtccgaaggacataactgtgaactcatatagaccataacgcgttgagaaagcggtcttcgggatatcttcagatctgattttcagttggtggtaacctaacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccagttcttcgatttgtcttttaacttctgctaactcattagctgccattcggtagggtctttttgcaattggtgcagtgcctggtgccaattctatggcgaactcaatctctcggtctggtggcatacttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttccttaattctaaggttaacttccgggcatatttgagttgcccttatattccttccaggggaatgtactatcattggtacacgcaaattttgggttttccaaccatttcttttcacaaaagcttgcgatatgaaagaatgggaagctcctgaatcaaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcttgagagctaggacgagactgagctgccgctggagtaggagttctggcagtgctgccattagcatgccctgagttggtgttggtaggattctgaggacactgtctagcatagtgacccatatggttgcatcggaaacactgaactgctgatggtccctgcggtgacttgaaagaggtaacactgttaggcgcagtattgccactaggggcacgctgctgtggctgaggtgccggacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagtagtgctttgttgatcatatgttgaaaagtggggaagtcatgagcaatcaactggagtctcattccaactgcgatccccttcaagaatttcctgatcttcttcttgtctgtgtccacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgagcattgcagtaattctcccaccaatctacggcaggacctcttagctggtgagaggcgtagagcgtcttctcaaccggagtacactgcactaagttgagttttctaacaacatctttcaaccaatcgtcagcctcgacgggctcgacggtctgagagaactctgggggacgagatctcagaaagtctgtcagcttggatctgttgttgcctatgtgagggtggccatttccatgcgcattatgctgaaaattggctatggctgtggttagtccttgtaagatttgtgtctgaactgccattaagtgttgcatgttgttttccacatgaggtggggaagggaggcgttcttctccagaattgtgactggcagcggggtgagagtggtgagactgttccatctctgcattacgggaagctgtgcgatgcgagaggctgctgcggcggggttgctcgacttcggcgttacgggaagcagtacgatgcgaacggttgctgcggtgagactgctcattagctgattaatgatttgcttctggctcaactctaccatcttcaaaaccaaggcgggctggtgcacgagctgcacggcgggggcggctagccatctaaactcccagaaaagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcgctaccttgccacgactccaaaagagttggcggcggaacaaaagggcctaacacacggacagctgctgaagactgcctcctctactcctcgtcggcctggctgccccctgtagtcggctcctcagtcgaagaaacgtcgatcggctggcgcgaagggaccggcggaacctgtcgagggccggcagcagcacgggccgctggcggtgggggagctgggtggcggaaacggaacacggtggaagaaccaacaatacgcttccgcgcagtgcggataaagcgtgggccacggctggaagaagcaactggggtgtgtctgggggtgtaggaagggctaactgggtgtgggtagggggagtacactggtgagtacggcgcacgcgagctgggggagcacgggccactgggagtgcggccagagccgcgggagctgtgggagtacaggtggctggcgtgacagagacggcttgagtcccaaaagatagtgtcaactgaggtgacaccctcctcggccagacgggcctccaaaccggcgtatcgtcgggcaagggatcagtaagcctcaaggagtaggtcgtgctgagtggcctgagcctccgaaagctcgaccatgcgagttagcactggctgagactcgctgtacgggcaagggtacctggcgtctgagtggccagaaggaaggcgtggaagctgtcggaaggcggagcctccgagtcggtggctgtagtcgtgggccaggcgacgaagcgcagtccaggagaggtcctggtacgcgatctggtgagtgggcctggccacggtgaagtggtgtgggcgaaggccagctccgtgtatacctccacgggggtaaaggtatacagagagctcacagtgagggggaacacggtccacggagtaccccgtgtactcgggacaagagaagccaaggaaacgggcgaggtcacgaagctgggcgacgtggtgaccctcaccaaaaccgtgggaactgaagctggcgttcactgccatctacaattttgaaggagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcttgtgctctgataccatctcttgtcatgccccgaactagttccgaccggaactagcccgtgacgctccaaataaacctgttaatcgataccagtcccaggagacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcatagccagcttgctcctggaagaacacctcatcagcaggatccgcttcatcttcttcagcaactgggggggattatttaaatagagcaagggtgagtacgggagtactcagcaagccaggggaaataagtgtttaatgcaggcttcaaggaaaggctgttgttttcgtaattgaatttatttgaactcttttctgaaaacaactaagtgagtgcttctcaaacgacacggatgagacagtgcgtctcgtccggtcggagtatgtgcaatgcatcagtctttagatcttgaaacagggttggcactcggccaacagctttttaaacggcctcccgggccaacaactcttcaaacggccacccgggcctagctgatcccgtcagctactgatttttcaaacatcgaaccccttttcacaacagcaatttcacaagcagtagacaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgtcgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaatttcaaggaatcggtccttaagtgcaagagcgggaaaccgtacacccggtacgttccccggtccgcggttttggaaattcatttggttcgcaagcaccgacccaagtgtcgggttttccaagtcttttgtaaaactccagttttacccaagttgttactcagattttaagtttgaaggcgaccgtcgatactcgcacagagtgctcgagtatcgaggcgcaactgggtggttacaaggggacgtggtatagcaattaacaaaggaaggatcaaatgcgaccaattaggtaggtccgccaatctgccttgcggacgggacaaacagattaagtgcgatcctatcaatgcataatattttgcaagcaacataattaaatttcaaatataggctcaagatgttcaaaggtggcttgccttgctcgagatttggagcttgatcctcgaaatcctcgcactgcgggtcttcgggctctgaaactacacgcgaaacgggacaactcaacaaacggcgaaaataaagccctattaatgacctctaagcgtgccattagatagatctcgagatttggggaattttggaagttgaacggagtcaaacggatttacggctgggaagatattgaatttccaagattatcggatttttggtctaaaggaaaaaggattaaattaaatcctttttggaaaagaaaaagaaaataaaagagggagggaacatagacttttctcgggcggctagggcgcggcccaagagatttggggcggctcgaccgagcttaatgggccggacggcccaagacggcccaagcgcgcgcgcgcgcgggagggaggagagagagtccggtggaccgggctcaccacgcgcggtcccgggtgggacccgcttgtcagcggctcggctcaccgtgcggagggagtatgcggcgtacgcgcgtgggcggggctggaacgcggtgcacgcgcgcggttcgcggaggaacggatgcggcgggcccacgcgcagcctcacggctcaccgcggaccacgcgcacggggagaaacggagggagcggctggccgggtcggcttatccggtcgcggccgaggtggcgccgacgtggcgctacgtggcagccacgcgggccggcgggaggtagatgacgacccggccgcgaatggacggcgggcgatagcggcgagcggcggggcgagccacggcgataccggcgaaggcgagcacaccgggtggctgcacaggacgaggagagacgagccaacggctcggattcgccggagggagtccgtcggtggcggattgcggcggtggcaaccggcggagaggaaagggggaaacggcgacgtggtcccgaggggctaattcccggcgacgagagcatcttcgcggctttgggaactcgacgcttgcgtcggattgggcggaactacgccgagcgaggctggcgacgagcgggtgctacggagctcgggcggcgacggcggcgagcacacggcgagtgacggcaacggtcggggcggcgccggctaactacggggaggctactcaagctactaccgaaagctagggggaggagatggagcgaggaggaagaacggagagaggcactaccgtgcggaggaggggcgctgtgacgagaggccgacggcgcgggagtaaacttctccggcctcgggccgacgaagaggaagaagaaggcgtgcccggagtccccttccgcgtccacgaacgcactggctcctccgacacgcgcaacgacgattggcgacggcgaaacagagggcggcaaaggcgcggaggcgaaaatgagggagggaagggaggaggagacggggcgacgcggcagagggaaaggagagctcggcctccgcctcttggcggcttgcgcgcggagtggcgggggccgggggatgacgacggcgatgacggtgggatggtttggagcggcgcgacgacacgggcgacaggcgcgggctggcgcggcagagggtgacggcggcggcgaccagacggtcggccactcggcttgcgcgcggcttgcaacgggcggcgtccgcgcgggcgcgcgcacgcgaacacggcgcgtgggaagcggttttgcgagcgggaagctcgcgcgaggggaggggcgctcggcgcgggcgactcccgcgcacgcgcgcgcggcgcgcgggcggagcggaggggagcggaaaaagaggcgctcggcgcggctctcgcacgcgcgagcagcgagcgggcgagactgagcggggggggggaggagcgcgccggggggagagagagagagagggagagagagagagagagagagatgggccgaggaagggagagatgggccgagcgagattcggcccatcgaccttgggggaggcaaaatagacttttgcggaggaatttgattggaaggatttggattcggaattgaactcgacgatagatcggggattgagatcttgagatggcacggacactagacaacaagcaaggaaacaaatttcgcaattagggtttttaagagataattttcccgctaggcgccacgacggaacgggcgctacaatatgtaaattacttttagactttactaaatttacttttatatgtctaagaagtaacttggtgaaatctaaaaataatttagacatatcataaaagtaatttgtgattttttattaaaatataatcatgtgagatcttgttgtaaagatttaattattacaaacacaacggtgtaatcggattgtaaatcagatgagtaatttaagagaaaattttatttgaagcatagatgataggaatatttcccccacttgctcaatggattaatagcaaccaaaactcctaaagtactagcacgtggatgtctctggttaagactaattggagaggcctcttcaattagatttaccgtttgatattggtacaattttttgtctggatgcatgcatatgcatgtgtcggcgacatgggaccgggagtatcatgactagaggcttgggcagccgcgatcacccacgtggcctgaccccctcgggggggtcgggcccgagggtgatgtggccgcccctccctttgtctccccgaggggtcggaccgctcccgtttcggccccgagggccggggcgccccgaccccctgtgggtttggcgccacgtggatgggttaggtgagcacagcggggctcacctaaccgcatttattgcgggttggacgagcgcgtcacgccgcatgtaatgcagcgcagcgcgctcgcttatccggtccgtgaccgggcgcagtgtgtgaccggtcacagatcggtcagatcgcgggttaggtggtggcaggcggcctgttacacgcctcgccccgtcccgtcgaattgatgagagcttccaggcacttgtccctagccggagacggcgtgccagctcctgaagatggcacgtcggtcccggtcagatatatgccaggcttcatcgcaaccattgcaaggaagtcattgtatgaagaagggcagacatgcagcttgctgaactgacgcgtggtggacaagagtgaccggtctgtgactggtctgacgcctgtcatgtcataggcagacaaccgcgctcccgttttgcacctccttccagcggagtggaggtagatatgacccatcccatcggagggtcattcggacagcagctattgcaaatctccgcccatttatgaagggatgacagggtgatctccgaagtcagacgagtgaggacgcctggccacactcaagaacaagctgtgttttagcttccaagagaaggcgagccaagttttggtgaagataggatgggtccccacccaaaagaaaagtaggtagaagtggagcatgtgggatccccttgagttataaaaggaggaccttgcccaccaaaaaggggaaccaaaaaaggaggggatcgaaaaaaaagggagatcagaggaagacaactgagagaacacctgagctctctagttctccaactctctgtaattccttcacacacagatccaccagaacactggagtagggtattacgcttctcagcggcccgaacctgtatacatcgcccgtgtcttgcgtgttttctttctcgcgaacattccacagaccaagggcttagaatctcactcagcgcccccggctgaaccggcaaaggggggcctgcgcggtctcccggtgaggagccccacgctccgtcagcatgttttccttctatcgcataacctgacttatcatgtcattccgtgaactttaatttctctgacttatcctcagaatctgcataagtcggcaaagaaaaggccggcaatgttacagattttggcagcaaagcaagcaaataaccatgaatcgatgaaagcatatggctattagaaccaaggccctcaaggaaaagctcgccacccgctcagtgatacttcaacaagtccttaaaaaaaattcaatctgctcaatggtcaggagaaaccctccccacaggcacttaaaagatgtgagtaattctacggtgtttgagaatgtacaaaaaaatttagtgtaattgctctaaagatattgcaaaggcgtgcaaccttgatgcgaaggccacaatggaatgggccggaaaaggtgctcagccaagccacatgatcagtgtaagcaaagctaccacaatctcgaatttctcttatttacaagaatgacacttgacgacttagaagcgtttatagagtatcacttggcggcttagaagcatttaaaggatgttaatggcgatcaactgccagtggcgtgcccacatacaacttaccggtgtcaaagggcaccgggtaaaattgttaaattctaactaatttatgctattttgattagtatactagtgaataagtagataactactatgtagtggacgccaagtaatttttgttctaggttcgccactgtcagcttcgcccaacctttattgctttcggaccacttctattacctgttatactacctttaatctcttttatgttcctctagttatttgtagtaagtaccttaatgctacctcttagtgtcttcagaaccttttacgaatcctctacaacgagcaagatgaaaaaaattagatgaaaaaaaatgaaaaaaaatattaccaaattcataagaaaaggaaaaaaaaaagaccgaaataatatcctatagcgggtgtggtgggggggggggggtttgaaatttcgttccgtaattttagacttatcatcgactccttgcaaaaaaacacacacataggcatgttctgagttctgaagtactctgcaccttatcacctcggccgcggcctcccgatgcagggtgtgcaatgctgtctcctgcgtgtcgcggcggcacgactcgacgagctcgagcacttggtcgagggccttgttgagaatgttcgtccttgcctgcagcgttgggtcctcgtcgtcatcctgctcgtagcccttcacggcttgggcgacttgcttcgcgtgctgggcgagctcatgcatggcagcgcttcttgttgttccggtgagccctctgctccgccttgtcgatcttgctcgccagattcactatcgcagtgacaacggcaagcagctccatctcgtatccttgatcacgtacccttgcttgcgtgcttagtttagagagaagaaatatggtgccgttgctcctgagagaagtcttagttgagttgtcatctctttgaaccatgtctcatatgattggaataagtctatattgcatgctgatcgttggatcgggtcatgccgggctggcatatcgtgcaaagaaagaggcccaaacacaaaccaatagttgggccggatgacttcgcctatatgtgtcaacatcaagctctcgaatggccgcgggccaacgacaatggctatggcgatggtgatggagtccgaagccatgtacgaggaaagaaagctggtgaggggattagcaagggacggccatggcgcggtcgccggcacaaagacgagcaactacttcagttgcgttgttgatgtcaatggggttcggagtttaaaactccgaccccctctaccatctccgatcaagatagtgcccgcaatttgagcacttagcccggtgaagagcaccacggtggactcatcgtagttgaagagtacatgcaacaccgacgaggttgccattggcgagtagagagagcacatggcaagggcagtgacgaggccggagaagaacacgatcatcttgtcgagttgttcagggagatggatggtcgagatgttccagttctgggctgcactttttcttaataactacttcatccatcccaaaatataagcatttttagcgtagagacaagttaaatttttttaactttaactattaatagcaaaaaaaatttaaaagatcaatcatataaaattgaagatattagatttatcattaaacaaactattataatatacaactctttttatataaaacatcttacttttgttgatattggtgatcaaagtagcatctcgtggactgtgtcagggtttaaaaatatttatattttaggacggagagagtaaatatattggtcaattaattaattgacgatgattactcattcgtggattgttagggattaccatttttcaagattcttaattatgttaacaccaaatcttgttttatcattttttttttgtttccatatgctcccagcgttattagttggaatggaaataagagagcgagaagttcttcccggaaaatttccctatccccacacctcgctcaaaaccgtaaaccctaatctcgccggctcgccgcgcagccgcaggttctccccagcgagatggacgaatctccggtcgccaccgtcaccgatgactccgccgagaaggtgagcctcgtcgacgctgaccggagcggggataggagaaaagcagcggcggccggggagtcgcacaccagcgacgacctcctcctccgccgccgcctcctgtacgagctgaggaggctgagggaggcgaagaaggcggagcggaagcgcgacgcccggtcggcgaggctgatcctcctgtcgctgctgctcgcggtggcgacggcgccggtcctcctctggctctccgccggcggcgagccgctgctcctcgtgtggaggctctcctcaccgcctacctcttcctttgcgccgccctcctctccgtcacccggggcctcctcgccgccttgcttgcttacctcgccggccataccatcaccccgcgcgtcggtatggtggtcgtcttcctcgacggatgtcttcctcaactccgtctccgcgcgctgctgccgtcggtatggtggtcgtcttcctcgactccgtctccgcgcgctgctgccggatcaccatggccgtgctctcttcccttcgttgccaccacggtgttcgtcgcgtgggagctgatctcgtggtggctcaccatcgccgatttccccgtcgacgagatcgtcggcgacctgtccatcgtcgtcatgttatatgtcttttgcttcctgctgcaaatcggagaggaaaactcacttgtactctatcatcgccgttttggtagtcgtcgcagctttgcccctatttttctccatcgtctttggtatgttgccccctttggggggccccccccccaaaaatttttggggggggggttttttggggggggttttttaccctttttttaacccctttgggggggaaatttttggggttgggttcccctttggacacttagaacctgtatttccttgggtatcgtctgcgactctactcttcttaccagcagcacaaggtgatgatgatgaggtactactacataggagtaataatctatttgaccttggtattgcacattttgtggatttatattactactcccatgttacaaatgctagtaatgctgctctatgcctttgttttgccatgttacaaaccttgttgaactactgttttgtatgcgctccttccttgtcatgtatgagcagtacatacggtggagtacattatatgctggagctgaattactacttctactgtttttgttttatactacactggtgaagaaaccttttgtagtccgggttcgtaccccccctttagtcctggtttccaaaccggaagtaccaatccgggactaaagatcgctatctttagtcccgggtgaaataaccgggagtaaagatcgatctttagtcccggagctgaccttttttttttgcatggccctgttgctgcatggtttatatatatatatataacccatacatatatatgcatacatatatatatatatgtatatatatatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctaggtagctacgatttcgacgtagtagtactcgctgctagctcagaagctaaggaccggtgaattgtgtttccgttgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtaatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagaaattaacataacaagattttcttaattaacaaaggaacttatgacggtacctgtctataagttcgaaaaccttgttaaacgtagactcttttttatccattgagtcatatacgttgacggtgcaggcctccaggtcgaagagtaaaagcacccagtggaatctgcaatgtgcgtgagatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgcttcttgtggatattggtcgagcattgcgacgtttactttccaagggtcgatgaatccagtatcgaaaaccctccgccgtcgggccctttgaatctccattctacaatgataaaagggagtatattattttctatagtctacttatatacaaggatctaattaattaaaggagacgtatagtaag

SEQ ID NO: 14902 - DNA, 649 bp, Oryza sativa
ccacgtaccaataagagctcatcgcagcaggtgacgcgtgaccaaagtcgtcgagaagaagagataagccatggtgtaggaaaatcacgcaggatatcctccacatggtaaccatcatcatcaacattagtggcgacggtggagtgcggccataaaatcatccaagcaacatataatgtcgggacaagcaatgtcatggagatcaccgccgccgatgagatgatcacggcgcgcgtgtactaaatatatatagttctaaggagagctcaaaccattacatagaacattcaacttttagtaatgttatggtgtgtcctaatgttgtactagtcataagatgaagctagtacacacaatcatgtgcacatcagtttaaatgtaaacacaattgtcttatcattatttatgtctttgtgaatttttgaaaatataaaataattaatctaagctattagtaggatatgagatgaggaaaactaaaggatatatagtcttgtacaagtcacaaaaacaattgcagaacatgagtaatcactgttaatattatatacaaatcatttgattatggaataggagccaatgcaatttcatataaaaataagaatcaaagactgcagatcaataagataaagttttttcaattccataa

SEQ ID NO: 14903 - DNA, 7785 bp, Oryza sativa
  unsure (1)..(7785): unsure at all n locations
aatcactagggaagacaatagttcacctcagttatattactttcctgtcccgaaatataaatctaggagttgatcagacataacctattacaataaggatatcttgatatattgtacaaggttatgtccaatatatcttttcttaagtcgctactcctttcgtcccaatatactgcaatctaagatatgatgggattatattcatatatccatattcgtagtcctcctatcctaagactgtatattttaggacaagaaagagtatgtgagaagagtgggtgccttgaatgagaattaaatgaagctaggatgcacttaattagtacttcctatgtattgtacggttatttgttaaggaagaaaagatttgatctaaagtagacttgacatgcaacaagatctgtcgctcatgatcaccatgcagagcaaaattttaggaactatctatatatgtcgtcgtatttttataaaaaatagtcggcatatatttatattgtaaattcttaaaattatatatgtaagtgaatataagtagatgtaagtacaatctaacgaacatatattgtaaaaaacaagcacattcacaccttaaaacgggcctgcaaaaactccacatgatagtaacaaataacatcccaaccaaatcacatgtaaaaaaaataatacatatcttaaaacagcaagcgctgctatgaactatgcttgatattcccggagaaggttttaatgtaaagttaaaaggtataatatgccgccacggaaaaaaaaatcaggcagaccaaaataggcaaacaactaaagatctatacctatacgtgtggagcaagcggacacggacaggaaactgactgagattaacaaaatgtcgacatctttctagcaaaccagaaagtcttttactactgctaaaactgctgatcagatcatcatgtatctatatgatctgaaatgtgtccaaatctgtgtccccactaaagcaaggtgtgtggagatgtgtagactcccaggcccgtatatgtgtagcagtacaatggattttccttcagaaacaagcattgcatgcatacttttacagctggttgcctttgtgcatcatgtggacggcccgagaggagtccgttggctccgccgtgccaccttttttagagtgcaaggacaaagttacattcgttatagttggtaacatagtcaatttcgtccttgaaagtttggtcttgacgtcactttgattccggatgtttctctgtccaaaccagcctgaagtcactttgattccggatgtttcttttatcttagagcgtgttcaaattgttgtcattttcaaatatacaattttttaagtaaaattgctaaaaaaatatctacatttagtttgttactaaatttggtaaatacataagaaatcctgccaaaattttagcaatattgccatcttgcccaaattttaggtaagatttattttggctataatctgaacaggcccttagtctatgagcctgccgaggggcggatccaaaggtgggtgttgggggccgccccatcctgttggttccgcatagagagaagggagacaggggagggggaagaagagaagatcatttttttatttttaaattttaaaaataaaccatttaaaaacttatttgtagaatctgaaccttttgatcacgccagcctgtttggtgtaataaaataatactgacacgccatacacaacgggcgtgacagttttgtcatgtcacgtcagcgagggtggcatagtcaaataacgctgccacaccagccaaatcgacgtaaacaaataacattttcacgctaatcagactagcctgatggtgttgttttaccacgctagtccgactgacgtggtcaaaaagatcagatcttagaaataagtttttgaaagggttcatgtttaaagataaaaatagaaaagttcagaaaaatcagaagaggaagaggaagaaggtaggggggctaggaagaggaagaaggtaggggggctggaggaggaaaaagatgaacccgtacaaagtactcatggatctgcccttgagcccatccgatatgtcatatgtagaaaacaactcttcgaagctttgttggcaaaccataatatctaattcacatgttattatgttattaaagtacacggatttttagaaattaatgctaaaaaattaaaaatgttggactcaaaacctagaatgacaataatttgaaatggaaaaagtagtaggctttatttatcttgaatgaagacacaaaaggatgaaaaataatctattcttaacattgagattgagatcaacattaaccttttcttgagttattttgttattagcatggcgtgtaaggtgagttcaacgaccacattcacctaaagacatgttagagatcaaggtcaccctaagcgatgttgaggaaccaaattgattgttctctcattatttattaataacaaggcaccaacaatgcaatttggtcagattagtttcctcattgataaaattagattgattactttctgtagtaatagaaaggcaaaatttattacaggacacctaaaaaatgtgtaattaaccgtgggacaccgtaaagacgcgaatttgctcgaggacactctaaaaaatggtaatttgctgcaggacactggacacattaaaatataatatctagtcaattgataagagagaaaccacgtaaaatgacagttttgcccttatcttcttctcccttctctcgttcttcttctgactatcctctcgcgtgcgtcccctgttgtgagtgcggtcgcaggccacgcccgccgccacggactcctcaccgctgttgtggatcgccgtgccggacatttccacttctttttataggccactagcatggaacgaccgctatccgtcggcgcgccagcaggagagggtagtggggacgggaagaacgactcgcacgcatggctggctcaactgcttatcgtagagctggaggttgtcggcgaaggactccggcgagaagcgtgcgagcaaggtgttggagcacccgtgagcttggcgacgtcgggcgggacggagccagggagggagaagaggtcacatgggacatcaccgaagaggtggttgcatcgaagggagagcacctagaggcgtagcatccgatgaggctgacgctaggtgggcggagaccaaggatggtggcgttggtggcgtcgcaggtgaagccgacccagtcgtaggcctgcgtggaggggttccaggcaatcggccgctggtgcatgtgcccatgcgcgccccacacgacaagctgaggaggctctactctatgttgggcaaggacgagaggaagaagaagataagggcaaaattaccattttatgtgctttctctctcatccattgactggatattatattttaatgcgtttagtgttctgcagcaaattaccacatttttgaagtgtcctcgggcaaattcacgtctttgcattgtcccacagctaattacactttttttgggtgtcctgtaacaaattttgcctaatagaaattagtacttatcttagggacaaatcgaggcacccctttaaaaggtttggtactatatatatcttcgttaatgaagcaagaataatcgatcgattccccttccaatgatctgtgccctagtctatgtctattcctcttttctagaaccctaatctccttcaagctatgtcatctggcctttctcaacaagatagttatcttgttgtgactaaattttctcacattagccctgggccacttttctctctctaggtgttcaagtggttacaaatgacaagcattcggacattaatggttaagatatctcaagcaaggtagacatttcaaggttcttgttagacacatatagagatggcaatggttgtgttttaagagagtgtcaatataaggtatatatgcagggggcggatccaaggcccgatgaccctaggcaacccgggctcaccgacagatcgcaccactaagacgacttgtatttctagtgttcaataacattgaaaattattcgcatatgtgtttgcctagctgaatgagggtgtaccaaacgatagtttaatgcttcatttgagggaatacagataggtctatatatccaaaagaaggaaaagaacacttttaagaggagaaaagacaccattattataatattctactcttttacaattcaactccaagaaattgatgaaaataaaatcatagcatggtgattgagatcaagggataaaattaaagaaattgtactagaccagggatgggcataaacttgtaagctaccgagggtagggataattgtccatgtttttttttttaaaaaaaaagctgaacactaaacaaacatgcataaccaaatttgacatacaccgagaaaaaagatactactccccctacttcatattataagtcattatgactttctttctagccaaacatttttatatttgactaagtttatgaaaaaaaattaacaagatctacaacaccagattagttttattaaatatttcattaaatatattttaataatctatttattttgtgttaaaaatgttactatatttttttataaacttggtcaaacttacaaaagttttactaaaaaaaatcaaagcgacttataatatgaaacggaggggataaaaaaatctgcttggattgtgcacgaactattcactgttagattttgtcattttgattctccaggtgtaaaaaaagttatataatcatattctatgattccagttagtctcgatctctcagaccaaatcgggctagaagcccagaatcctcccaccccgtgccacagcccacacacggcccatctgaagagatcgagtgtcgaagagaaaaatacagtggcagccgcgcatcgcggtggtttctctggaaaatgcctcaaattgggcccccgatgctggcgtggatgcatcgagcgcctgcactcctccgcggccccgcgcacgcgccgcccccgccacgtgtccccaccacgcacaccgttgtaacaaatcacctacatattatggaaaccctctattaaaggaattcgtttcatttttttatgcacaaaaaatgtttcactatatatggatcaaatgttacaatgaattggaatattcttttgcaacaaatcacccacgtattatggaaaccccctattaagggaatccgtttcattttctgttccattaaaaatgtttcacttagtgtactcgtaatgtttcactatatatggatcaaatgttgcagtgaattgaaatatcatttcgctatttgctaaaatattgtttttacgcagggtgaaacaaccccattttttgagaaaccgttgtttcatatattttagtaaaatgtttcatgaggtgatttggttttgtttcagtttttttttaaaaaaaatgaaacatttgcgatctacttagcgaaacaattctgatttacttgatttaacatgcaacatttaaaaataattcaataataagctaaatatttttttatcggattatatccatgtatggtactgttttaaagatttaattggaacggatttaatggtgtcatccgaccatgatttgaataaataatttaagaggaaaaatagttttaaagtttgtctaggaagttttgcatgtatgcatgcatgtatgatcacatttgatatcgtgggcatcttatttttctcagaaaaaatcgagcacctggtccgtaggcgcctcgggtttctctacaaactcggccacgcgcaagcctacgctcgccagcccgcgcgtgcgcgcgctcttccacccattcatgcctcccgcttcctcctccacccaatgccgccacagcgcctcgccaccgccaccgcgcaccaccccgccggcccgtcccgccgccggctccaccaccgccgcggcgcgatgttctccgtctcctgctggcgcatcggggccatcgcctccctcgtcgcggcggccgcggccaccaccgtgctcctcaacttctccctcccatcctcaccccacgtgcccgccacagacttcaccgggaaactgtccgccgcgatctccccgccgccaccgccctcgtcgcctcctccagcaccggcgacgccgcctcctcctcctcccgcgccaccgccacctgctgcaaggccgcgacgaagagaggtacgcgatcgatcgagcagaggccgatccaaatctaattattatttattcgtgttagcatagtgatcgatcgagtttgttaattcctgcgtcgaactggtgatcagccgtcgtattggaggatggcgccggaggaggcactgcggtacgccaagaaggagataatggccgccgggccggtgatcgacgaccccgacctatacgcgcctctcttcaagaacgtctcccagttcaagaggtataatattattggtgcatgcgtcgcttcttcttccgttcctcgtttcacgcaccagctaccaaattaaagttcgtctcattctagcatgttttgataaacaggatgatcgagttgccggttttttttctatttctctggatttccggacatgtagaagcgtgtatttttttttactagatttcgatcgttttttactatgttgatggctatacatcttatatatgtgtgtaacaactaacattctatcccttatgctctttcaaggaggtaataatttttttatatcttaaattctcttatatagtgtgtattggaaaacatatagattaataattaaaacttacagtgtaattatattgtaagtttttaaatttatagtgtaattaaaatgaaaatatagatatattacagtataatactgatttgactacattttagtgaaaattaatgtatcataaatatatctagtgtcttatatttttaaacgaaattgtgatgtcagatcagacaagtcaatgggccgtggtttgtacccaagaggctcactatttcggaacgggaaactttcaggggaacaaatatttagaaatttccattgaactttagaaattttgatcatttttttagtaatgaaattcattccagccttttcttcaaagaaactatagataatttttacataaggttgtgggacgaatgactactattgctaaacctcaagctatggttagcgagaatttacataaccattgtaatttgaatgaaacattttgaaatttaaatatttttcatgaaattcgaataaatttggggggttatttttgcgtcgtaggaaaacattacccaccccaaaatcacaattcgaaattgtttttgaacaaaaagaaaatccggaattgtgaacatctccatacatgattgttagtgtctcccgatttgcgttccttgctgcgtatattacttcctctatcctaaaatatacaaagttgttaattttttacataacatttgatcatttatcttatttaaaaaatttatataactattatttattttgttgtgactctttttatcatcggagaaattataatcttaacttatatttttacatattttttttataaatttttaaataagacgaatgatcaaacgttaattgaaaaagtcaacggcatcgtacattatgttgaccactgataattatcaaaccataatatttctgcattttgtacagatttttgtaccactgataattcagtatggtgactnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14904 - DNA, 521 bp, Oryza sativa
actatagggcgaattcgagctcggtacccctgccagcgagttgcagcggcggcgtcggcagcgtcgcgcgcagtggggagggaggcggaggccggcgcgcagcgcggggagaaaggggagccgggcctggcggtggaggtggtggcggcggcgtctgcatcggcgcgcaaggagggaggcggaggccggcatcgacgaagggagggaggggagccgggcctggcgacggagacggcggcggcggcatctgcatcggtgcataaggagggaggtggaggccggcgccggcgaaaggagggagggaagccgggcctggcggcggtggcggcggcgtctgtatcagcacgcaaagagggaggcggaggctggcgccggcgaaaggagggaggggagccgggcctggcggcggcggcgtctgcatctgcgtgcggggagggaggcggagaccggtgccggcgaaaggagggaggggagccgggcctggcggcggcggctctcggtggcatcggcgtctgccgagg

SEQ ID NO: 14905 - DNA, 599 bp, Oryza sativa
cctcctgttgttgtcgctgatggcccgcccttatgtcgtgtgtctgcttgattcttgcagggcatgaacgctgtcgagcgcttcaagactgggttcgagaatttcaggaatactatatacgagtatttttctgatgccctgagagttcgtcggtgtgtttaatacgattttgtgctaaatcgaatctatttgtttttgtcggttttcagcaagaggccggagctgtttgagcggctcaagactggccagtcaccaaaggtatagtgctgccatcagattaatagttttatacatagattatgaaacctataatttgttctttccagcacacatagaatgcgccggcataatttgctgtctctactaagaattatgccatttggagggtgcatacctcacattacgctcttttggtttgtttgtggactgaagtcaaactcgactaaggaattctgatgggaacagctcattaccattgtgaccattgagcaatatatattgataaaaaaaatagttgacaaaattttcatcttcagtacaaagtactagtggaatttcttcaaaattctacattagaggaactaacatgaacaaaagca

SEQ ID NO: 14906 - DNA, 1995 bp, Oryza sativa
cgtcccgatccgatggaaagacctccacacatcaaacggagcgatagattaacacataattaattaaattttagcaatagaaaatttagaatttggattaatatgatttttaaagcaacttttctacataaactttttgtaaaacacgcaccgtttaacagtttgaaaattgtgcgcgtggaaaatgaagaagatgagttaggaacttagataaaagaacataacctagggaagtcaagtgaagggaactcaaccaaatcactgatctcctctcccgaccaattcccttcttctgttgtactcccctcgtggccctgtatacgcgactggtaagcctggatcgttgcggcgcgcctcctcggttgttggctctgggcatagccgcaaggacgcattgtagcggataggaggcgatcactggtactcaccgatccagcagtagttggagtactgactttcgagtcaccgcgatcggcaaacagaatgcgcactcccgaacagcgacagagagctaagctctcgcggggcaaggggaccgttctatcgttgtcggagcagatcaacgaatcgtggcagtgcggtctcatcggctctgtgacttgtgcacgccgatcgcgctatgcatgtgggtcctagcttttgggggggtaaaaaacgactctacaacgatgcaccaccgcggggcgctgtgtcggtggcacgcacgcatcggtcggacgacgggagtggtttcgcgaacgaggccacggagctctccacgacccaactgcgccggtgtaccgtatcggtgcacgtctgacggtgaaacccgggcggaggagtggaagtctgaagcctgcacgtactgaaagcgatatcatacgcagtggaaagatgggatatgtcggtcagtccagccatttaatcgcgtagtacaaaccttaatccggagaacttttataatgtgcacgatcccaaactgacagtacaactggtgtggttaccctttccagtagtaccatttaaaatttccgctaatttcaactgctttctcaattcaattttctttatagaaaaaagggttaccaaaagttcattggtcatattaacatcaaaatttggtatgattcagttaagaaaaaaaaaaccgtttgatagataaaagtttattagataaggttgagttcaaggaggaattgtgagaccacggcaaaaaacagttttgtaatttcttagtatatacttcttccgtttcacaatgtaaatcattctagcatttcccacattcatatcgatgttaatgaatctagacatatatagaatgacttacattgtgaaacggagggtgtatctcttaaatttgtaggattagttatttttcttttttttaaggaaactagtatggtggcccgcgcagattgcgcggctagcatcattatattttctctcatatgatagcatttatgttttctcattatattattcaaatatattaaaatgacaacataattttaaattttgcaataactttacaaaactattaatgtgtaatattcatattatattttatatacgtgttagttattaattatttttaatatcaaattttagttatttgtaaattatatatatttctatatagactctagactcgtcttttaatatttcttttttttaattccgaattttctataaattgtatttctatatagactctatgctcttcttctaatattatttatttttatttctgaattttcatattatattttatatacgtgttagttattaattatttttaatatcaaatgtttagttatttgtaaattatatatattcctatatgaactctagactcatcttttaatatttttttaatttcgaatgttctgtaaattgtatttctatataaactctatgctcttcttctaatattatttatttttatttctgaaattttattatttctaaacggatttctatgtggactctaaactcatctttcaatattcttta

SEQ ID NO: 14907 - DNA, 2644 bp, Oryza sativa
cgtcttttaatatttcttttttttaattccgaattttctataaattgtatttctatatagactctatgctcttcttctaatattatttatttttatttctgaattttcatattatattttatatacgtgttagttattaattatttttaatatcaaatgtttagttatttgtaaattatatatattcctatatgaactctagactcatcttttaatatttttttaatttcgaatgttctgtaaattgtatttctatataaactctatgctcttcttctaatattatttatttttatttctgaaattttattatttctaattgtatttctatgtggactctaaactcatctttcaatattctttaatttttaatttcgaatttcagctacttctaaattgtattcctatattgaccttaaactcttcttcccatgtttttttttatttcgaattttagttatttgtaaattatatttttatacagactctaaactctacttttaattttattatgtttattccaaattttagttagttttaaattcctatatggactctgtcggtgacatgggaccgggagtatcatgactagaggcttgggcagccgcggtcacccacgtggcctgaccccctcgggggggtcgggcccgggggagacgtgccaccccctcctctgtctccccgaggggtcgggccgctcctggtttcggcccgagggctggggcgccccgaccccctgtggtattggcgccacgtgtgtgggttaggtgggcacagcggcttctcaccaaacccaatttattgcggaatggacaagcgcgcccacgcccatttaatgcagcacggcgcacgcatatccggtccgtgaccggtcgcagtgtgtgaccggtcacagaccggtcagatcgcggagtaagtggcaggcggcggcctgtcacacgcctggccccgtcccgtcggaatgatgagagcctcttggcactcgtccctagctggagccggcgtggtacctcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactggactgacgccggtcacgtcatcggcagacaaccgtgctcccacgttgcatctgtttccggcggagtggaggtaggtatgacccatcccatcggagggtcattcagacagcggccattgcagatctccgcccattaatgaagagatgacagggtgatcccctgtgtccgacgagtgacggcgctgggcatcactcaaggacaagcggtgatttagcttccaggcgaaggcgcgagtcaagatttggtcaagatagggtgggtccccacccaaaagaagagtaggtagaagtggtgcatgtggtatccccttgagatataaaaggaggaccttgcccacaaaggaagggggacgactctgagaagactggagcttggaggggagatcgagagaaaaaagaaccagaagagaaggaaaaagaggggttctagagcttgaactctcttgctctccggctctctgtaactctttctcacacatatccaccagaacacaggagtagggtattacgcttctcagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagccccacgctccgtcagactctatactctacttctaatattccttatttttttaatttcgaatttctattttttttcttaattgtatttctatatggactctatactctacttctattttcaattccaaattttagttatttcctaattgtatttctatatggactctatactctacttctaatattccttatttttaattccgaatttcaattattttctaattatatttctatatggactctatactctacttctaatatttcttatttttaattctgaatttcagttatttcctaattgtatttctatatggactctagtctcctcttctaatattccttattttttaattccgaattttagctatttctaaattgtatttctatatagactctgttttttctttttcagttatttcctaattgtatttctatatagactctagtctcctcttctaatattccttatttttaattccgaatttcagttatttcctaaatgtatttctatatggactctagtctcctattctaatattctttattttttagttccgaattttagctatttctaaattgtatttctatatggactctgttttttctttttctccgattaatgtgagaatttctaggccatgagagcgaacgtggaggctcctttttctatggactctattctcctcttctaatattcctttttttttaattccgaatttcagttatttcctaattgtatttctatatggactctagtctcctcttctaatattccttatttttaattccgaatttcagttatttcctaattgtatttctatatggactctagt

SEQ ID NO: 14908 - DNA, 21432 bp, Oryza sativa
  unsure (1)..(21432): unsure at all n locations
nnnnnnnnnnnnnnnnnnnnnnnnnnnnnnnnnnnnnnnnnnnnnnnnnnnnnnntaaatgtatttctatatggactctagtctcctattctaatattctttattttttagttccgaattttagctatttctaaattgtatttctatatggactctgttttttctttttctccgattaatgtgagaatttctaggccatgagagcgaacgtggaggctcctttttctatggactctattctcctcttctaatattcctttttttttaattccgaatttcagttatttcctaattgtatttctatatggactctagtctcctcttctaatattccttatttttaattccgaatttcagttatttcctaattgtatttctatatggactctagtctcctcttctaatattccttattttttgattccgaattttagctatttctaaattgtatttctataaggactctgttttttcttttttagttatttcctaattgtatttctatatggactctagtctcctcttctaatattccttatttttaattccgaatttcagttatttcctaaatgtatttctatatggactctagtctcctcttctaatattctttattttttaattccaaattttagctatttctaaattgtatttctatatggactctgttttttctttttctccgattaatgtgagaatttctaggccatgagagcgaacgtggaggctcctttttctattcctttaataatataatagattatctcatgtctgatttggacttgtacaaacctgaggatataaatatgaagggacctctagagtcttagtccaggcagatgaatacaatcatatttcggcgcatcgtcaccctagccatagtttcgatgggttcttaccctccagcagggctgcatcggttaagtttgatctccagcgaagggataagccctgtcatcctggtaatcgtatcggtacaattagaattttcccgtatttcgcttgatattctgactagtctttatagtcgtcggtttatctttgatataccaacttttgctaaggctgtatcgcttcgatctcttggttcgatatggtatatccatcacgtttacatagatctatctattacattgttgctaataagtttaattctactaaatcaataagtttaatgtactgttcattggagttttaaccgatgagttatcattattcaaagcttcaattagcagacatatcggcttagttagccgatatacatttaaatctacatgtattagacattaagccaatgtatgttttaatcattggacctgcatctatcatattacactatatctatcagtattggttgatttattcattggttcaattattcatatcatcatggttagttgcatgataaaactaactaacacgctttgagcctaacttttatgacctacattagacttaagcaaatctcttacacctctgtgagttggacaaaatttgtggcaacaaaaaaattgaattcccattgaaattcttagcgataattaaatcggaaagattgaaactccacaggtagacttcctaaaaattgtaatttgattttctatctttcagatgcacaatttatttttcatttatgtacaattttgaaattttcaactacaaccattttcaaatttttgcaccgatgggcgatatctttctcgaggtcagcaatgaaaaaaaaagtggaatttgtgtggtgccaagcacgagggtaccagttatgctttggtcagcaacaagaaattagtaacactctaaaagtcataggagcactggtgcatgccaaactttgtgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcggaccagtcgggagagaaccggatctcagtcccgtttggattcccaaacgcgggtgaaacctacttcaagaccatctcaatcgagtcggcttcaaaccactcggctgagatcgcatcttctccaacgacaccagatcaagatgatggggcttacccaccagtcctgatgaagctccccgacgatttagcggccgtctccacctcgacagggtcttcatcccgtaggcctaggcggaagtcggctccaacaccgattccgcctagcttcagggaagtcggcgtcatcctccagccactcggcacggtttcgacggatcagctagatgactacaacagctctcccaccgtcgactcacgtcctactgacatcgtggagtacgacgaatttagctctcgctacaacgacttcgacgactacgacgacttcgacggaagcctagatgacaactacacccctctctactttggcgttttcatggccaataatgagacggaggagcaacgccaagcccgggagactgaagaacgtcgccgactggaggaggagcatcaagcacgagaacaagaacggctacggcgtgagcagcaggaccgtgagcggatcgccaaggaggctgaagatcgacgtcagcgagctttggaagcagggcgccgagcgcgtgatctcatcggccaacaagacgtcgaagggacaccggttttccgcacccctcaacagaatgcggttgccgcgatcaccctcctcgacaccctcctcaaccaaaacgagctcaatcgttccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcaccggaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccggtggctttagcagattccgcccgatcttggctccatggattgccccgtggtacgatcggatcttgggctgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgatgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgttaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcaggaccctcattgatggtggcagtgcactcaatatcctcttcgccaagaccctggatgatatgcagattcctcgctccgagctaaaaccaagcaatgcgccttttcacggagtaattccaggattatccgcaactccactcggccagatcaccctcccagtcacttttggcactcgggaaaatttccgcacagagaatatcagctttgaagtcgccgatttcgagacagcataccatgccatactcggacgcccggcgttagccaagttcatggccgtcccgcactacacttacatgatgatgaagatgcctggtccccgtggagtcctatccctacggagcgacatcaagcaagccgtcacatgcgacaaggagagttgcgacatggcccaaacccgcgagatggcgtctgcccaagaggaaatccgactggctgcaaccacggtgagcgaaggagaagtgcccgctgccaagatttcaaaaagtggagaaaccgaagccgagactaaaaagattcccttagacccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggatgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttttggactgctactcggggtatcatcagatccgactgaaggaatccgactgcttgaagacttcattcatcacgccttttggtgcatactgctacgtcaccatgccgtttggattaaaaaatgcgggagcaacttatcaacgtatgattcagagatgcttctcaacacaaattggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagactcggcgagcgggggatgcccttcttcaagctactgaagaaaacagataatttccaatggggacccgaagcacagaaggccttcgaagatttcaaacaactcctcaccaagccgccggtcttagcttcaccacacccgcaggagccgttgttgctgtatgtatcagccacctcccaggtcgtgagcacagtcttggttgtcgagcgtgaggaagaaggtcatgtccagaaagttcagcgaccaatctacttcgtcagcgaggtcctggccgactccaaaacgaggtaccctcaggttcagaagctgttatatggtattttaattactaccaggaagctgtctcattactttcaaggtcacccggtaacggtggtcacatcgtttccactcggcgatgtactgcacaaccgcgaagcaaatgggcggattgctaagtgggctttggagttgatgtccttggacatatcattcaagcctcgcacttcaatcaagtctcaagcgttagctgattttgtcgccgagtggaccgagtaccaagaggatacccccgtggagaaaatagagcactggaccatgcattttgacgggtcaaaaagactttcgggcactggagctggagtggttttaatttccccaactggagaaagattaagctatgtgctttggatacacttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaattggaagacaaatttgacggactcgagctcagtcacgttcttcgacacaacaatgaagccgccgacagacttgccaattttggatccaagcgtgaggcggcgccctcagatgttttcgtcgaacacctttatacaccgacagtacctcacaaagatgctactcaagttgtgggcacccatgacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaatcctgcaacgctgtgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagcgttgcaaacaatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaggggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgacttaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtatcgtacaaattgagcctccatgtattacattcaaactcagtcagaatcagtcctttcatcatcagagtcttcattactcggttggaggtcgttgttgcgaaattgctctacaacatcgctcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgaatgcactcggaccaccattattgaggaacatggcttggataattggtgcagcggcattggcgacgttatcccttgctccttcaagcctcttgatcttaccaaccaagacgtcaaattgggcttgcgattttattttgcgatctacaaaacacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatgcaattatgacagcataaatcaatggaacagatctggatgattaccttttgatgaaccactcagctcgaagttggagtcctggagctgtgcaattctttcccttaattccttctccgttttcttggcatactccttggcctcgtgtagctgttccctaacggattcaagagttcccaaatgtggaaccagcttttctaaggttgtagtcttggcctcattacgaagatggattctctgcacggtggttcatggattagtttgctaacaagaaaacaaagttattaaaggcagtcacccggaggacttacatttacaatacgagtggcttctccgagcgctttcttcagctggcacacttcttcatcttctttttgacggtttatgactataccggcggcttgtgagttctcgtcccaccatttgatcaagataggaggacgagagtcgtcggttgcctttatgcgagggatttcctctccgtcatcacctgatggtcctgatgcgtttccaagacattagacggatatactgaggttatttaaatcgccgttgtttgagaagacaactaacctgaagatgtacttagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggtcctatcgcccgaagtatgggcgccagtcggctggccttcagcagtcggctggttttcagcagtcggctcggggtccttggatatattttggtctgtcatggcaggatcggggtcttttccagatggatctatatcagatggtttcctgcagagtgttgtttcaatattcagcattattttcatcggaaaacattccgaagcggaatcataccgagaggtctgatacctggaagatgttctgatctttggcattgcacggccagccagttttttcctgggcatggtacgctttgggggtttattaggcgagcccttatccccagatttatcatcgtcgccttcatcgtcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaccaagatgcctccatagttagtcaactcagcatgaagataaaattatgttctgatcacggtttgagggtttccgatgcatacctgtggaggcggattgaatgcattatatggcacaactggcagttggtgagagtagttgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcattttatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagttcgcatgccatcctttgttcgaagtcttgaagggcatcgagaaatatttttggctcagagttcctcttagttaggaatcctgcccccccgacttcacaaggtttgttcttgttgggttggggcttgaggaagaagatcccggcgtatagggcaaagtgaggtttgatccccaaaaaggcttcacaagcatggacgaaattggcgatatgcactatggaattcgggtttaggtgatgcaagctgattccatagaaattcaagatcccacggaaaaattttgaggtcggaagagcaaagccgccgtaaaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcgctcaaatgtgctgatttgattcgagggatggcttgggagaggtgagggattgaggcggtggatcacgggaaggattttgatgcacttttcgaaggtggatttggccggagttgtgaaccctagttcgccggcgcaactttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggattaactaggaatgacttgtttttattatagtcatttccttggcgtcttatatgcctgtttttatggtaaatagtcatggcctaggctattcgacttatttattaccataatctttataatacttgatgggtaatctttggagtttttatattcggatgcctgtcgagtgtgttcattcgtgaaccttttagagtgtaaaccactcagatttcttttattgtggctaaaaagcagtcggctagcatgcctatttaggcgccgcgtacgcttttgtcatataatgcacgattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactttgatatggagattagaaagcaactgatttgtaacaatagtctggaactaatgaagtgtgtagagagaagaggacaagaggatggtgcaaaagggacaaaatgaattgagtaagcctttgcccaattccaaaggtgagcgtgaataaccctagtacaaaagcgattttcgtatgcggtcaaaagcgattttcgtgtgtagatcttccaaccgtctgtaaggaagtgtccgtaaaaatcacgcggaaatcagatttttcacgtgcgggatggttatgtcgaccgcacgcaaaaataaaaaacccaaaaagaaaactaaccctaaagctgccgctgccgccctccttgcggtcgccgtctccgtcgtcgtagccggattcgccgcctccccaccgtccgagccggccggccgcccaccgccaccgccagatccgagcgaggggcttgccgcctccgccggatccgagcgggggcggttgtccgccgctgcgcgcacgccgccgagccacgtggtgccgcctgctgcgcccgccgccgagccgcgcgcgggagtgagagagaggtgagagaggatagagaggtgaaagagtgagatagaatagaaagaataagtatgaggatgggtggataaggataaaattttgaagtgtcgaggagggaaagaggaggaagaatagacttgtaggcaggtctttaagagatccgtacgtgaaaataagctttcgcgtgcggtcctcttaagggtcagcacgtgaaaatgaaatgccgatttttacgtgcggacgtgaaaatggtatgtctatgatctaaatagctcattgtccagaaaaatcatttctttactggtggcagtacgcagctccaagcctccaacgtccaaatgcataggtaatcgatcgatctccttcccttaaaaaaaaataattgatcgatctcccaagtccaagcatggtcggcgtgagcttagcgctggtatacgtgaaacactgaactcctacatcgtaagctagaatgactaacacgtcggctgggttactctgcttcatctctaccacacatacgtggcatgcgaccatgctccatttttgtgtgcaacacgttttatttggctcgacgtacttctggtgtcggacggaccacgcgcgcggccgaattatctacaacggtgtcgcagggtcgtagccctgggaacggccgtccaccctctgataccttttcagccgcacccgttccctcagctagacgcgcgggacttcgctgggacacgttcctcaccatctttttactgaggcaccgagccgggagacacattgcgagggtgagtgtcccttggccaccactcctacacctagagttcctcttccaccccttgcctcgtcgtcgtcctcacgactcgtgagagggcggcggcgctaggaccggcggtggaggtgacgccgggggttggcggcgtgccagaactgggagagagaggcggtgaaaaggaggttcgtcggcgacggcgacgatgagctctgtcggcgacggctggaggaagagaggggagcgggaggagggcaactgggtgctgccctcgccggcgagcccgcccgttgctgccgaggccagatctagcaagcccagactggatccggccaccccgccgccactcttctcgcgtggtcgctgcttgccgccactgctcgatgtcgggggaaagggaggcaccgctgccactccgctgcactgctcgatgccaccgccgtcattcgtcgcgccgcttaactccgcgcgcagtcagccgccgcgacctgcgaccaccctgtgcgccactctctgtgtgtagggatatagagagccancgcggagtgtaagtagagttcgaatgtcggtggcgggcgcgacgaaggcggcgacaggtagagggagaggggcggagtcgccagagaggagaggggcatagttggcagagagagagaggggcgagcggcgatctggatgacgtggctggggtggatgattttctcgagggcatcggtgggctggtgggaggggtatggaagtaatttgtcatctatggtctttttggctgtgacacctgtcttggaccctagattttaaagagtctatccaaagacactctccattggaagataattatcgtagagagtgctctcaggtagtgagggtatttaaaaatggcttatattatagatgcccttaatattcccaacaaacatgcaaacgttactacgtacgtacactgctttcatactctcaacggtcacacgtcacgacctgagaaaggatcgatctggcagtaaaagtacgaaaccgacggatgaaattgtcaacgcgaaggctagcactgtcaatgcacagtcgcacacaacaacaacatatcgacactgggtgtgtttaggctgtcaatgcacagtcgcacacaacaacaacatatcgacactgggtgtgtttaggctgtgtttagttcacaccaaaattaaaagtttagttgaaattggaataatgtgatggaaaagtttaaagtttgtgtgtgtaggaaagttttgatgtgatggaaaagttggaagtttgaagaactattttggaactaaacacggcattagttccacgctaaaattgaaagtttgaagaaaaaaattgaaagtttagggctgtgtttagtttctgaaattgagaagaagtttggggaaagttggtagtttggaaaaaaagttgagagcttatgtgagtaggaaagttttggatgtgatgtgatttaatggaaagttgggagtttgggggaagtttagtgtgaacttatgtatgtagaaaagttttgatgtgatggaaaagttaaaagtttgaagaaaaaagttagtaactagacacggtgactgttcgaagccacataaacatagtagtactagtacgtactctctctgtctcaaaatataagtattttttagacttcgacacagtcttcgaaatgttagtttgaccaacaatatctttaaaaataaaatattttaaataaaaatgattatatagtatgatatttttttaatgataaatctagtaacatcaattttacattattgatctcttttacttttttaaagttaaaaatatttgactttatactatgctaaaaatgtttatattttaaaacagagggagtaccaaacttattgaggaaaaaaatgtttcccaaattaaagcctcggtatatatcgattctgcccccgtctttacatacacgcatgcttgttacgacaacaaattggcaacagcctattttgacgctaaaacagcctcactggcaactagcaaccatggccgttaataggagcaggccggaatgactccggtaataggttataggtaggcaggtggagtagtggtgttttgtactccctgggtaaaaaaaaaaaaataaatgatgtgatatattctagtacaataaatctgaacaaatatatttagattcgttgtaatataatatatcatatctagtatagattggttttttatatgatggagtacacgggttgtcactaaaggaataaaaacagcggccgtggggctgtcgcacagtcgcaggagagactgtactagtgctcgcgagcagattgagcggggagggaggccgcagaggtgggcaccgtgtaggcggcggcggcggagtaacggctgggcttatgtcagaaaagcccagcccagccaggaagcaaatttgcaaaaggaataagtctattttgtcttcctcatctgttgctcttggttgaacttgaattctatctcaaaaccacaaaaccgggtataacacctccactaattttaaaaaccggtccaaattgactccttaagtggtttcgaaagcggttttggtgacatagcaagttgacttggtctaagtgtgttgacgtggcagcccattatcgaaagagttaaatatagaagtgggtagccccatatttcagcgacacgcatgtctgatgtttctcctcccttctctttatttcccctgcattttctgactccaatggcgatggtgagctcttccatcaatttgcccctatcccatgtctccaaaaacgacaattcgctggagtgaagcttgcccagcggaaagcaatacacggaaggaggaggacttgccccatactacgcttccatccgggagctcatgaccaatctgataagaacaccaaaaaaaagtcatgaacatcacatgaatatggcaaattaggatagttgctgagaagtgagaagcttaatgcatgttctgttagtgttcttactccctattcggccagaagaagagtggtcgagccaaaagacaccgccggggcgaagcatcaggtagacgccgtaatggtggggctctgcgccgccgcctgcttcggtttgtacccgtcgaaaaactgcgtggtgtagtcgttaccgtcgaaatcgctgaggacgaacgacgacttggacaggtatgacttgcacgggaaggaaatataatggttagtgaggtggtcggagttaatggaggctcggcgccggcagcgaggtgggaagtggtggtagagttacatgagacacagatggagggcatgagctgctggaactactggatgcgggtgttgaggggcccgttgttcccgatcttgtcgccgatgccgagggactagaaaattcatggtggtgacgccgatgatcgccatggtcgcgcctcgccagaagtcgaagccgcccctgggcagaagcggcagcctaaacttctccgcaaggtcgtcctcggcgccgagagaagagaggagagagagaggcgaggaagaagaagagatgagatagaggtcgctgacacgtaggtaccatttgctgactcagcgagtcaagtcaactgtggtcaacctatcacattagcaaaaattgcttcccaaaccgctaaaggaggggatttgcactggtttttaatgatggaggaggtgctgcatctggttttatggttgagggaggcgattcaaccatgggcaagagatgaggaaggcaaaatggacttattcctttgcgaaacacaactaagacccaagagtaaatctagaaaggaataagtctactttgactccctcaattacagcacccatcttatttgtatcctcaattgaaataccatatatcttgacctcttactatgaaaagtggtgaagattgacttcctgagtgattttgagggtgcttttttcgctgactcaacatgtgagacccacttcagcgtcgacttctgtcttttctttcctccctctccctgtccctacaaaatcacacggcgactttaggcgaagcggtggcggcgtggcctcgaggtggagcgcggccaaatactaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatataggagttggagctgtaccaaacaggccctaagcggtgtagcttaggagatcaaaatcatcacccacttcaccaggtcggcgacaccggcaccaaattgaacggagagcagagggagccataacccaggcctgcgtcgtcgaccgtgccgtgcaacagccctgcgacgatgacaacaaggcccgcgccgacctccgcaagcagtgccactgccaccgtctccatgcagtacgtgctgcatgtaagggtcaccactcgcgtgcaatctgaagaaaccaaatgccaaagacaagcagctcggtcgcttcaacatctcaaaagctaacgcatagacaaaacgaaggaagcaagaggatgggacaaagtcgaacatatctgcccgtggtgagccgccttggtggcattgaaggccctcctcacgaactcgtcgatatagtgttggaatataaagtgaattgttcatcttttcctatcagattaagctcttgggttgaattggttagcgcatgcaacttaatatggtatcagagctagaaaactcgagttcgaatcctggttggtacgcaattaaacaaaaattacagctcacttctattccacactaaggcttaagggaggctcgtgtaagggagagtgttagaatataaagtgaattgtccgtctttccccatcagcttgagctttttatttgaactatttagtgcatgcaactcgatacatcgcgcatttgatcgcataggatatcatcggcgccgacgccatcgcctacccgctggagaggaaggggtgatgatggaaagaagaggatgacatatgggcccacacgccaactcactcggttagactaggtcaatgatccacgtcagtgaaaaaccaccaccaaaaccactaagggagctattttacaggttttaaaagttggataacctatttggtattttggttcaaggaaataaatcagattgcatctgtattgagggacttaatgtggacttattccattcggaaatcatgtaaagaggtcatcattaggggaagcccatatgtaaaagttatgctgggctgttactcagacacgtaacccaagaattcagacttgcaatttcaataatttattcatgtcaaaattgcttttcggtgaaaaatgcttttatggatagagatattctccaaaatacaaattgatcccattgtcatataataaaaaaatgaaaaaaatataagtactttaaaattagagtgaaaatacactattgataactgatactccctccatcccaaaatataagaatatagtaccggataggacattttctagtactatgaatctggacagtctgtttgtctggattcatagtactataaaatatcacatctagttttagattcttatattgtgggacagagggagtaccaaaacttgcaacttggtgtaatttattcaattcgttttgcaaattacttaaacgagtcacctgtttaatttgtcgtctttttattacttctctagaaacactgaagtttgctatgcccatcagaactttcagacttgcaatctcaataatttcaggtaacaattgctaccgtcataaatatgttactctctccattttatatttttctaaatttagcaacatttaaaatataaaattagtttcattaaacttagcattgaatatattttaacaacatgtttgttttgtgttggaaaagctactatatttttctataagtttgattaaatttaagtaagtttaactagagaaaaaaataaaaacaacttataatatgaaatagagaaagaatatattttattaagaaaaaaccacacaatattcatgtatccaatctaatcttcttctctcttttttttgaaaaaaaatataattgatgaatgtaatctcgaaaatttgacctgatgtatgcctaaagatatttttacgatcactggtacatatatacccaaatttatttatctttttgttcgaatttcgtgtcgatgtgtttcgcctttatacatgcattaatttgaaagggactacagtaaatcattttcagaaaaaaaataacgattgcccaataattgtgtttctactgaaaaaaaaatagtacggccttctcttattcattatacatgactctactgaaaaaaaaattaaaaagcgcagttcatcccaaaattgctatctgtatatcctccgttcatatttctctggatcctgatgaaagagagttctgaatatccggttcttagaaaattctaaaaaaaagggcatataatcagctccaactgatcaaccacgccatggtgtttcaattgcttctggatgacacatctttccataattccatcgatcatattcgcgcgtgttcttactcctctgcttttcgcttcgccttgctagaactagaagggaacgctagctatctagaacaactagaactagatcggtcaaaaaaaaaaaaagagataaacccaaccaagagagatcgactagaaggtctaataacccgtttactttagaacgaagcagtgcgagcaccgatcagcaagaaaaacccccatgagccattgtttactcagttgacactggctagctggcgtccaccagctgaactagaagccgcagtgctacggaatgtgaagcaacttcctcctgccggctgccgctgcagtgcgcttcttgatccgcaaggcgctcggtctaggtcttcgtctacgtctagaaggaaaactacttgcgtg

SEQ ID NO: 14909 - DNA, 11579 bp, Oryza sativa
  unsure (1)..(11579): unsure at all n locations
nnnnnnnnnnnnnnnnnnnnnnnnnnnnnnnnnnnnnntttacttaaaatttattaaatagttatctcgttgtcttaagatttaaaagaccaaaccttatcatcgttgtgtttctaattaattttatagtttttaaaagtcacaccagttgctaccctttatttctgtcatattattctttattagcttacccaatctaccgtactgtttctattcattctccttgaaacctttaaaaattggatagtaagtttttagagtttattatcacgttgggcttcttatttataatttatagaagtcctatcaaacgctgtcattatacttctctatgactgtccactgcatcttctctatatttttaaaaatcaaacataattatcgtttatgttcatttttctactttctagaagtttcgccaaaacgccaacgactttgtctctatactcctctatggctcgcccgctgccgtccttctctattgttattgagattttaaaatcaaacatgattaacattgtggtttatttttttttactttttagaagcacgaacatttaaaaattggaccttatagtttttgagtttattgtctcgttgagtttcatgttttttataatttttagaaatctcgtcaaacgcagccactgtactcctctacgacccgttcgccgcatactctttattgtcattggaattttagaaatcgaacataactaacattggaattcatttttttactttctagaagacccaccaaccatcggtggctctgccattttattcctatacgacccgcccacagcctctcttttttattgtaattgagattttaaaaattaaatatgattatcattggggtttatttttttattttctagaagtcctctccaaccgtattgaccgattgcttcacgacatgcccgtcgtctttccttttaatcatcattaggattctacttggtgttttattaattgtttttcgatatttcatcaaccgccaccactctgctcctctataggcctcttacttaattaatctcgtcatgtgttttagatagtattttctttcaatagtcttaattattttatagttatttataaattgtattctagttgaaatcttttttttctttttctaatttctaaatttatttcattttttgtattatatttttttgatgtttttattttttatattcaacttcagttattttacaattgtattcctagtttaactctctttttaatttgcccaatttcggatgttatgttatttttattccaaattttaattaatctactatttggttcaatattgcttatatttaattccgaatttcagttaattttaaattgtattcctacttgaactcttcttttattatccttttttctaattttgattttttatttttttattctgaattttaattaatctcgtattggattcttgtatggactcttctttcaatatttcttattttaaacttcaaatttcagttatttttaaattgtattcctacttgaactcttctcatttttctgaatttcgttatttttataatataaataaatatgctcaaatttatataaaaatcagttaaatatatcaaaaccaacgtggtttctcttaataaatgtctctatttgaatgacatatatcattactatatttttttatatagaatgtctatatataattaatataaatagtaattaatttttttaaaaaatctcatagtatcccgatcctacgatacgatattactttgagcaaaacgatactacctagtatcccgatcctgacaacctttctacgtcatcgtatatttttattaataaatataacaatattttatatatatccatgatctatttataccgctgtacattttaattagttacagtgtatctgcaaatgatcttcttcattgaatgattttttttccacattgttagtcatttttttctttttcatgcatggtatattcgatttttggctgaggaacgcatgagttgtcttggtctttgccttcgcctacatgcgcatactgttttgaattggatgtatccatcttcaagttctactctaatccgtgctttaagtccgtactgtttaatgacgtccgtatccattcctaactcatcagcctactctaactcctcatatattattagcggtatttctctgtacgattctgatccaacatacctccaataaatcttagccattaaaatctagacttatcacaatccaattatcacaatccaatggttaatttacttttctttttctacgattaatgtggtaattttttctagctttcacagcgaacgtggtgccttctttcaaagctgttttaataatataatagatagatagatatatttgtagtgcatactgacctacataggacattaacaattaatcaccaccaaacaaagaacagtcatgctaaaaaggaaaataaaaaaaaacatgtctgaacactctccggatgctgaacatttctcatctctgatatcacgcacgtacttacgcaaaacgcactgcaccagaacaaaattgtctatggattagaataacattctttttcgtgttcatttacgtgcggctccatgtaataatcgcacgagatgacgatgctttcctcctctcccgtgggataatcactatgcgcagtgtgcgaacgcatggatcacacgattctctgtagttaatctgccgttgaatttatccgcgagatcgatcaagatctcgagcgcgtagatcgcaagaaacccgctgctgatgttgtaatccggcagttactagcttccagctgttcactttgacatgttctttcttgcaatatcttgtgagaaatatatgtgttagcacatgtccttttctgccttttcatgaagctctgatctatattagccacaaacctagcgtaagctagtacgtactactagtacttaccaataaccaacctaacctggatcacaccaaccataatctagctagtgagctaaggcatgcattatcggcgtgtcaataaactgaccggtccaagatgacgtacgtgcatatatccactgaatccacatgtccgcatacatgtatatccgtaagcaaacaggcatgcttaatttcgggataaatgaattgaagaaaaagaatgacgctgaaacggcaacggatactcattgacatttcataccagctagtcactgctctctgttcgagcagctcaggtcaggagcagtttcagaggtaatgagatggtgctttcttgcagcagttgatttcgtgagcttgggatgaggcgaggattacggctaacgtgtgtcatctcctcgggttaaacaagctagctgcagggtcagtgtatatgcgcctaactgttaggtgcttgggtgttaggcaaaccctgaaattacacatgacgatggagagtaattatcagagcatgtgattgcgagagatttacatcaaacccgtgcataatggctttcggaattaatttggctgctgctgatgtagtgatgtaccaccattcggacacaggtgatggaaaatacctgcctgaacaccctgatcactgaacgtagacagacgcacacctgacctgaaaactgaactgacaaatacgtttgacacccatcaattctcactgatcatgtcgtcgtggagatggcattgatcagttcggactctacagctgagcgttactagcactacactgatcaaacaactcgtgattgagtgcaggttgcgtccgatttgggaaaactgcaagagtatccacttctctgtttttctttcttcaggctgtaacatcgggacgctctgtgttttcctccctggattgagaggctgtttgcatcatctggatgatgccgtagcagccgtggaacctgcctgaccaggcgctcagatatgcatcgacgcatgccgcgatgcagcagcgctcgttttgcagcagaagtcgggagcaagcaacaggcgacggattagagtccgggctatgtccaggctccgtctgataggacgaggggctccgcttttccggggaggtcagggtgtcccgtctccccgtagtaatggagagttggaaatgagggtgcacaatcaagtggttaattcacatgccacgaaatgtgaaatattttgggtacaacattcacatgcttagaacccaacttttcaaattaatcatgcgcctagattaatggaactgttaggaatagataggactcatagtttgtgatctgtaagcatcacaaactgccgtactctttgttgctttttcctagaggtggattatacttgagggttgaacaaaagaggctcctctggtcatttctgaaaagctaatggaggtatgggttatcggtgacatgtttaagtaactttttttcaagctagcatttgctagtttttaagtaactccaggagagttgttgtttgactctccatgtcaaaatttggcaaacatatagtctatagagaaacatgtctccaagcaacatgctattttgatagccaaaccactccccctagcttgctatctattccggctttgccaaaaggtgggtgccacgacctgaggcagcttcggttcctcgccaacgctttttatatccggccgttcacccatctgccaagcaccgccgtcaacatggggcctcatcgtttgccttatggcttataagccaaaaccaaaattttaattttaaaacttgaatttgaatttgattttttttcaacatagtttttttcaactttggcttttcaatcactaaaaacatatatacaaaagttttactcacgtatcattttgtaatcgctaaaaagccttatggcttataataagactagatcaaccgatggggaccatgatctgctgcatatcttgcaatgatgctatcagcatcgcggccgtcggccttcgatccagcgtacgtctcactagtgaggcagggtggagtggttggcgaggggaaagatctagatggagagagaggaagaataaataaagagagtctaacaaatgggatctattgttcgattgaacagtttaatgtagagattatagatactgttgtagtgaaacataaatatggctatgtaatttgtgcattctgatagaaaaatagccactcttgaagatccacttatattagaattatactatataacgttcaaaacttactctgcagttacatggtaagtttcaaaatttacattgtattttcttcttttcgaaaaaatatattatttttctaatatacaatgtataagagaattaagaataaaaataatttattatctacttgaaagagaagataaggaaatgttgaagcatatttacatctggagagagagcaattacactcggggaaaacaactggctgtgtttagtttcatgtcaaaattagaagtttgactaaaattgaaagtttgaagaaaaaagttggaagtttatatgtgtagaaaagttttgatgtgataaaaaagttaaaagtttaaagaaaaagttgggaactaaagcagacctgaaaattgagccaaagatgtcggtatataattgaatgacagttactttaagtgggttctttgaaaagagcaaaaatagaaaaaaaaataaaataaaagtacatgcctgttgaatcttagagcaaatacaatagcaaactataagcaagctataaccacgtatcgagaagaaaagagaagagggagaagaaagcaggctacagatttgtagccgactgcaacacggactccaagacgttatgtgtgtatgagaggtaggacctggtattaatggtgtagtatatttttatacgtaactattgaatgaatgggctattagattagctacagatgatttgttacgggcctgtttggcacagctccagctccagctccacccctcctagagctggagctcaggcaaacagtttcagctccaccaaaactgggagtagagttgggtggacctctctcacaaaatatactagagttgtggagctaggtttaggcagctcaacaactccactccatactcaactcctgaagttaattttaagagttggaactgtaccaaacaggccttagtcagcagttggctatactattgaaattgctcttagcaaacaaaatatcgcctgatttttttagttctgtcaattccaaagggaaaaaggtcaatgttctagatgatcacgagatgattgaaacaattggtggcatgaatgcggttcaccttccatgcaatcaattactcgtatagtcgcatgtagctcttcataccatttcattaggcgaaaattcacaagttattctaatcgcacgcccaatcattgtcggaaacccaacagagaaagaaatatagggcaaacaaagtatgcagaaaaagcaacacaactactccagtagttagattgtgcaaacaagggggaaaaaaacgactcctgtcaatctacatatccaataatacacatacacatatgtacaagtacaaataatcacatggaagctcttcttttttttctctcacaacttccccgtgtgtgattccctaccacgttcacaacttcacatgtcgttcgcaataaaccgacttgcagagctgtattcctcagcgaatcccccacatttcgcctgttctgacttcacgcctccaattttgacttcattaatcccccgtgcaatagcaaagctatagattacgctaatcacacaaacttcaaattgcagtaggcttcaagtcaaaggttcgaaacttcaaatcccggagaattcaaactcgaaatctctctttctcacttttttgagttgaagtggtcattcgccctgacggtgacggcttgtgtccggcgatcagaaggggcggtggtgagtccggctgaggccgttcacgttggcgaagatgcccatgagatcctggcggtacggcaggaacgtccgccgcgtcgcgccgccgtgcgccttgtggttgggggagtaggacagccggtggccggcggcgatggtgtcgagctcggtgtggagcttggtggcggcggcggcgccgcccttcgtcgtgggcttcggtttggggtgatccctggccggggacgacggcgcggagaggaagcggaacttctccttgccgtcgctgtggctgcggccgacgacgagctcgctgatgcggcgccaccgcgcgatggaccccgtcgacccgctcttccgcggggggcgcgacggcgaggacgccggcgacgacccgggcacccagacgcagtagctgtcgggcgacacgccgtccagctcggcgatgtccgtggacgacgacgacgacgacgtcgacccgacggacgaggtccgcccctcctcgaggaacagcctcccgagcggcggcctccgctcctccgccgccgccgccgcaggcgtcaccgccacgtcgtcgagcacgcggccaaacaccgggtagaacgccctgatgcggccgtccgcgaagagctcgtcggccacgcccccggcgtccgtctccctgctcacgaacgggaactcgaattccccatcggactcatcgccggagaacgccgcggcctcctcgacggtgcgatcgcgaggtctctcttccatggccaccgcctcctctgtgatgtgacgatgcgtcgcggttggctctcgtctcgtgtggttgtgaggtggattttgggagggaaggaaggaagctgccccaagcgatcaccaactaataactagtcagccaacggtgcgtggcgtttatataggcgatcgatcgaggggggacgcgaccttctcgaaggtcgccttcatcacttcgctgcttttatctcgatgccctgcctgcgctgcgctgtttgggcttcgaggtggcgacggaacacgtcactcgtgaggcacgcggtgtgccgttggcaaggttcccgtttccgtgtgaacgggggttatttgtttttttttttcggttttacacatgttttgctactagtacgatatttctggaagaggcttggcggttgcctacaacgagacgtgacgacggacggtcgatcgacgtggttgcttgtcaagcaagctggaagctgctggggagttaattcggtcggttcgtaggatcacacagggcggcaggccggcgtctgtacggtttcggaatacgcatctcgtggggggggggggggggggattatttggtttcgtggccagcaggaaatcggacgtggcgagggacgcgtggccattctccgaatcggggcaaaagaattctgcgagtagctatggtcatgatcatttcaagttcatattccattcgacccgcgtctcgaaattctggaacaactccaaaatgcaatcatcctcgatgcctctaaggcctaggttggggaagattctgagaatccgctggttggtagctaacttctgagaatctagaaagctgggtttttcagcttttggactctcaaaatttgagtggcaatctggactgtttgggggacctggagattctagaagaaggtgcagcagctagaagctccctaaacagaccctaaatcttgcttaaggggtggattaacaagccagcttgacttgttcaagctcgttattttaacgttaacgagctaaaaggctatcttgctcggctcaaaagctggctcgttagacttgttaccgagctatttatctttcttattatatattgataatttcaaatttatcattttattacatattaccataataataaacatcaaataataaagaattcactaaatataaatagttttaatgtaattactagactaagctctagcccatattcatatagatgttaataaatataggtatacatatatgtctagattcattaatatatatatatatgaatgtggacaatgctagaaagtcttatacttcctccgtttcacaatgtaagtcattctaccattttccacatttatattgatattaatgaatctagatagatatatatatatatatatatatatatgtctagatttattagcatcaatatgaatatgggaaatgctagaatgacttacattgtgaaacggagggagtaatatgaaacggagaaagtattaagtatataaaagtatggtgatatcttgtactgacgagctaaacgagcagctcgcgaggtagctcgttaagcttacagctaaaaggctaactaattaaaactatggctccaagccaattcatccgatccaagctgactacaagcctatccaagtcccgagttttgaggctttttgtctacccctaatactagctgcctaagccgacctcttctagcatgcttcatcagaatcattttcggcaattgtgtgatgaagttgatggtgacgacgacatttacagatgtggggctgaagtagcgttgttcgttcatttggttcacgcctaattgggcgtagtgagggtgtctcacccccttgttgtcgtctgcatgagtggtagcactgaatcctgtacacccatttcgtaaaactcaattcgatgtaatcgattgaaagaggaacgagtcgacgagagctccgttcaattgctagatgattcctccgtcctaaaatattactccctccgtttcatattataatactttctagcattgctcacatttatacatatattaatgaatctagacatatatgtgtatagattcattaaaatctatataaatgtggataatactacaaagtcttataatataaaatgtagagagtataatctagaatgagaccagacaactgcctaagatgagtctaatttcgtcattttaggatgaaaggagtatatatcaaagtctcaccgcgttaaagccccagctaagctatctatcacatctgtacatcactgtacacttgtacagtagagacaaaacttggaaaagtctcttgattagaaatggttcagtttcattggaaggctattaaatgaggaaatcacgcctctgatctcgctttatttgagggttaagccgcgtaaatctgtagaaagcttctgagagaagggagcgcgttctgcttcggcacctctacatcgtgccgcttcgcctgtggcttgccgtgacggtcgcgtcgatgttttgtcaatcgtgtgttcttttatagataatgaaagagcaaaatgtatatatatagctcctgtcgtaggcgatcctgcttagtcgatctacaggcatcccagcgtccagaataaatttatttttatctcttttgtttgtccctgaataattttattggtgagtaatcattgtatcggagtttataaatatataggataaatacattgaaaatagataaagtgagaaagaattgcatcggagtttgataaaataagaatattttatttttttagttttgtattggtatgtgtgaagtagataaaaataaaattattttgagatggagagaatgctgtaggattcaaatttacgtgttggcgttatgcgagttgccaggtagcttcccgtatatggctgcgtttagttcagcgcaaagtttgtattttggttgaaattggagatgatgtgactgaaaaattgtgtgtatatgataggttgttatgatggaaaattactaaagtttgaatccaaactttggatctaaacacacagcctatgtcactcgatcggtagctattatgtcaggtacgtctcatggctatcatcgtgttatgattgtatatgtatctcggtgcaaaacagtagtatcactttcatgttgttaaatttgtacactgaccactgattaattaatttggtaacgcattgcaatccaattaaaatattgaatcttgtcctactcccccgatccagcaaatcctctactacgcgatactactacggtctcctttgatttggaggaaaaacatagaaattttaaaggattttaattctataggaaaatttcctatgaagtcctttgaaacaaaggattgaatcctatccaatcctttaaaattcctatggaatggacaatcctatagagattttggaaaaaatttagcaagagcttcgacctcttactaactttcttttgaggctatctctttcatccaattcctgtgttttttctgtggttcaattaaatggtcattcctgtgttttgcaatcctctgttttacacttacattcctatcaaaatcctacgtttttcctattcttacattttctcagtcctgcgattcaaaggggccctacatgtgggcctcgcattctagatctgtctgtatacttcatgttccatgcataggtgtggtccttattttgtaaataaaacagtttaatatgcagcgagagggatttgcatcagcactaatattgaactgtaaggcaaattctgcctctcacactctagcagtctagcatccaaattcacgtgatggaaggttccctagctctctcgccgtgtcattcggattggtgttactgttatagccttgtttggatcctccgggctattaaatagtccttcagaatcttgctatttaagattattaaacgtagattaccgataaaaccgattccataacccctaggctattt

SEQ ID NO: 14910 - DNA, 4384 bp, Oryza sativa
aaaatagcctaggggttatggcctgagttttgtcaataatctacgtttaatactcttaaatagcaagattccggagggctattcctgaagtacacctcccagctattagtatcgctttcatgttaaatcttattcattgactatgcaccagcttgattaatttggtaacatgctaccatatcttaaatattgactattgtcccaatcctccaatcagagcagatccttaaaattaattaactcaaagatagtagtaccacacacacacacacatatgtttcacactctaaactagtcagtataatccctttgtttaacagtccttatttcataatctaagtggttaatatgtcttacattgatataatccacacacactctctctctctctcgctctgtgttttacatagaccaaaggaaaaaaaatatgaatgaatgttatggatcaagatatggctagatcaggtgtgtaatcagcgtgcttttctttaacgctggttccgcacagcactctggcttactggggtgagataatgataaatgcctagtaatcccaccaagttcagataaattaaaaaaatatttttgagtaattttttattgtttttttaactataaactatcatggataccaggattatcaaatatatgctggcgctggacatggtaattttggcgcgtgttgggtgttcggcctctccccggacaagaccctatcccctccaccggatcaggggtaagagcatcgtgcttcggtggatgttctagtgccgcgacgttttggatggcgggagcactgtgacggagggtggcaaggcgccagcgaaacggtctagtggcccgaggtgacgcggacaacaggatcatggcggagtcggcgcttgttctgttaagggggagccgcggtccttcatgggccccaatctaggcttttgtcctcttgcgacgtcgcctttgctgacaaaagatggccgcgtcgggcaggctagtgtgggggagaggggatcctttcttctctctcaccctctccccatccaacccaactgcgcggatggagctggagcgtgtcgagagtcgagctcccccttaacgatcggctggcgtcgtggcgcccatgcggtagccatgcgttgaaggttttcgatggtggtggctgcggagtgtgcaggactttagttcttgggaaggacgaaaatttgggcgacgacgcctgccgatgctgcttttctcttggggtgttgttgcattttcttgttgctcccaattactttcttcaggtaaaaatcttgtgttgtcattctcttcttggaggtgtcgtctcttggaggtgtcgtctcgaagatctccagtttcgctctcgtagcgggtgttatagacgcgcggtgtggttgttcttttctctttttttccctgtctatggtcttctagaattacatatttatatttttctcctgctgtattaatacgtgaaactcgaactatcttgtgctgttcatttcaaagaaaaaaaattgataaccagaaggttggaataacaaagaatgtcaaggacttctgttctgttgtggtgtccctttttattttttaaaaggccgggaaaagaacgctccttgtaggaggtgttcacaactatggtatgttctgttcgttgtggtatgtctgttgttcttttcttcttggagttgtggttttagatgatactctgggtgttactcttaatggtgtgtgtaagaggattgacactccgctgagacgacaacatacaaaatctcttcttttttttttttttttgcggggagacaacatacaaaatctcaatgctgttatgaaaacaaaatggtttgtagatatcagaaatgtgtaaaaaactttgtcccaggactacaattctagtaatgaaaaggaaaaaaaacaatatttgacatctctaaacttcaatgaaagtcctaagttaaattcatccataaacttgaaagaccggacagtattcagccctaggcccctaagcattacgccattcaatttcaatgtttgaccaaattcaaagcagtttttgagtgacatggcattgaggtttaattaagaatgaaactattttcaatttttaaaagatgtacttaaataaaaatcttaaaaattatcacttattctatatagattggacaacctagcttatttttgtgagctatatattgaataattggctcacgatctatttttataatatgtgggtggaaagatttttattaacaataacattgaatatacaagggcatatataaaagcatagtcaactagttatatatataaaatgtaaatcccttctctagttaaaacaaatgtggtcaatatgtgggtggaaagtttcttttagcaataacattgaatatatgagggcacatataaaaacagagtcaactattctctctacaatttgtccatatcaacaagggactctccgaaacactattacaagtttggaacaacaaatttaatataagcataaatttctttaacttcatctatagccaatcaataactctaacacaatgctgattattgttttcttatgttcctacaatcctactaactaaatacccatgtgtttaaggagcaggttgaatatgattccacccatcctccacagctttggaaatggatggtgcattatttagtggatcctaaatgtcaactcataggggaagcaccggaagatgggattatgggtacattgactccatctattaaagtttaaatcttgatgttcataaacattatacacaagtgagtacgtttttttataagaatttagtgtgatcaaggatatgccgttgtttttcgtcttttgagcatgtgttagcagatgtgtgagtgtgacgtgcttgtgtggtggtggtccttttgctcttatatcttgtgtgcaattaaaaaaaatgtcaactcatggtaggaataggtggtagcacaacattcaccaacttcgtgatccccatgttaattattgagtagtaattaacagatccgctactcattaattttcactaccaatttaatcttctagagtaatatagataatcgagacatgtgacctccccttcctctccaaaccgttttacacgcataacttgttcaaacaatactgtacaatagaaattcgtcacccactatagcatcaattcagaaaggaagcgcagcaccaaattgcacaaaaagtaccccgttgtcgcttctgtttgtccaaccaaaccaagcgattctgaggcaccagtccaaaccgatcacacaaacctgattaatggattcggcatgtatctcttgtcacagatcaatcgatcgccatcagtccacatgggtttagtagggggattaggccatcatatcgccgccggatagtcgcttgcacggttacaccaccccactcgcacccaccactcacccctccggcgccggtctgtcgcggcggcggaggtggtggataattccatgcttttctcgccgattccgtttatcaggtgactgatgctccggtaagcagttaggccgtatcataaacctgtcacgcgtgcgagcgtgcatggaatgtcttgcgccagttcgtctcagatgcaatgcatttgactacccgactagtaataactaggaagttggaattctagacccgaccaggcaataatgtcacgatcgtctcaggaagaaaaaaagggcagcaatccagaagcgttggtggttgtgtgtttttgcggatgggcgagtacacccaattggtcagtggagacctagcaaggatagacatgttactagtagttgaaactaagaaaacgaatttggttttaaaaaatgagactaaaatcgagacaaattcccctgcccacgtgattagatacagcaattagtgaactagaagtggtagtaatgttttatggggggagaaactaacctaccgcgtgcggccaaactagctactggttgatatatactccctttgtattttaacatatgacgccattgactttttatgaatattttaccattcatcttatttaaaagatttatgttactatcatttattttatcatgacttgatttattatcaaatgttttttaaacatgacatatattttttaatatttacataaaaattttaaataagacgaataatcaaacattgattaaaaaatcaatgacgtcatacattaaaatatggagtaattgattagaattgatgcacttggtgttttgcctcccatttgatctgtgcaagttgcatccatctaccattctacctaccagtccgtgccaaacagccaaagacgaggagcatggatcgttgttgcgccaggactgacgctagaatttttcgaattgacctgtttagccaacaaaa

SEQ ID NO: 14911 - DNA, 607 bp, Oryza sativa
ccgactgaaagtggccagtattttttttcaaaatacccagattgcccccgtgtcccaaactcggtcgccaaacaccactcggaggactgcatcatgtagatcgccgccgggaagtccgcaccaacgtgctcttctttggctgccaggacacccacaggacaggaggcaccaccacggcatcaccgccgccgtttcgccgcagtagtcgggacacgggcgaacttacacacaacaaccgccgaacgccgctttcctccctccctccctctctcctcgtaaaaatacttgctccaaacgccatccatccatccatccacccacccacacacagccgcaatcgccacctcattctccgcacgcaaagccgtcacgtcccgccacatcggcatttcggtgaacacctcacgcgcgcgctcctggtgtcggtcgtctgcctcgcggcgggctgcaacgtcgtgacacgctcctcctcccatggccggtgccagcggcgacggccggcgagcaactgggactggtcggactatgacgccgcattcactgaggaggccgacggggcgatcgccgcgctgcaggacacggacggagacgggctcgccaccaagca

SEQ ID NO: 14912 - DNA, 646 bp, Oryza sativa
ggtggatccgggccactcggcgcctcacccacccagcgcgccacacgcgcgcggataggctcgcgataacgcgccgcggcgccgtggccaacggttccccgcccgcgcgtcctggtccacacgcgcgcggatgatgggccgccgcggggcggaaaacgaaggcaacctacgcgggtttcaatgcgagcggctttgcggttgggtcgcgccgttgcaggttgtgggtggatcgctcgatggagatgtggatgtggatttgatattgcgatgacgatgccaccgctcgcggcctctggagtctgtctcacgggggggttgggccggtcgatcggctcggatgtggtggcgctgcgaggtgtggaacgtgtgatcagggcttgcttagccacggtaaatatctttcgtttagcgaagccgtcaaagcaacgagaatgcaccgccgcgtaattgtgggtttgtggctgtgttggcgacggattggtcgtgattaggttctgccgatcggagcgggcacacgatcttggggtggaatctactgatgatacacgttggctgtagtttgatttgggtgctagattaccttgcggaagtatgtatagtagtaggaactcttaaaacagaaccctttttcaatagcaggatttaa

SEQ ID NO: 14913 - DNA, 1454 bp, Oryza sativa
gttccgcccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccaagccgttggctcgcctccccttgtcacgtgcaactgcccggtgtgctcgctgttgcccgtatcaccgtggttcgctccgccgctcgccgctgtcgtccgccgtccgttccggccggcgtcgtcatctacctcccgccggcccgcgtggctgccacgtcggcgccacctcggccgcgaccggatcagccgacccggccagccgctccctccgtttttcccccgtgcgcatggtccgcggtgagccgtgaggctgcgcgtgggcccgccgcatccgttcctccgcgaaccgcgcgcgtgcaccgcgtcccagctccgcccgcgcgcgtacgccggaaattccctccgcacggtgagccgagccgctgccaagcgggtcccacccgggaccgcgcgtggtgagcccggtccaccggactctctctcctccctcccgcgcgcgcgcttgggccgtcttgggccggccggcccgttaagatcggccggtccgctccatttcccttgggccgcgccctagccgcccgagagaagtctacttctcctccctcttcctttttatttttctcaaaaaggatttaatttaatcctttttcctttagatcaaaaatccaataatcttagaaattcaatatcttcccaaccgtaaatccgtttgactccgttcaacttccaaaattccccaaatctcgagatctatctaatggcacgcttagaggtcattaatagggctttatttttttcgccgtttgttgagttgtcccgtttcgcgtgtagtttcagagcccgaagacccgcagtgcgaggatttcgaggatcaagctccagatctcgagcaaggcaagccacctttgaacatcttgaacctatatttgaaatttaattatgttgcttgaaaaaaaatattatgcattgataggatcgcacttaatctgctgtcccgtctgcaaggcagattggcggacttacccaatttgttgcatttgatccttccattgttaattgctatatctggtccccttgtaaccatctagttgcgtctcgatattcgtgcaccccgtgcgagtatcgacggacgccttcaaacttaaaatctgaataccaacttgggtaaaactggagttttacaaaagacttggaaaacccgacacctgggtcggtgcttgcgaactaaatgaattttcaaaaccgcggaccggggaacgtaccgggtgtacggtttcccgctctcgcacttaaggaccgattccttggaattcatccaacataagataagtcgaccacatgggtggaatggga

SEQ ID NO: 14914 - DNA, 8421 bp, Oryza sativa
  unsure (1)..(8421): unsure at all n locations
cgccgtttgttgagttgtcccgtttcgcgtgtagtttcagagcccgaagacccgcagtgcgaggatttcgaggatcaagctccagatctcgagcaaggcaagccacctttgaacatcttgaacctatatttgaaatttaattatgttgcttgaaaaaaaatattatgcattgataggatcgcacttaatctgctgtcccgtctgcaaggcagattggcggacttacccaatttgttgcatttgatccttccattgttaattgctatatctggtccccttgtaaccatctagttgcgtctcgatattcgtgcaccccgtgcgagtatcgacggacgccttcaaacttaaaatctgaataccaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagataagtacgaccacatgggtggaatgggacacccctggctgagtaactagcttatcaggggagccttgatgccgagagacatgtggattcaccggggtggtgtcggggaggacccctgggcttgctggcacagtatggtctgggacctaccctgttgttggtctgggacccctctcgtcggcatatggtaaacctgtatcggctttcgaaatgccttgtcatgaaagcttggaggtctcccgacgtggctgatcccctcgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgactactgattgtgaaattgctgtcgtgaaaatgggttcgacgtctgaaaaatcagcagctgacgggatcagctaggcccgggtggccgtttgaaaagttgttggcccgggtggccgtttaaaaagctgttggccgggtgccaatcttgtttcaattctaaagagctgatacattgcacatactccgaccggacgagacgcactgtctcatccgtgtcgtttgagaagcactcacctagttgttttagaaaagagttcaaataaaaccaattgcaaaaacaacagcctttccttgaagcctgcattaaacacttatttcccctggcttgctgagtactcccgtactcacccttgctctagataaataatccccccccagttgctgaagaagatgaagcggatcctgctgacgaggagttcttccaggagcaagccggctacgatgagttttagggtttcggcctagttcccaagtcgcgcctgtgatgattggtccaagtcctggcttccgtttccccttttgtattgcagttgtgagctcgggatctgtccgtagcccaacataactgtattccaactctataataaagagacctctgttgctgtaatattctgtcttcctgtgataccagcactgtttcctgggactggtatcgattaacaggttaatttggagcgtcacaggctagttccagtcggggctagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtggccaggcccactctctagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgcctttgaggcctgtctggccgaggagggtgtcacctcagttgacactatctcttgggactcaagccggctttgccacgccagccacctgtccttccacagcttccgcggctctgcccgcactcccagtggcccgcgctcccccagctcgcgtgcgccgactcaccagtgtactccccctacccacacccagttagcccttcctacacccccggacacaccccagttgcttcctcccgccgtggcccacgctttatccgcactgcgcggaagcgtgttgttggttcttccaccgtgttccgtttccactacccagctcccccaccgctagcggtccgtgctgctgccggccctcgacaggttccgccggtcccttcgcgccagccgatcgacgtttcttcgactgaggagccgactacagaaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccatacccgttgtatcaggtgtttttatgatttgaaaaatccagtttatgcctagtgtgtgctatctgagttgctattttctttgcttcttgccctcctaagtgcttatctgactcttaccccgccctcttctgggagtttagatggctagccgcccccgccgtacagctcgtgcgccagcccgctttggttttgaagatggtagagtcgaaccagaagcaaatcatgaatcagctaatgagcagtctcaccacagcaaccgttcgcaccgtactgtttcccgcaacgcagaggttgagcaaccccgccgcagcagccgctcgcatcgcacagtttcccgtgatgcagagatggaacagtctcaccgctctcaccacactgccagtcacaattctggagaagaacgcctcccttccccacctcatgtggaaaacaacatgcaacacttaatggcagttcagacacaaatcttgcaaggactaaccacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactccggttgagaagacgctctacgcctctcaccagttaagaggacctgccgcagattggtgggagaattactgcaatgcacaccttgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaataagttggctcggtacgcccctgaggaagtggacacagacaagaagaagattaggaaattcttgaaagggatcgcagttggaatgagactccagttgcttgcgcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgccctcagatgaaccgtccggcacctccgccacagcagcgtgcccctagtggcaacactgcgccaaacagtgttacctctttcaagtcaccacagggaccgtcagcagttcagtgtttccggtgcaaccagatgggtcactatgctagacagtgtcctcagaatcctaccaacaccaactcaggacatgctaatggcagcactgccagaactcctactccagcggcagctcagtctcgtcctagctctcaggcaagtggacaaggttcacgtgcttccaacaactttggtcgaggccgtgtgaatcacattcaagctgaaaccgctcaggatgctccagacgttgtgatgggtatgttctctgtcaacaccgtacccgcaatagttctgtttgattcaggagcttctcattctttcatatcacaagcttttgtgaaaagaaatggttggaaaacccaaaatttgcgtgtaccaatgatagtacattcccctgggaggaatataagggcaactcaaatatgcccggaagttaaccttagaattgaggaagttgacttcctagccaaaccgatagtcctagactcgcaaagcttggacatcattctagggatggattggttggctaagcacaaatgacagatagaatgtgccgaaaagtccatcaccttgcaaggacctggaggaaagcaaatccgctttacccctaacacccctaccgcaagccggtctattctaacctgtttacaagtcacctccttggagtcggtgcccatagtctgtgcataccccgacgtatttccggaagaattaacaagaatgccaccagaccgagagatcgagttcgccatagaactggcactaggcactgccccaattgcaaagagaccctaccgaatggcagctaatgagttagcagaagttaaaagacaaatcgaagaattggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaactcaaaggagcaagagttttctcaaaaattgacttgaggtcaggttaccaccaactgaaaatcagatctgaagatattccgaagaccgctttctcaacgcgttatggtctatacgagttcacagtaatgtccttcggactcaccaatgctccagcgttcttcatgaacttaatgacaaaatctttatggaatacctggaccagtttgtcgtggtgttcatcgatgacatcctgatataccccaagaatgtgtcagagattcgcagcttccttggcttagcgggatattatcgaagattcattaaaggattctctaagctagccagacctatgactgagctgttaaagaaggaaaagaaatttcaatggtctgcagcctgtgaagacagctttcaagaaatgaagaaaaggttgaccactgccccagttcttaccttgccagatatccgaaaagatttcgagatcttctgtgacgcatcaagacaaggcttaggatgtgtcctaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgtgaagtatacaccgatcacaaaagtcttaagtatatcttcacacagaccgagttaaatatgagacagagaagatggttggaactaatcaaggattacgaccttggaatccactatcatcctggtaaagccaacgtggtcgctgatgcgctaagtcgcaaggcctattgcaacgtagctcaaatacggcccgaccaagatcacctgtgcagagaattggagaagttaaggctgaccatggtacagtcaggtgtccctgccagcttgacagtacagcctaccctagagtcgcaaatccgggaggcacagaaagacgacgaagggataaaagagttaataaaaagaatacaggagaagaaagacaccaatttttccatagacgatcaaggcacagtttggtgcggtccacgcatctatgtaccggccaagaaggagttaagagatctcatcctaaaagaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccctagcgggtacgactccatttnnnnnnnnnnnnnnnnnnnnnnnnnntcagctcatttcgtgctagtgaaaaccacctatgatggaaagaaactagcagaactctacatgacccatgtcgtatgtagatttggctgtcccaagaagatcgtgtcagaccgaggcactcagttcacctcaaggttctggaagcagttgcatgaagctctcggaactgatctaaattttagtacagcctaccatccgcagaccgatggtcagaccgaaagggtaaaccaaatcctagaagacatgctacgtgcgtgtgccctggatttcgaaggcacttgggatcgttgtttgccgtatgccgagttctcatacaacaacagctatcaggccagcattcagatgtcgccgaatgaggcaatgttcggaagaaagtgccgcactcccttgtgctggaatgaggtggcgaaagcgctagtattcggtcctgacatactcaagtcagcagaagaacaagttaagctgatccgagaacgtttgaagacagcgcagaaccgtcaaaagaattacgctgacaatcggagacgtgaccttgagttcgaaaaaggagatcatgtatacctgcgagtatcacccctccatggtatgagaaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagttaaagaaatgtcttcgaattccagaagagcaagttcccctgggtaatatcgagctggaaaagaatctgacttacaatatatgttcgttagattgtacttacatctacttatattcacttacatatataattttaagaatttacaatataaatatatgccgactattttttataaaaatacgacgacatatatagatagttcctaaaattttgctctgcatggtgatcatgagcgacagatcttgttgcatgtcaagtctactctagatcaattcttttcttccttaacaaataaccgtacaatacataggaagtactaattaagtgcatcctagcttcatttaattctcattcaaggcacccactcttctcacatactcttcttgtcctaaaatatacagtcttcgttccaatatgtagcaacctaggataggaggactacgaatatggatatatgaatataatcccatcatatcctagattgcagtatattgggacgaaaggagtagtgacttaagaaaagatatattggacataaccttgtacaatatatcaagatatccttattgtaataggttatgtctgatcaactcctagattttatatttcgggacaggaaagtaatataactgaggtgaactattgtcttccctagtgatttgtacatgtcatccaaaatgtaactaaaaagattttttttttaaaaaaacaacaagatagataaatataaaatatatctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccctccaaattaaattcctccgcaaaagtctagtttgcctccctgggttcgatgggacgaattccgctcggcccatctcttcccggccccctctttcccgggcgccctcgcccttcttttccgccccgcccgcgcgccgagcgcgcgtgcgcgtgagccgccgcgccaagcgccccctccctt

SEQ ID NO: 14915 - DNA, 4177 bp, Oryza sativa
ccattatcacctccaaagctccagagtatagattgggacgcggggcaatctgggcattttgaaaaaatactcgccactttcagccgggaaatgataaaataatgagctcggtgtcctacggcaaattttacaaaatttgtagtgtcctagagcagttccatgttttctcggtgtccctcagctaattacgcgttttttggttgtcctgtagcaaattttgcctattataaaacgtcggcaacagcctgaccgttcgaaaaaaaaatctcatgttcaacttctaacacactcgcaattttttcttaaaaattatttggaggatgtctctcccctctaaatcaccttggaaaggttaattgttctttcttaaatcaagttcggtggaatattccgaccacagaaatacgacattttgtgccaaatcttgatccaattttggtcaaattgcattgttttgaatttgaattctcgaaaccaatctaaatttcattcggtattaacattcttcctgcctctagcttaaaattttgcagttaaaaccatgcggtgcatacccaattacagatgataaatatattgatccgatccagcaaaaaatatcccgatgtaccagtacctcactatactaaatcgttttctatagttggatctaactccaaatcgtttcctatcgttgaatctaactaggcagaatggccattgttaaatcctagtaatcgaaaataatcttggtaccaagaggtactgagctattttttattggatagaaacaaatcttaaatgtcaatgtttaatgtttcttaacaatatctgggctgcaaatgagtcgaaatgacgactgaactagaacctttcgacccatatccccgccaaaatgtaatagagccggacagccggtagggattgggcctggataggcgccaaaacgaggcatgaattgggcctgattcgtacacacattggtaacagaataaggcccaggtgttgataagccacacatcctcatctggtactccatcgtagtaggctgtagacttgtagtgtaccaaaccaagaaaacaagaaaaaaaatgttgtgttttaaaagagtgattttacaatgcttgaagaggtaccgggattataatttgggacctcacgatatcttcggcactataagttccgaaatttgcattaaaattttggtaaatctaagtacttattaaggactataaaattacttttcaaaaagataaagtactttagcaaattctcatcactcccagcgtattcaacggattcggctatatccatttggccctgctgcagttcagaataagggttgaatttattcaaatatcataatatataagtagagactatttttagggcatatacaatagtctttattagtgatctctctctattgttatgcaaataaatttgatgacataaaagaaagagaaatgaatatggttgttatgcatgacaactgctcagagttgactcttagcatttattagagcaaattttgttgcatggtgatgaaaaaaaggaaagaagagtaagaaaaagtatttttatatattaatgattatagaccatattgtctctaactgttgtaggatgctagtctctagataatataaatctcatatctaactgtatctttgtacatgcacttaggtcgccaaaattgggttacatgaatgagacggccgagttacggtgatgccatcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgaaattttaagatcagctgaggtcttccaagaacccatgttcttggaaatcacatgttcaagctttaaaatgcattgataaaaggcggatatcatggtagcggccattttaaaatgcattgataaaaggtggaaagaaaaaaaaaacatctccaagtgtaccttggattgtgagaacgataaatattctaacaaaaaatttgaatgctagaacgacaagtaaactgaaacaaagggagtattagtgaagattcaaagcagtagtaagtaactaatttgaatgttcataatgatgatattgtaacataaacaatgatagaatataaggtttaaggttaagttttcataacacactataccatttatatttcatttccggagtccaaacattaccgaatcggaataaaatggtccttacaaaacggggacaacctatacggtcaaaaatctcaatatggttttcattcatgttttaggttgtgttcttttggcagttgagaacattttcctagcatgcaaaacgaagcaatggacaaacgtatgattaattaagtattagctaaaaaacttaaaaaaatatatcaatataattttcttaaacaactatcttatataattattttttaaaaaaacacatcgtttaactgttcagaaaacatgcgcacgaataatgaatatagaacttgggaagagggagtatagaacacacctctgctaccgtacgtaaaagtggcgtagtggtagaggcactactacagaaagtgtttttcagtacaagggggttattagtttacatgcgggcggcttaaaccttataaatttctgtacgagggggtcatactatggtggccaaaatctatctattaacttataaaagtaatagaaaaaggaggctccaagttcgctcttatgacttaaaaattctcacattaattagagaaaaataaaaaaaagagtccatattaaaatacattttataaataattaaaatttagaactaaaaaaataagaaatatggaagagaagactagagtccatgtagatatacaatttagaactaattaaaatttagaattaaaaataagagattaaaactagagtttagagtctatatacaaatataatttgtaaatatataaaattcaaaattaaaaataaataata

SEQ ID NO: 14916 - DNA, 13233 bp, Oryza sativa
gatagtgttcgttttctactttgtttctttttcgcttgaggagaagcgtccatgatttagctttagtaatggactgtcgagtcactatcaacttcgttattttaacaattatatattttccattttattttgaaaaatgatacggagtattgtctttagtttctcaagccatataaagatcatagtatctagtatatacagaaatgctagaaaggtcaagtttgctgtttttctaggcaattttttatttctccaaacattaaaaagggaatttcactgtaaatggttgaactcaaaatattttttatattaattttatttcgtacgtggtgatctgacttgttggggtaaccagtacaagccctgatttttgttgcagtcaaggtcaggctgagcttgacgttgaccctcaccaaaaattgagtggtacaaaaccattcaagaccattaactgatgttagatgcacagatgagatgtcaacaagaaaatccacctgttatcaaaaccggtttgaaatgtttccttaatatttagggaaattgagctttcattaatcaataccggcgagggtacatccaacatgaaaatatattttttttatttaaagagtcatattgggaattaatttctatcaattaagctctaccaaaatttgcctaacagtactgaaattcctggttcatgtatacaagacaagccccaacattaaaactagcttgcaatactgatttgtcaacctatacagtcatacagacgcatacccgaaagaaacacctactctgtaggaatatgcctgtggttgcagttaacggattagggaccaaaaccttcccatcttgtggcgaaaagctaattgtaccttgcatgatgtactactagtaggggacctctatgccatttgtgtttagtcaagtaatatgggcgcaaagataaggaagattccgcgaaagagtagttggccgattggctcttccagcttgcaaagcgacctctcgccttgccgaaaacttactgttccttttcagatcagcctaagtgcctaactctcccgttaactgggatggctgcatactgatgcatgcagagtagttagcagttgtttttgtctaagtactgcagatagatggataaacagaaaaactaactgctgagtagtgacaagatcagttccggattaacgcgccagattgcgcaaatccagcatagattgtgtagcttgctcccgtactactggtactgatatagtagttattcaggcatatgggatactatgaaatggttcttggtctcgtttggagctattgtttcttggatcacggagccagtagctgctccatgtactttggtcacctgatgcaccaggcaaaacggctcttaagatgtgaggatgcagtagaaaactgctcaacctggcaggcatcctgctgacgcttccgaggcccaaacagcgcaaacaacttgtagcacttggatcaccccagaatcccagataaatcttgctgctgggttcatgcatggtgaaatctgcatctgatttagataatcttgtatttgtcttgcaaacaaatccactttcaagatttgtctgatgcgtgacataagtatagtagtaagaggttgtcaatgtctgcaaagtaagagaggaggagagctgatgatcgaatcagaattttgtgaggtcgtgaagttgcttcagctttaacttcaactatcaacaatcagatactccacaaaagaagtgcctaacgaggcaaccctactgctaagtactagcacacacaaacactagatcaacctgaacctttttccttagcgcgcacatgatttaatcaaaacaactgccattcttccacaataagaaagccgtgcacgcacacatgctagttagctagtagtttcatttctgggatcaatagtatagccgtcacgagtcaaattcaaaaagaaaaataaaggacgatccacacgaccgtttatatgtgtatacacactagcaaggagttgttgatcatctggatgcatcgacttaaggaaaaaggcatatgaccatttcgtgtgactaatcatactcccttaaaattaatcgatctccatttttgtaatcataatcctgcatcatgcaaccccatttcttacttgctctgccaaaggaaggaaattaaacaaaacccgcaaaattatgtttggctgaacagcataccaaaacagggggagggctcttgccattccgatcggccatttattttggccacaaaaccagcccctccatccatccatcgctgctatatttttacctctttgctagctgctccaactcaccgcgttccacgtggcgcatgcatgtttgctagtgatccgggaggccgcgacgaccgccagcgaacggaagggaaaaaaaaaagtcaaaaactagagccgatcgtttgatccattcgatatagggaagatgagtggatgcctctgcctcccccgctataaaaaggccccaaacgggacgccatcgccaccaccaccagcagcagcggccgaagcggaagcagcagcagcagcagcggcgacgaagccgtccatagattcttcttcctccccgtcactcctcaccaacaaccatcccccaccctccaaggtccgtccccctgtctcctcctcctcccgcaccatccgtcaatacagttactgctctcatcatcatccatccatcctcttctcctctctctctccttttcttgattcatccgtcgatcgattcgcgcgggcgtggcttccttttttgttgggcaaagagaaaaaaaagggagatcctttgcatccgctttagatcgccttttgtgcatgcctcgcgtgggcgcagggaacccacaacgacggcgatatcctcctctctcgcatattttcatgatgcatatgggtgtataaaaattttcacgcgtttttgtgtgcgtgtgttcttggtttgggattgggatggcatgagagctgatcggtgtgattaattatttttgcttgcagatggacgccgccgtcgaccgcctcaaggatgggttcgccaagttcaagaccgagttctatgagtaagccccccttgcctatagatggttaatttgagaagaatttgggtagccgcgcgcgcggcgtgagatgaaactgacatgatcaccttgctgtttgtctttttgtctcctccgcagcaagaagccggagctcttcgagccgctcaaggccggccaggcacccaaggtacgctgctccgtccatttcctgctcaaaatttgttcttctttgtctactagtgagccaacccagccagctggagttttacggttactcctccatggccgctacaccgtccatccctcagctcgcaaacctcgtcagcaaaagaaaagccccaaccttttacccccgatctctgcggttgatttggggattcgtgaacacaccttggcccacagattcctaccggtctagatactactgctactcccaggtagaaagtacacgcatgcttgcaacctgcaagcaaggcaaccaggcaaagcatatagccttgtgtttgcccatccggtgtacactgtttacggtgcccacagcatatatggccatcaaggtcaaactggacaaaagttagcagcaactggcctgtccaagttgcctggccaaagttatataagaggatgaacagcttgtcgccggcctgttaggccggggctggctgatcagttatatacgaggatatgataagtacaaccaagattataaaaagagagagggagattagattagattagaatgctccatttggcaggcgtacgcagcgcaatcttaattagtagctcgggtattggtaggccaggcaaagaagctgctgtagtagtggaaatccttcctcataatgcacgcacccaccaccgaagaagacgaggctcgcacctagtaacatgcaggatttcttcaccgtcccccatgtgcttgcccatgttgtgtttccgccgagatgtcgccttcctcgtatagggtttagcatccatcatcactactgttttccttttgatttcttcgttgcgtccagcttaattttagaatagtaagagcaagtttaatagtacagccaactactaactccaattcatatatagctaatctagaaactcattcatacaatagttacatactacactactaatacctgatcccacctgtcatacacacactgtgtcttggagtccgtgctagagctggctacaaatttatagcccactgcttttctctctttttatttagcttcttaaaatatgtttacagctagcttatagcatgctattgtacatgctctaataagctaattaggtcgtcgatcgaggctagggtctcctggcagcgcctcggtctaaattggcgtacgtcgtcctaacatttgggtacaaaaatttggaccggccggcaacctcgctgtacgtgttgatgaatttcaaagttcatttggacacggccattctcatggggatactgcaatgatgcccaaattaatttgggcgatatcatcgtctttgctgaccccacacaagctagaacgtaccgtgaaccacaagttctcttttgtttatagcaacggagaagaaagaaacagtggataaagccttgcagcttgatatactccatactatagctgtagctaagcaaaagtatttcctgtacgacatggcccggaggacatcacataattgtgggcccagcaatcacgcatttgtttgcacgtccaactcaacagcctttaacgaaagtttaggcgcatatccaaccttttgcttacactacattttggcatctgcctcgctatacagtaacttggattggccagccacacgcattgatgagcaggtgcaaaagtccagcagtttgcattacaacatgcgtacatatatactttattaatatcaaatctcctctcccggaaaatgatggcccccatccaaaaacattaatctacgccgcaactgactgcctgctgctgctgctgccgtaagcccgtaatcgatcggccccggcaatttgctaaagggtggggcctgatcgccatgagcatgctttggatgcgtcagctcgcgtcttaatctaatgctcggttatttggccgtttttgtctccgtcggcgttgtcgccagtgggatcgttagttcattaggattagtactaatcagcgcaacagttatatgccccccatgggccatgaactcatactcgtccgtgtcgtgggttatccttgcgtatccgttctgttttctgggtggaaaaagtggtcagggaaaacagagcagacaggtcaaaaagctggcagctttgggggcaagagaacgggaaaaaaatgtcagattcctgtgggggttgtgggcactcggatacgcctatcagcatctgctgcctccttatcgataagagcagtagtggtagtactagtagaacagatgctaatcgcctaatcctaatatgcttattgatctcctgatatggctgtgtaatcgcaaaattactactccactactagttagtgtggagtaatgaactgagctgattgttgggacaaatgcagtacatggtgttctcgtgcgccgactctcgcgtgtgcccgtcggtgaccatgggcctggagcccggcgaggccttcaccgtccgcaacatcgccaacatggtcccagcttactgcaaggtaaccaacttcatcgtacgcgttttcgtcgccggccggtcgattggtaagctagctattccggtcggtcgccgcggtttgcattgattttgacccccctcgtgtgtgtgcgtcaactgcagatcaagcacgctggcgtcgggtcggccatcgagtacgccgtctgcgccctcaaggtcaactctctctctctctctctcacagatagtgctctattatgtcaactatatagtacccgttgctctaattgtgccggcaacttcacacaccggatcagagaaaaatattttcgtacaggctgagaaaaatgggtcgtgtctgacgccagatggtgtgtgaattattttattgatcaagaagaatcttcccttccccacataatccatccagcttaggtttatgtagggtgtgtaacattcatggtgaaggtggtacttgcgttacatatgaatcttgtcaaatcaagcagggagcataattagcgcctttgtttagtatatttggacggtgttagtaggaaagcaccgtactttggtgaaatctattttatgctcatacagcacatgtatgcgtaaagtgtgcgtgcacgatttgattgtggggtattgacctggatcgaataatctgcaggtcgaactcatcgtggtgattggccacagccgctgcggtggaatcaaggccctcctctcactcaaggatggagcaccagactccttgtaagttgctgaacaaaagaaaacttagtgatagtactatagtattggcaacttgggcataactgtatgcagacaaacaaagggttgaagaaataaaaatgttagcgtgtcttgatcatcgtttgtttctgactcgggtttgcactttgattggttcagccacttcgtcgaggactgggtcaggaccggtttccccgccaagaagaaggttcagaccgagcacgcctcgctgcctttcgatgaccaatgcgccatcttggagaaggtaacgcacgtactagtagcatgacaaccactatgcataaatcaaaatgttaaatgaaattggaacatcagaattaattacattcataggaaggacaatcgaactgtctgaaacttgcgttgtctattcaattcagcactgactgaatttctgcgtccctgatcaaaacaattgatctgatgatctgcaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtgaagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggtatttctcgctggcgccagcattttcttttggtgtgcaagattgtcaaaaagctagatatcgtgcaattttttttctcataaaaaaataataccaaccatcatccacatgtacaataaggttgtgttctttcatgggtgatctggtgattgtgagtgagttttgtttcgtttttcgcgcacacgcttcccgaactacaaaacggtgcgttttttgcgaaaaaaaactataggaaagttgctttaaaaaatcatattaatccatttttaaagtttaaaatacttaatagtcaattaatcatgtgctaatggctcacctcgttttacgtatctttccaatctcctctatctcctctcctcaaacacagcctaagaagtgatgataagtagatgctataagaagtgatgataaatgcatataaagaagagaataactaaaatggtgcttctatacatcacccctaacatgagttgcattatattccaaaagcaaattagcatccatccctgggtcatgctttaatagctatcaaaattgtatcaatgcttaattcagaacataattaaggttcattgctgttgcaggctaatactaactgattatttgactatatagttctggttgtaatcggaatatatatacacggtttatagctcaatatcatctttttactaatcaaagaatatttcgatcaaaacaatttgccacctttcaacatttaatatataaattaggcttctgcccaactatgctgaatcgtgaaacaatattaatctacaattattaacgtgctttagttgtcgcatgtcaccagtcatctaaaatggtctatatatatatagcatatactcccttcattccaaattgatctacatatagttttttttaaggttattcctaaataatctatatatttgtgttcattcattaagtctattcgttatttgtgcactgaagtaaatagacattgatgcatgtatccatgcacacaaatttattacctacatacaatatcttgatttgctattgactaggaaatagtggggatggcgcatgcattgagtttgttgctagagcctagagtaaatatagtatgagagagttattagcttttcttgatcttagtataactataaaatatgtatatcaatttggaatggtgggagtactatcaaattctccacgttggattgttggtaggagctaagtgggtcttttacaagtgcctagttgaaacacattgaattgcacgatggtactacctccgttcctaacagtttttaaatgttctaagataaacaaaaagtttactgcttatatatatttaaaatgcaacatacaccttactcccttcggttctataataattgacgttttggacaaggttgaggtcaaacttttataactttgaccattaataacttcaaaagtatttagtttaaagaaactagaacaacatatatagatttgtctttcaaaacactataataaaagttaacatgcatttatttattgtgtatattataatagaaaaataaggtcaaaggtatattttgtagaccgtgtcattgtctaagacgtcaattaaaataaaactggagggagtatgagttatgacacggtatctccttaggtatataatttttcttttagaaatataaagtgattaaagtttaaatataaatagtagccgataacaagaatatgtatgtgggaacagagagagagagcaacatagcttcaaaccattgtgctatgctggctaaatttagggaattggagatttagctgcaaattcagatggagtgccatgtatacctttttcttcctagactgtgggctaccacctcaaaggtctcatgcatttacttcaaaatacttaaaattaaataattaaattgaatctgaaaaggcatcacctacaagtgccaattagaacaagaacatcgagtattttttttctaataaaaggataatataatagtaatttgcttatgagtttcataattatagagacccctttctaaacactactaagtactaccgtcgtctcaaaataagttcatttttggtttctgtgtccaacatttgatatctgtcttaattaaaaaaattagaaaacaaattaatcacaaataaagtacttttatgttttatcatctaataacaataaaaacattaatcataaatttttttaataaaataaagagtaaaacgttgtatccaaaaactgaaaaatgaatttttttatgagacaaagatagtaaggcttcaaaccaaagtatcctaaaactagtacaatttgataataaaaagagtgacaaaatttagctttagtatatgggttgaaagccttaacaaaatgtgccaaaatttaatattactatattctgttagggttaatagtggcaacaaaccttttatgcctcttttgccgtaacaatttactgaagaaaaaaaaggggagaaatttgataggctcagcaaaacccctgtccgattcccgttccgcacccgtcgaaatccacagtagcactcgtcgccatgtccggctgccgccgccgccgccccagccaaccctatcccggcccctcgttactcttcctcggccgccgccggccgtagctctgcgcttttgccgcactaaccctcaaccccacttcccttcggaaactgatctcctcctactccccggccgccgcggcgccgtccacctccagactccccgcatggcatgccggagttacatttgggggggaataccaaataggcgaagccccaacctctttgggagccagtctggctgggaatgtgttctcgattgatgtcgacgacggccgccaccgactccctgaccgcctccaccccgcagccacggcggcggcggcggcagcgccacatatacgcacgacgaaataaggtactcgattttccttcttgcgtaatcctgcagattgatcctgaaatttatccgcaacctatttaaatcctctgaaacctatacggttttcgttataaatgccgtaaattaagtcaagttaacgtatctgttgcaattgcaaacgaagaggtagagtccaagtgattttctgatttcacccacgggcctatctgtttcatggctactaggttcagagtttgcctcctcattagtgcgcgcttcttcttcgtttgtcgccgatcgtttttgttcgtatagcgactcgcggtcgcggggacgcatcgaggatgggtgcctgctgctgctgcttcccggtctacaaacccgcgagggagaacccgatgcggtcgaccagagagtcactcatccagcacaagccgaggcctaccacgccgtaccatccaccaccacccccgtttatcacctacactgacaaggtcgatttccctttctcattgtcggtatgatcctcctgttgttgtcgctgatgggccgcccttatgtcgtgttggctgcttgattcttgcagggcatgaacgctgtcgagcgcttcaagactgggttcgagaatttcaggaatactatatacgagtatttttctgatgccctgagagttcgtcggtgtgtttaatacgattttgtgctaaatcgaatctatttgtttttgtcggttttcagcaagaggccggagctgtttgagcggctcaagactggccagtcaccaaaggtatagtgctgccatcagattaatagttttatacatagattatgaaacctataatttgttctttccagcacacatagaatgcgccggcataatttgctgtctctactaagaattatgccatttggagggtgcatacctcacattacgctcttttggtttgtttgtggactgaagtcaaactcgactaaggaattctgatgggaacagctcattaccattgtgaccattgagcaatatatattgataaaaaaaatagttgacaaaattttcatcttcagtacaaagtactagtggaatttcttcaaaattctacattagaggaactaacatgaacaaaagcacagagcggcttactatagatgaccaatgacatggttcctgcatatgttaactttttttttttttgaaggacagacccgtctaaataaatgaatatttttgttttcttattctattagcttgcttaggttctaagttttttcctttatgacttgcgtgagaagggctagagatgtgatttctagtgctgtagagtgtcatgtggggaatgcactacgtccgcaggcgcaaggatcagcgacaacagcaaaacggcaaacagtagatatgcaggatttgttttcgtttgtttcagagtctgttaaagtttgttagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaacttggtatcagattcctctggttccgatccaatggcctctactcagaatcaactcgatgaaatcgcgaagaacctcacctccatggcggcgcaaatctccgatctcgccaggaagatgagcaccttggagcccctcgtgccgctcgcggcaaaactcgacaagctgcctgatcgcgtcacgcaggtgcaggcgtccgccttcgagtactcggagcaagtccgcgctctcaacctcgccgtcgagcgcgtcgaggcttcccagcgcgcggccacgacgaacccttctggcttggtctcacgtcagccacgcgacaacacaccgtcacaagatgacgctgacgcacgctcgcgacgcgaccaacacggcgacgacaccgcgatcgacaacagcttccttcctcgcgccaaactcgagttcccgacgtacgacggcaagggcgacccgctgccatggctgaaccgctgcgagaccttgcgcggacagaaaacgccggagacacgcaaggtgtggtatgcctcattgcatctaatcggggacgcccagttgtggtattacaggattgagctcaattctggcgaaccgtcgtggcggaggttcgtccagctggtgcacactagtttcgggccacccatgacggacagcccgctaggcgagctcacggccctgcgttgcactggcacggtggagaactacgttaacagtttcctcggcttggcgtgccgagacgtagagctatccgagtcccagcaggttcagctcttcacgggtggcctggccaacccgttcaagactgatgtcaccctatgccgcccgcgagcgctggacgacaccattatgctggcgcgcgcgtacgagcagcgcgccacccttggcccgactgatccatacgcgccgagcacgggacgagtgcccgcggccttcactgccggcagtcgtcagccgcattcgcatctgcatcgaccacttcggctgatgttgccggatagaccgctgctggcaagcagcccctggtgtcggatctgccccgcaagcgactttctccagacgagatggcccaacgacgcttcgaagggctatgctacaattgcgacgagaagtacgtcacaggccaccggtgcaagaagtcgttcgtgatcgaggttatcagtttcccggaagacaccggggacgaggaggactccacgccagaagcacacgccatcaccctcgacgagccgagcatcttcctccacgccctggctggtatctctgctcctaagttcaatactatcaaggtgtgggctcgtctcgggtcgcaggaaactcgcgccctccttgactccggctcaacacacaaccttattaacgatgccat

SEQ ID NO: 14917 - DNA, 2301 bp, Oryza sativa
  unsure (1)..(2301): unsure at all n locations
gagttcgacatcgatttttatgcactcccgcttggcggctacgacattgtgctaggtgcccagtggctcggcaccctcggaccgacgctatggaatttttctcgacaatccctcgccttcggacccgcccacgaccgcgtcacgtggacaagtatcgacgccgcaccggcgcccgcccttgctgccgccatcgacggtcagccgggcgacctcatgaccgatctgctcgacgtcttgaaagacctcttcaccgagccgcacggactaccgccagaacgccatctctgccaccgcatacgactggaggcaggggtatcggctgttgcggtgcgcccgtatcggtacgcgcacatccagaaagatgagctcgagcgacagtgcgacgatatgctccgccacggcgtcatccggcccagctcgtcggcattctcgtccccggctttgctgatcaagaagtgcgacggctcctggcgcttctgcgtcgactaccgcgccctcaacgacaagaccatcaaggataagttcccgatcccggtcgccgaggaactcttcgacgagctgcgcggcgccaaattcttcaccaagttggatatgcgttccggctaccaccaagtgctgatgcatccggacgacgtgcacaagacggcgttccgcacccaccaaggcctctttgagttcttggtgatgcccttcggactcacgaacgcgccggcgacattccaagccttgatgaacgacgtgctgcttccgttcctccgccggttcgtgctcgtcttctttgatgatattctaatatacagctcgtcttggtcggagcacctccgccatgtacgcacggtgttgcaaacgctgcaagatcattgcctccacctcaagcgctccaagtgtgagttcggcctcacctccgtcgcatacctggggcatgtcatctccggggacggtgtggcgatggaccgtagcaaggtccaggctgtgctggactggccggtgcccaagacggtgcgcgctgttcggggcttcttgggcctcgccggctactaccgccgcttcatccgcgacttcggcgctatcgccgcgccactgacggcgctcctccgtaaagaggggttccgttggtccgacgaggcggcagcggcgttccgcaagctgcaacacgctttgacggcggcgccagtccttcaacttccggatttcaaccgcgacttcatcgtcgaatgcgacgcgtcgggtacgggccttggcgccgtgctccaccagggcggcggtccagtcgcgtttttcagcatgcccatcgccccccgtcacgccaagctggccgcctacgagcgcgaattgatcggcctcgtcaaggcggtccgtcactggcgaccgtacctctggggccgccgcttcatcattcgcacggaccattatagcttgcggttcctgctcgaccaacgcctctcgaccattccacagcatcattgggcgagcaagctgctgggattcgattttgccgtcgagtacaagcctggaacggccaatgtcgtcgccgacgccctatctcgccgcgacgaacacttggctgaagcgtttgttctatcggcgccgcacttctcgctgctcgacgacgttcgccgcgaggttgcctctactccatccctggcaagcctccgcgacgacatcattcgcggcgctaaacccccgccgtgggcattcaaagatggactgatcgtactcaaggatcgggtgtttatcccggagtcgtcaccactgctacccgcggtcctggagttggcgcacggccacggccacgaaggaacccagaagaccatgttcaggctccgcgccgatttccatgtgccacgcgatcgcgtgctcgtgcaagatttcgtgcgcgcctgcctcacatgccaacggaacaagacagaacatcttcagcccgccggtcttctccagtccctcccggtgccgtccgcggtgtgggctgacatcgctatggacttcgttgagggccttcctcgcgtccatggcaagacggtgatcctcacggtggtggacaggttctccaagttcgctcatttcatcccgctgtcacatccatacacggcaaccacggtggcggcagcattcttcggcgacatcgtccgtttacacggtgtgccgtcctccatcgtcagcgatcgggatcccgtcttcaccagcaagttttggacggagttgtttcgcctcgccggggttcagctgaatctgacttcagcgtttcannnnnnnnnnnnnnnnnnnnnnnnnnnnnnnnnnnnnnnnnnnnnnnnnnnnnnn

SEQ ID NO: 14918 - DNA, 4791 bp, Oryza sativa
ctgcgttcttatgagccggggagtacatgcttgccagccgttcagcgctcgatgcaagatcgggatcagtttttggtagccatccgtgatcggctggagcaggcacagcaggtgtacaagcaggcctatgacaagaagcatcgggagttgaattttgatgtgggcgattgggtttggctgcgccttctgcatcggccgatggcgtcgctcgacacgaggggccgtggcaagctggggcctaagttctatggtccctaccagatcgtcgcttgcatcgggtcggtcgcttatcgtcttcgccttccgccaggagctcgtctgcacgacgttttccatgtgggactgcttaaaccgtttcggggtgagccgccaagcactctgcctccgttgccgccgacgcagcatggtcaagtctgtttggaaccacagtcagtctcccgcagtcgtttggctcgaggagtccgtcaagtcttggttcagtggaagaacaagccggcggcagacgcatcgtggttgtcgctggatgaattccgtgcattatatccggatttccagctcgaggacgagctgcttctcgagggagggagagatgtcatgtggggaatgcactacgtccgcaggcgcaaggatcagcgacaacagcaaaacggcaaacagtagatatgcaggatttgttttcgtttgtttcagagtctgttaaagtttgttagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaagagtaggtctccacaaaaaaaaaaggcccaaaatcggcaccacattttttgagaaatgtttcctcataagtcataactgagtgatttgccgatccatgatttatttggtatgattgtctccgttttgatttggcctggattaattgttctttcttgcagtacatggttttctcgtgtgctgactcacgtgtgtgcccaacactgaccttcggtctacaacctggtgaggccttcactgtccgtaatattgccagcatggttccagcctatgacaaggttcatgtttatgtacattatatcttgtctttcttcatgtactagtcagtaactttggcctgtgtattccaggtgtaaattactaagccccgtgttttcatgttgattgcagagagggcagtgcagcattgggtcagccattgagtatgctgtggttgtcctcaaggtcacatcttccttgcgaataattaatgtccttctaatctaagtcgcatgtttttttggtttaggaatagaacggcctcatgatattttgcagttaacttgtattagttatagaaaaggagagcagtggatatcgtagtatcacctgcaataaaggcacatccccattatgtcgaagtcataaacctaactggtgcacttgtaatgtgataagtggataaattattacccaatttcgtgatgacatcatacacaagacctttgtttggaaaaggagattaattcctgtttcacttacccttctctaatttgttctagaaattatcccatagaagtaaagaagaatcttgcgtcccttcaagggcatgtgtaggctctctctttcatttggaaagcatcctgtcaaatgcaaatgggtttaccattaggttttgtcggggcaatgtatacacaaatcaagtacccctggtatgatttagggagtgaacttctgttttgcatttcgaaactgtatgttctttgaaagttttagaaagaatgtgcatacacatagcagtgctagatatttgtgcgacaaccatcatacagtccacttacttccatattatgaataatagagtctgtaacattcatcatgtgttaaatgattctagcatggacgagttagctttcagattatagctgtaattcggagttctgtagagcactatagctgaactccgttagctgtatttattctcatttaaagtgcccaaatggatatggaagaattccactctagaataaatttggtgaactcacacattcgccccttcaacagttaacaaggatcttattattctccatgaaaggcacatgttgacagacatccatttggcaggttgaatgtatcattgtgattggtcacagctgctgtggtggaatcaaggaactcctctctctgaaggaagatagacctaacaccttgtaagtgaacatatccatactcggttcaagttttttatatgctgaaagcagtcaaaggattcagataagaccatacttacatgtccaggaagaatctgtcccacccaaacaaggccaagaaggaagaaacattttaaaatttaaaataaaattactgttgtataaatacgcttctttcacctatccctttttgcaatctcatttttgtttgattacctagccacttcgttgatgactgggtcaagattggtctggctgcgaagaagaaggtcgagagagaaaacatgttactgccttttgacgaccaatgcaccgtgctggaaaaggtattattgcttggaacaacattatattatttctagtagaattgaattgtgagtcttggactaagggttcactgctttgacccacggacattgagcaaagcgggctaaaattccctcacgccgatatttgcttatctgaataatgttaggtttgcaagttaactcccatggaactgagctttactgtgtggatgtaacttttttaagataatggaaatggtttacattttcgggtcttccgtgttcgtcgatagcgacacatccaataagtgtttgggtgagctacagagtgacaatagattttaagttgaatattagcatgctaaatattaataaagtgaattgcatattgggctatttattttttatcatgattttagattggaccacccttaatccaatgctttcgcattaaaccagattttcttaccaaaagattgcagttaggaccagtggctcacttgtcaatattgcctctctctcatctctctggtctccattgatggctcgtggtcaaggttgaggtcaagctaatgccggtgtacgggagcagaacctcgagcgcaaggttgatgtcaatgaagcttgagtggaaggggaccttaagctcgacctacatccacaccgtgtcacgcaagcttgaccttcgtcatcgtcacgcttggcatgggctcaatcacgacctccatccacacagtccctgggcttgagatcctcttcgcctgtcaccccgactttcgccccgccgtctcctggctcgcgatcctctccaccattgtcttcctctcctctctagctcaccctcgatctcctcgcacgccatccctagactcgattcctctccgccagcattggccccaagcttgacattgacttctgcttgtgcaatccttaggctcgtacttctgcgcgcctgccttggagtcatgaggactcgccagagtgatagaagaggaggtcgatatgctctctcaagctcccatcacgatgcttcgttttttagtccctatttaacctcactgacaggtgggtccaggggcagagccatgattttaggtcgatggtgtcattcgtcggctctaattgacgatcatggtttaagtgaaacagaaatacatatgaaaaatacaaaaaattcctcgcaatagtggttgctcaacctatgtttcaccaaatcactcaagaaaacttatgatgcacgaactttatttagacattgtgcatagtcttgttgaattagccgttgtgtatggtcaaataactataaattatagtttgctagcagttattttgttgatgctgtcaagttgtccatgtccacataagctaaattgtctaatgaaagtgcaaaattattcacacgttggtgtcacaaatcaaaatttactagtgtcattcattgaaaaattagaaggataccttaactaatagatgggtcattgttgtccggtgacaccactgcttgtatgccagctccacccctgggtgggtcgttagtccaaagtgtaaccttttggcaacaaagtatggtgtaaaatggaaacgttaagggaagaatggttcaatgtaaatctaaggtaaaataatataacccaatatgcaatttactatatattaataataatacacaccttattcgtcttaataaaaaactaaaaattgactatgaacgatcaagatcgaaccgacaattttttttataaatatctaattatgtgttatgattagatttctaatgataaaagaatactttattaatatcctatcgggagatatctattactaaactgtattgagggttgaaacatagtcatcacatttgcctctaaagtctaaagaactagaaattactgagtatattaagagaggttgaaatggagtcatcacattcaccgtgcgtctaaagatctagaaattattaccaagttataaattgaagaaaatgatatatatatatatatatatatatatatatatatatatgtatgtatatatatatatgtatgtatatatatatatgtatgtatgtatgtatgtatatgtatgtatgtatgtatgtatgtatgcatcatttgatcatggtggggtctaaattatggttcttaagatt

SEQ ID NO: 14919 - DNA, 2539 bp, Oryza sativa
gtatacaaaatagtataagttatttatggaagcatattatgtaggatcaggagagcgtcgatgagatgaggctaaatgatcgcatatgtttcctgaaacaattagccattttaattgttacaagttacaacaaacaatacctttgagacacatatatgatatatagccactctagccttacaaactagaaatgtgcttttaagagagtgcaattgagttttcaaaaaaaaaaagagagagagagagagagagagtgcaattgggcccacaactaagacatgccatactcacaccatcatatacgtgtgtatcctctacagacgcctgaagtatcaaatgccctcatgacgtgggcatctgcatatataccctacaaatgccccaatgtgtactcctaattagaaaagaaagaatgttttttttttacgacaagaacaacgtatatctcatacgcgtcccacttatttgcacaaatatatgtaattaaaagtttgcatgaggatcggagaagcatgtgagtagattgtcgacggcctggtcaatcagagcatgcggcggaagagattgtccatggagatgagcgcgctggcggccagcgcaaggaacccaaggaacgatagccaaactgcgttgttgatttttgtgttgagtggctccttgccgaacgcggccgtcgacgaggctgacattaggaggtacgccaacacctgcagccaaatgaaaccaattagccgcgcgcgcgtgtgcgctgaaaaacttctgcttctccaacacgtatgttgtgtttagttcgtgtgccaaattttttttaaagtatacggacacacatttaaaatattaaacgtagactaataataaaataaattacagagcgaaagggcctgtagcctagtggttacagagcgaattttctaggatttaacggcgttgtggtttcagtggtaggcgacgtacccgtcgatagagaggcgtctgtggtgacttcgtcaatctcttcagaatttgtcggcccagtcttcgaagatgctcataggggtagggtttgcgtgcgtgtgttcataggggtgagtgcgcgtgcgttgtgagtgtctgcgttgtactgtgtaattctcaaaaaagcccagtcttcgaagatgctcataggggtagggtttgcgtgcgtgtgttcataggggttatgctcataggggtagggtttgcgtgcgtgtgttcatgggggtgagtgcgcgtgcgttgtgagtgtctgcgttgtactgtgtaattctcaaaaaaaaaattacagattccatgtgtaaactgcgagacgaatctattaagtctaattaatccgtcattagcaaatgtttaatatagcaccacattgtcaaatcatggcgtaattaagctcaaaagattcgtctcgcgatttacatgcaaactgtgtaattgatttttttttcatctacatttaatacttcatgcatgtatcaaaacatttgatgtgatggaaaagttgaaagtttgtagaaaaaagtttgaatataaatatggccgtagctttgcaatggcgcattttgagcagaagaattgatgggttgatagatgtttcaaaagaaaaatgaagaaccgatgtattgtgtgtattgggcttgcctgatccaggaagaggctgacgcagtaggttatcgggttcagagaagcagcaaacctcggcgaaatgaggcgcccgatttcgaccactgcttgcgcggtcgagtagacgcagactatcagattcacaccgagggcatacctgtcatagtacattggcggagaagagagaatatttttaactaaaaaggataatagatgaaatgagaagggtgaatagtaaagtgatctatgtggataaaataaaccctgaagaaccaaattaaacctttggtgaaacttaaaggattagattagttattcacctaaattaaaaaggagaagctgatcactttgtagtgaagctaggaactggctagttcctttggggatcacaccgctagatccaccgttattcgactcctaaccaatctacttctctctctactgtggtcaagggcagcggtgccttgccttccatggtcatcctctaaagctgcccctccattgaccacccttacacatcaacctctaaccctgataaatctattccgttgtgtttgctggatttcggaccatcactgttgttgcaccatcgccggaacaagttgtcgatgagttcttctacttgctcttctgcttcttcatctattctatctagaggttgaagaagactctctgctccctggaccttagtcattaatgaatgtgatggccaggaaaacatttgggtggctgtgtttagatctagggataaaaagttttagcgtgtcacatcagatatatggacacacatttgaagtactaaacgtagactaataaaaaagggacaattgcttatttgaccctgttttgaagtctaactaccaatttgaccctattttttttagtttgcttatttgaccctgcttttcaaaaacgaaccttccgt

SEQ ID NO: 14920 - DNA, 4375 bp, Oryza sativa
  unsure (1)..(4375): unsure at all n locations
gtcccacatgtaatagggtcaaatgagtaagggcaaaagggaccttttgtgcttcagttaacaccgttagtagcccttaacagaatagggtcataccgtatctttaattctgaaaataagggtcaaataagcaaaattgaaaaaagggggtcaaattggtaggtagttttcaaaagagggtcaaatgcgcaattgccccaataaaaaaactaattacacaatccgttagtaaaccgcgagatgaatttattaagccaaattaatccgtcattagcaaatatttactatagcaccacattgtcaaatcatagagcaattagtcttaaaagattcgtctcgcaaattagtcgtaatctgtgtaattagttattttttagcctatatttaatacttcatgcaggtgttcaaacgtttgatttgacacggcgtaaaattttagggtgggatctaaacaccccctaacttttattgtagaatatttacaaaacctactaacaatgcttggtcaaggaaactcctgacctaccgactctcatttccaagttctaccggtcgtaaccaacatagatgaaaattaaaacagtaaaaaatataaataaaaaatggaaaagattttgctatttccaaattttaccttattattgaggaaattatcctttttataatatagcaattactgtattttaaatacccaataccatgattgaggtctctatttaatccaaattttagagtaccatcaatttctcaatgaaattccaaacttgggtgcaaggctaaaagagagacaatttgtaaaaatatgattttacaaattaatgtttttgacgttattactagtttccgatcaattataacatgttttcgttcgtacagttccatttttcaattttcccgatatttcggatacaattttaattttaatttttatcatgttttatcccatttccgagaaaaaaaatatgattatggcaatggttgatttttgaccgtttccatcccaggctataatatagaggaagtacttaattttgagataaatctacatacaactatacaagggagtattgctagcatctagacttgttgcatgttaagaatgcatgatgtttagacgcaacaggcaagtgatcatgcaataacctgtagtactgttcgtagaggtcgtagcggtcgctgtcccacccggacgtccggacactagccatgagcacgaacgccgccaggctcagcaccgccggcgccacccgcagcgccgtcgacagcgttctcctgtcccccgccgccatgtctcgcggcacgtccgggacgacgtcggacttggcgggcggcgccggcggctcttgatcgaccacctgatccggcttcgggacgtgcttcgtggcgggcggcggcgccttgtcggggttcttctcgaactgctcggcctgcttgaggtaggtgtccatgtgcggcgtggtgtatagccggacgccgtcggcttggcccctggtggcgacgcgctggcggtcgtgggaggcgagcgaggaggcggcgtatgggcggccctccttgttgtagaggtactgcctctccatgagcccccgcagctgccgcagctcctccaggagcatggccaccgtcgggttcgccgcctggttgaaattctcctccagtgccttccgcgccttctccagcttgttccgcgcgtcctccatcttgttggcctcggccatgtccctggctgccctgatcatgtcggcgtgctgccgccgggccagctcgttctccaccggctgtggcttgctcgccgcgcctggtgcagcactcggtctgcgttttatggtgatgagatcggggttggaggtcacctgctgggcctggaaggtgaatctgtactgtgccaagcagacattggcgtcgtacggaggggaggcggtcttgtcagcaagcgcgaggtatacgatgaccctgcgcgcctctgcgctgtaaagggtgccgaaactgactgtgacggaggagccgtcgctggcggtggtctgcgggtaggtccccgcgtacacccagaccaccctcttgatggtgacctcgccatggaaccgcgtgacggtgagctcgaggtcctgggcgatgatggtgaggaggccgccaagaagctgggagaagggccccgtgaggttggcgctgtcagcgacgtaattgaacgtcccgccaaggctcttgcgcgcgatcgcttccagcaggttggagtcgtggctcgcgccgaagctgaaggtgtagacggggacgttcttgagatggacgtccctggcgtcgccgccgtggttctggtagccgtcggacatgagcatgacgctgacggcgcggccggcggccagactgcggccgtcgacaacgctcatgccggtctcgaggccgcccttcatgttggtgtcgccgtaggccttgaggccgtcgacgagggccttgagctcggcctgcgcggccgccgtgacgaagcgcagcgggcagagccgggtggcgttggtgcagaaggtgacgatgcagaggcggtcgaggtcgctgagcttgcggatgacgaactgcagggcggtcttcaccttgtcgatcctgtccccgtccatgctgccgctgacgtcgatgacggcgacgaggtccaggcccgccctgtcggtggacgaggaggagcccctgagctcgagcagcagctcctgatcatggagtgccatggacgcgacgtcgttgtggtacttgttgagacgcacttgcttcaccagttggcccgtgatccccaccgtcggcctcgccggctcggtgncggtgctcgtcggagcagtctgctagtcgtcgttgtacgccatctcttcgcgatcactagctagcttcttggttgttggctaaagcagctagctctgcgcgagctctatatatacagcactccacggcactcatcacgagcgtgtaacttttacagcggatttgccaaaaaaacttccacaagtttttttcccccctaaaactttcggatttatgaccatcggatcatcttgagatttatacatgaaggaaaaatattgctggaaagaaatttttatacatgttacgcataagatttcagtactacctaacctaaccaaagcgcagttgaatacaagttttatgtaagttataccgtaattgcaacgtagttataatcaaggttgacaatttcaaatttggactttatgccaagggttactgaaattttggaaatttcggaacgaaattatttgaaattttgattgattttgaatgaatttgaataaaatttgaccaaattcacaaaaatttgcaaaaagccaaaaatttcggatgagatttgagcatgccggcggggggcgagattaccgaaatttcgggcgagatttcggaaatttcaaactaaaatttcaaaccctggttatagtgcagctacatgtaattacacttcaattatactatagttacatctgaaatttttttactagaaaaacttacggcagttttttagatgctctccaccgataatacaataaattttggctttgtttcaagaaaaatcccaaccatgagcacaaaccatattctccataaattaaagagcacaaaatgtcacaagtgtgttaataagcgatgacatgcccatcaagtgaattattcgttatattaggtgagagtattttcatccttgtagacaattatatctcctatatagtcatataactttttgaaaacgtgttcttccataataaatatgcaagtttgaatttgacatacacaactaaaaataaaaacaacaattttcttgtgaataatgcactattcgcattcaaatatgttttttctcctcgtaaatgtcaaatttaaagttgtatatttgtaaagatattgtcacgccccgaactagccccgactggaactagcccgtgacgctccaaattaacctgttaatcgataccagtcccaggaaacagtgctggtatcacaggaagacagaatatcacaactgcaatacaaaaggggaaacggaagccaggacttggaccaatcatcacaggcgcgacttgggaactaggccgaaaccctaaaactcatcgtagccggcttgctcctggaagaactccacatcaacaggatccgcttcatcttcttcagcaactgggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttcttaaacgaaacggatgaaacaaggcgtctcgtccggtcggagtatgtgcaatgtatcagctcttta

SEQ ID NO: 14921 - DNA, 4627 bp, Oryza sativa
ctagcatgacgtaccccttcgctagttcgctgtatccaatttctggactttatctcgcagcagtagattttacttctaccagcttattgagccgatcagtcttgcaatccatcttaattaccactcgtttttggacaaaaggcaagcgacttcccagcataaaccaagcttagttgctgttcaagccggattagcagatactctgcgtctcctcccgaagtgttgttggggatggaaccttgccacctaccgctgcactgcgggtttggtgtgctacctgcagtacggtcaccatttcgtcacatctgcatagaccggatgctagcttggagtagctaggaactactacgctgcatcttcccgtcagtagaatttgctttcgttggataatggcgtaacgctctttgacggtgtatatccatttgcgaatagagaccaaactaaaaaaaaaaatattggcataatgctctgctcgggctggtgggtggtatggcagccactttcctatgcacagtgtgcatgtagccgtgagagtatacctaatgatgattgcttttatgctttggtgaatataaccaacttaattacctacttggaaatgacagaccgaaagaaacgtgcgaaagctaaagagaggaacatatacgtttatgtctaattcgccacacacaaggaaaaacggaagaaaaaaacaaatgctaacaaggagtaggattgatgggaggtggtagctagactgaattagtttaagacgtacgcaaccatctctatgatcgatcagcgttgaacatttgactactcgtatatataaagctaccgggcgtatgatttcctcgtgtagtagttagttattctcgcattcgttttttcctcgtgctatatgcacaatctttggatgcattcaaaacattctgattgtgactttctccatataccaatgggctcatgcttatggcgtaacattaaacttttcgccggtttttattcttgttctggtggtcagccggtttcttggaaagaggaaattgatcgtagtttcaaagtctcctatacgactcgtccagttggggatgaaacaatctacaaatcaaacactagcagagacgtacgcagaatttttttttccactggcagcaccatttttctttgacccgaggtagaaatcttcaggtctaccacatcatgattagatttcaaccaaccagtgctccaattcggatacccattttaacattgcgccactaattagtcagctttgtgttgcttagttgagccatactttacgcgttctgatccttcacatcagctaacaaatccaatccttcccctgaaccaaaatctttcagtactgctcccttcaattccctagcaagaaagcagagaacctttcgacaaacaaatagtgttgatactaattataagtgggtgctggacttctgatagcttcgtttcaacagtctacacccaagggccattaggaaaatttatctgatgatagcttagctccaatcttaatctggaacaacatgtctggtccattaggcctccactggaatagaggaatatcacgggagttgaactaattcttgtgaaaatcctgtagaagtcatgcctttatctttatgctatcactaccattctctaagtcatcgcggataagaaaccatgggcaagaaaattttcagaatatcaaaaagataaaatcctctctccggtttcccagccagctacgaatagttggaaacacacctgctgcttggctatgcttataatagtggaacatgattcatatttctggttttcaaatggagtcaggtgagaaggatggaacgagattattgataaagtaccgttccaaaaacgttcttatccttatcggacaattatcaatgatagataacagaaagtaaaatcacacggcatcatcgctattattttattaaagcaacatggcttctttttttttgtgagtattcatgcaaccatcgtaatcttgacgtgtaataatttggcttattgctatttgctacatcgcagaggacctggacaagctgagggagatggagatgttcggcgaggacggccgggacggcgtgtggacggtgatggcgaacgtgacggaccccgagagcctgcaccgggcgttcgacggatgcgccggcgtgtttcacacctcggcgttcgtggatccggggggcatgtccggctacacggtgagtgcaccaaactcggtccctaaccttaagatcctcgcaactactacacctacctatgttatgtgttccctaatgctgtcacagaagtcactaagtaagttagttatgtgttccctaatgctgtcatatagaagtcactaaataagttaggttagtaaaatatagaaaaaatcatgcaaacaaaacagagtgaacttgaagagaatggcggaaaacagagtatatatgctccatctaacattctaactcaaggcgcaactgaacatcaaagattgatgttgaatgtttggtgtactataaaaagagcaatattatttatggtcgttaagaaggtatcaagaagtactacaattttactagaagacactaaattttacaattaaaaaaagatacctcctgatacaccataaaataactcgtaaaaggaacattgcgattttctttgtggtgatgtggtggggacccagtaacagtctgaacttctggaaatcaagcaattaattgacacataacggcgttcgggaatttttgaagccaatggacatagatcattttcgtaattaatggcatgcacatcacagagcctcagacatctggcccagagaaatttgtacagttgagctgtagagtttgcatctacatgtacatggcctttggtactgcacgtggaggcactcatgcctcaaaattcagaaagattttgtaagaccgagtgacgagactctgtagttcgtgtaccacacggggaagattctgctcattcttggcttctcctcccaagagacaccaaatagtttatggtacccgttatctagaaacgttgggcgctgcggtgtccatcacagatgttaacggttataccttccatggttacttaaaaactgagaccttgctgattgtcgattccattggtcgtacagtagtatcaagatttcaaaaatgacaaaccagtactattgactgatgtgaagagcggcagatgccataaaactagccttatttcgagcagacttaataaaaaaagggtttatagaaaaaggctcaatcaccaactcgtaccttcaaggattattttgtttacgagccaatgtcttgtttgttgccaaaggcagggtgggagaggatcttgaggctggacagtcctccttgtcgccctttcgttgacattttgccaaacctgaagtcctcctgatgggagcaggttgtaactggtagtcctgcctatgcagatggtcttgcacctatctgatccatgaagtagagcttccggagcacagcattggtgggcgcacgcctgtcaactccgtcacctaattcattgacagaaaatcgcttgtccatagcaggggaccgggtttattatctgataagaacgggtaatcaggtaggattagtatctgagtgtgatgagagtccgcattgcagcaagagttggacaatacaaccaccgaatccacttcggttgggtacttccaagcagccgtcagaatcatgacgaccttagtgtaaccaaggcgattaaagaacagagatgccatccagttgcgtcctactctgcaacaatatatactccctctcttttagatttattaacatatatataaatataggcaatattataaaatcttatattgtgaaatgcacaatagagggagtatgctagtaataggctttattttactgttcttgaatacctttattttttttaccattcttgttccacacaatataacctctttttaatggaagaaatttgctgcaatttggaggaaatgaactggttcaatgaaaatcctgtaaaatttatgcgtttcaaagtagccctacgttcgattttgctatatatttgtcgacaaattttcccctaaaaatttaacagatgtaattacagtacaatcgtagtgtaattacactataacttgcatgtaattacactgtaactatagtgtaacttgtatgtaactttcaaaaatctctccgtaatatgttatttcgataaaatggaggtcgtgggaacaaattctttcacatatgtgtgtactatgatttgttttcttcctcaccaaaacaaatcttgtaatagatctaacaattcaaaattatgtgaaacttacatataagttacactgtagttacatgcaagttacagtgtaattacatatatgttacagtgtaattacattatgattgtattataattacatctgtcaaatttttaggagaaaatttgtcaacaaatgtataggtagtcccccctacgtttggtatctcaatcacactagtgtttatcatttatctgcagtaagagcctattgtagctaaaataaaccttaccaaattttggtattgccaaaattttggcaagatgacaatattgcgaaaattttggcaggatatcttatgtatttact

SEQ ID NO: 14922 - DNA, 53477 bp, Oryza sativa
  unsure (1)..(53477): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtagtagctagtagctcgttttatgtgtatattgtgcttgacgagtaaaattgacttaaggctgtgttcagttccacactaaaattagaagtttaaaaaaattagaacgatttaacggaaaagttgaaagtttgtttgtgtagaaaagttcgatgtgacagaaaaattgaaagtctaaagaataaaaagttgaaacctaaacagggccttacaaattgtctttgatacgatacatcgatggtcgatttggttcctgcgtgactacaacttaaacagttgttagggctgtaggatgtaaattcaaatgcccaaatttcaacaggacaccgttagggctgtagcaagactactgtagcatttaatctggaccttcaacggaaaaattggatgactggattgcgtgcaatctctaacgtgcagttatagttgggactgcacgtcagcagatgttcccaatccatcgagtgtgggtgtatgacctgacctgaaactgacctgtcagcaggtttgatgcgttcaccggtcggcatgtatgcagcaacatggtagtgcaaaaagggtacgcgtaaacctggatttcttcggtctcaaaaaagcccaaatgcgaccttaaaaaagaaggccaaatcagccaagctcgatcccttgactgaagcatggacgaccgtttaccttggttagcttggaacggttcaataattgctgctgctaaatatggcaaatgatttactcttaaaaattactgcagatgattaaagcaatcagatgcttactgcaaatgattaaaacaataagatgcttcagaagttcacgcatgttaacttgcgtttcgaacgtcgggcgtgcgatgtgcaagcgtacaatcgtgatatgtggagtagtagcgatgcagtagtaccatggaagaaaaagagtaaacagagtatgggtcggaactcagaaaggggtgcttgaaaacgggaatgctacgcaccggaattccgtccggacgggatccttttatccccttgcttattcaaatagtagcgatacctgaccatgcacgtcctgaacagcagcagcaacctctgcaggacacggtgccgctccagcgcgcgcgcatggctgacataggcagcggcgcccacacccgcactgtcgacgcactgccccgtgatcgtgagctcctcgccggcggcgtcggcaccggcgcaggggaggaggaggacaacacggacgcggcaacagatgaggaagtagagtgcgaaggtgttgccctcaccaccgccgtcggcgcagagcacaacgagcacgtacttggctagctcgtcgaggtggggaaggacgtggccgtcggcgacaagctccgacgcggcgtggacggtggaggatgcggccgtctacgacgagctccgacgtgggacatggatgatgaaggacgcggtcgtcagcgacgagctccatcgtgggacgtggatgacgaaggaagcgtccgccggtgatgagctccgacgtggcgtggacagtgcaggatgcggccgtctacgacgagctccggcgtgggacatggatgacgaaggacacggctgtcggcgacgagctccatcgtgggacgtggatgacgaaggaagcggttgccggtgatgagctccaacgtggcgtagacggtggaggatgcggtcgtcgacgacgagctccggcatggggcgtggatgacggaggacgcggccgccggcgacaagctctgacatggcgtggacggtggaggatgtggctgccagcaacgagctctagcgtgggacatggacggtgggatatctggtaggtatcgtctgatacctcgcaagtatcacattctacgtggtaagaatcgcatgatatctgataggtatcatctgatacctcacaaatatcacctgatacgtggtagaatcacatgatacctgataagtatcacctgatacctgataggtaccatctgatacctcgcaagtatcatctgatacgtggtagaatcgcatgatacctgataggtatcacctgataccggttaggtatcaggatctgatacctcacaagtatcatctgatacgtggtagaatcgcatgatacctggtaggtatcacctgataccggttaggtattaggacatgatacctcgtaagtatcaccctctatgtgataagaatcgcatgatacatgatagatatcatctgatacttctcaagtatcacctgatacgtatgtgatagaaacgcatgatacaggttatgtatcaagacctgatacctaaccggtatcatcccgttcgaaaacgagattccgttatatagcagcccccgcttgaaaactaacccctcttaggacaaaaacacattgtttgaacatattttaagtcacaatatttttaacatatgaattgcatgtatgaaaaatcatatattttgatttgttggatatttagttatcttttatgaaaaaaaagcttcaattgaagactatatcgatgttgaaacgatattttttccaccaaaagtgagtactatttaggtgtccttggaagtaaatttagaggttttatttttttaagataaaggaaactttcttgatggatgtaaacaattataataaagtgatacaattaatctaagatcactcttggcaccagcatagtaggttgtccacaacctataattattttttagaaagaagaacgacatgataacaaatatcatgccatagtgagctacaaccacaagctttatactctatacacgcatcacttagaaaaccttaaaaacaacacctccaaaataaaaattgcattgtcattgccatgatccgatcaacaaaacccaaatcataggttttcatactagagaccaaattcttcgaattctagacaatgccttcaaccagctaatgccatatgtagggaggaaccgattttcgatgagcacagcctgaccgaagttccacattcatattgtcctctcatttcttgttttgtttgagaaattatcttattcttgtgaaaaatctataaaacttctacctatattaagggaaaaaaatcatgccttaccagtctacctaccaattagtaccaatttaagcaatacagtaatatatcgtcggagagtggattttgaactctcgagtgaatgacccatcgttgtttacatgtcactcaaatggttatgaaatttttttgagaagatgtattaacatgtgatatattactccacaaacatgcaagttaaatcaacttttataagttgtaaaaaaacaaactacagataattaaagtatattcatagtcaaatttattttttcgttacgatatgtagaagttaaatttgactttgtatgtttgtgaagtgatatatcacatattaatatattttctcaaattttttcataaccatttgagtaacatacaaacaacaaggagacatcccctcgagagtttaaaatagtttccccgtattacccagtttggaggaaaccagaaatattttaggccatagccatgatacaaggtgaaacggttttatttcagaatctggttacaagagacttgaatttcctttactacaacggaactaaattcaacacgaataaatctacagacaatttaatgaaacaatcaataactttccgacaccttgtaatcacatcaacccctgagcccaacgtccatcagcatgagcaactttattctccttaatatcgtgtgttgcagtctcagttaatcgctcgtctgaggtgatgagcagccgcagaggagctgccagatgctcttcttgacgttgttacgcttggacttccccattcttgctccaggaatatccgagctgcacaagctctaatgctccaaatgaaatgctcctgtaaacaaaggaaccaattgaaaatctcctacaaaattacgcgaagatgaaagaaatatacacagctaaatagcaaaaaggaaccagcagagtaaaaatagaatgctattgtaacctccagttaacttcttcaggaatcaggggatgtcaagcttggtgcatttggtgaatgagagaagctactcctatttataagtgttgcaagactgaactgtacactgcataccttggcttctgaatattgtcggactttgcaagtaaaagttcgcgagaatccacaagaatattcaatgaagaaggactgaatgagtccagaacttgaattctgtccacttgcacaaacttaattcggtggtatttgcccgggattagcttattcaacccttgtttaattgcacctcacctctgcttgttagagacaagtagaggtgaggtgcttgttagaacgagaaatactcaggggtctttcggctagctccacaagatggtgggctagacgacctgggttcaaaacctaaccccttctaattatttgatattaggtccttccctaatttttgagttttttttttttctgcttgttagaacgagtcctagacgtcccaaactgctttaatcactatattagatgcaagcgattagaatgcgcgtaattaatcggattaagtgaatggtttggaacttcatcgatctatgccatgtaaaaagaaaagcattgcgtattccctgggttgcttctactgttacataaagtgtgctgttcgtcgtcctgttgattgaatctttcatctaagaagaattcagacacagccacgggttgcgaaatggcccggatagactctgatgatttgatgggctgcgcgggcccaaaaccatgaaggtcgccatcccttgggcctagtggtagggctttgtctcgcgcggcccagctcgtcggtcgctgttggtctgctacgccaccgatcaaagaagttcacaagcacagttggtttgcagtagcgtactctcgatctgttctaaaataaacaaatctattactcttaatattataaataatatataatatatcttaatactataaatctgttctatcaaatattatgtttttgtttattttaatatgaagaaaagtaggaaactaggaatgtacgtaggggcttttcaactgaagttgaccgaagcatatgtgcataataatttgttgggattattgtattgagaggcattgagcgtttccatccagggcctatagctgtgaagaagaataaaatttgagcatacgattccgctcccgttttgtaaaccgccaacatgcccatggttttggacctttttttgtgccaaccttgcaatcttcaactacaaataaacttggatggaccagttctcaatacgaatgaacaaaacatagtactagtaaattacggcctgtttatagttccctaacaaaaattttgcaccctattgcattgagcgtttgaacacctttataaagtattaaatatagaaaaaaaattaattatacagattgcgactaatttgcgagacgaatcttttaagtctaatcgctccatgatttgataatgtagtgctacagtaaacatttactaataatatattaattagggttaataaattcatctcgctatttactgacggattctgtaattcgtttttttattagtgcttgaacactacatgtgacaccctatataatacccgatgtgacatgctaaaactttacacctctcatctaaacaccccctacagctgctaggcaagtgaaatatctctatgttctggaaccgtacttgtttccatgtcattggccaggaaaacaagaaactgcgtcagaattgagacctggaaacattattggctcctaattaacgcaattgacactgggccacagatcaaagccatacttgtactgagcttggacgaaaatattcttcgtctttccagatgattaaagagccttctggagagagaagcaccatcatggctgcctatctggcgaacggccgatcggccatgtaaaggagaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacgtatgtaggggcattgcattttttttttcttttgccttttcagtttcttctcttgttcagcaaattctggttcagaaaagattgacaggttttgcatctgatttaccgttggtttttgactttgtgtagctttgattcctctgctggagtttatggagatgaacgtgcaggcgaggtatgggatcaaccccgataaggaggtactggagatcctgcaagctgaatccaagtccaagcaggtaatgattctgcagccttctctgaattcttcatgaattacctgtgatgggactgtaaaaactagaagggaaggttgattcaaatgtaatcaaactaaaaagaaacgttgatccaaatgtaattcaaagcaaaacactgattccatattggctggatcaggttgaagtactggcaaaagtttactggggtgatgcaagggagaaactctgtgaggcagtagacgatctcaaggtgaatacctttgttcttggttgcaggggactaggacccttgaaaaggttagcatttaaacctttttcattctttgatctaaacctcttctcagttaaattgcgtgtgaatcaatggtttttacctcaatgcagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaaccaaataaatccatactaggcttagggacttttaagcaatatcaatatgaataaagaagttctaacaagaaaaagatcactcagatattttaataggcaatgccactttaccagtttatctacatacatattcaaagaataggcaatataatcatgatctttcctcagaatagggaaaaaatgaccatgctaattgtatgatgcagacatatactgcaggatgcattacttgattggacctttagcccctttaataactacttgagtatggatatcaagtatcagtataacaccaaaatataaaaagttcctttgctacacatggcccgatggaattatgaaaataataataaaagcaataatagcacatcatcgaaaagagcataccacactgccaatttttccatattcttcttttgaaacaagatcaatatgcgctcccaccaatctctcaacaaggagattcccaaccaaaccagggtccttatccacaagaagctgaatgtgaacatgccccaccaaaactaggttagcccaaatatgctaccacacgatatcatatcaatttaatgatttaataacctcataagtcataagtacaaagatcaccttggatgtgcgcagtatcagataacaatcaagatttatatactttgcagccactgcggtggcacggcagtgattgctctggatgccacctacagttataacgcagtcagcgccctgcgcgacggcatctgccatcaggaactcgagcttccggaccttgttcccgctcaactgcatgcctgagatgtcgtctcacaacaatttcccccaaactctcgtgtcagaagccaaactccataaacaaactactctaccctgaatcatatatctattcattgatagagtaaatggaacatattccctgaatcatatcaattcttttcttctttctttttttgcggggctgaatcatatctattcattgatacagcaaactgttgcttatctctaaccttgatccacacctccgtgccattcggcaaattgggcagattccacttgtggatcggcgtcgggaactgtttcaattagaaattaaaccgtgagtttcccggaatcgatcctcctaatcaattcaaaactacttcgaatcgaatccaccgataagaacaagtgcggccgttaggatcaacgatcaagcggtggacttagggaaacaaactcacatggccgagcgagaaggtctgcgagggggcgggggacaggtgcgaggcccaggacggcggcgcgtacggcctcttggagaggaagctcccgatcttcccggcggcggaggcggcggaaactccggccatccacgcggcggcggcggcggcggcgtggaggggaatggggagagagtggggcagcgagcagcgcgtcggggcagcagctacagtccaaaacccacctggtgcctggtgggccccacgcgccatctactgagcagcgggcccctcctcacgtgccccgtgtcagtgagagaaaaggagacgtcgttttgactctttgcccccgtgtccactcgctttctctcctcctggtccttggcgtggaagccacaagaggaagggattaaaaatcaaaaagaaaagaaaaaggaaaggagaagtggaaaaaaaaatagttcgctatctcgctccagtgtccaaatcgcgcacaagttctgaaagcgattgtggttggccgctgttgatcggtgcaatctcccgacgtctcgaggaggaagaagaagaacacgtcgggttagttcgatttctcttcatttttttgttcatttttttctgcgcttttccgcggcgatgtggtagagtgggggagtaggggtttgatgcttccagaggagtcggagaggcgatttttatgggatttttttttgttggcggcggtgcgtgccctcgcgttcagccagggtagccacctcccgccgccgtctgtcttccctgaggtcgccgcctcgttgcttcgagtcctactttgatttggaagccgatgagttcgtggttttcctggaagtaattgaattgttttttttgtatgcgaatctgggtgttagatttggtgaagtgcaatgttttgctggtgtttggtgattttgatgataagatagatgattccactgaagcaatgggggtgtagcaaatgagtggcggcggcgaggatgaatgaaccaatgtttttcccttgattagatgactccaccgccaacctagtgtagcttgctcgctgcagccaggtgccgccattgctcaagctgcttaaggagggcactgacgatgccctggaggctaccacacgcctgccctggctgcttggcttcaatcttcaagggtcaatcgaacctccatcagaggagaacggtagattcagattgaggaagagcacactatttcagtggtattttgagagaaccaaaggctttctattggtatatatcacaatgtgcaagttcaagtgatatatacccctttttatattaaactatttattagttattttctctcttcgttcatctcatacattggagtattggacacaactagtcttaaagttgttgcagctgtatttgctgtctttattggtttgcacttcttagttccaattcagcagtccgtattcagtaatgctataggtttcccttctataacaagtgcaaaatgtctttatctcatttcaggttctctgttctttgggggactcctacagatgtaattggttctgtaagttggggacctaatcaggtgaacacttgattgtgataggcttgtcaccattgttagatatgcagcaggttactgacacaacaggggctgattttgtttggccaatctacatgtggattctctaccgcagagtgtattttcatgctgtatcattctagtggccattataggttaataactttatatttctatctaaggtggttgtttcaaacactggcattcagtaatgtgtttttacattcctgaaaatgttctgaaaattttcgttattgttatgctgacattgtgctacaaatataattccaacatgagtattgatattgattggagtcgttactctctgaagatagataatgttcttttatacaaaagtatgcaaactttcttgcttgtgtcattgaacttgattttctattacaatggatgttgatttcagggttaagaaatgtctgaccaggagagagatgatattcctatgctactaagaaatgttgagctaccaacgtttcctcctagaagtacatcaatgtgcataccagttagggatgatgaatacgaagaagacacatttgtaccccatactggtcctctgtttgttcagccaccaacacaaactgcagcagcgggcattccatttacaaatacaccagatatgcctcctcgacctccacaaggaaaacaagtcaacaagccacatgcgataatgccagaagaaattggaggaaacaggtggtcttatagtgggaatgttccaaagaatgaacatttgatgatgtctggacctttgggacaatgtgacgatcctgattgtgtcaactgccctcctgcttgtaaaaacaaaaggcattttcacagaggatcaagtacattggacagtaaggtggtcttacttccctctttttgtaggaatgcacaaaacattaaaactatatgattttatctgaacctgatagaagtggttagattgcgcaacatttttctagtaaaatagcatagtattgatacatccttcacaatcatcataagtgatctggattcgagaagcctagtacttctgaattataaagtagagaccccaagtctaaaagaaacataaaagataaaaggcaaaaaaaaaaaaccagagtatagaatgcacctctacatagatgagaggtaatattagttgatatttatcttcttcttatataaaaatctcctagtaagcaatcaacatttggctacagataactcaattttaagcatcaaaatttctatttcaatcttcaatggaaaataacagccaatattgctggaggtagcgctgtagcggaagtaccccgctattgttattgcggctgcaattgtggccattgtgaatgctatttagtaccttggttcttagttttttttttgtctagttagatttcttcaacataatgatcaaagcacttcttaagagcgcttaaagttactgactgtggtattgttgtattgaataatctaatctgttttcttttgctctcttgaagttccataattttctttgtgagcatggtggtggatggaagaaggaaattgagcgtttcctttcacgcattccagttatgaacccacatgcaaaagttgttcagcaatggaatcagttctttgtgatatcatgcctggttgccatattcattgacccactatttttcttcctattatcagttcaaaaggtaactagttcacttgaagatgctagttcatatccatctgtcaaaagcctacaactttcttgtacacttcatttgttgttgcaccttgtttgtgagtttgtgagctaatcttgtgtaatttttcttactcctgttgcagcattctattctcctatcggttaactgttctaagtgttgatatcttgtgtaatggattgaaagggtcaaataagcctaaaaggggaggggggaaggaataggcgattaaaacttttaagtagatgcagaagcagtgcttttcggaaattccgaaaatctcagatactccgaagatcaaagctgacctgcacttacttttgttccctttttttttatgcaggataacaagtgcattgtgttgaactggcattttgctacagcacttgcagttgtgagaagcgtgactgatgctatttattttctacacatgcttcttcaggtcagtacatcattgcttttgctattctatagaaggttctataattcatgttccatgatagggtatggttccacattttataaaattctttcataaataacatggtcactaaggcatcagatggaaggcagtttgattatattttggttctttggtatgcatattaggacaagtatatttgttgagtgatcagtagttttcttctaaaaatgccaaattagatactggttttttgtgagtataacttgcactttttatctgttgacaatatgtgagaaaaggctcagccgctcaggttcaatattcttgtgtcctggtatcatgttttagtaactaacagtaatgcattgtttgatcttcagcggatgatttatcatatctccatgatcaaatagttgtgatatctttttaccctttgtttgttaattgtaatggtttgtcatgctttgactccattctggtatcatgttttagtttgatttatcatatcttgtattttattttattttgcatctatttgttcctgtccagttttaaccccaagaaaacatattatcaacttttgaccgttttattttttgcatttctctttcagttcagactggcttatgtagctccagaatcgcgagtagtgggagctggagatttagtagacgagccaaagaaaattgctgtccgttatcttcgtggatattttttactcgacttcttcgttgtgcttccactccctcaggtaacttgttttatccttctgagttgatgtggctaaattttgacattaagcttcatttttcttctttatccctgatggatgacttattatctaggctgaagttttcctttatcattctatttatatttttatattgctttggtactcctcttcaagtcggtagcagaaggcaaacttgttcttagggttatgataattattttttagggtaggtcaaacaaataaaagagttagctactgggaacgcactatacatcctggagagtatgttggagacctggcacaagcagcataggagttaggaggtcccagctatccatccagctgttgaaaattgcttttcttgtttgcttggcttattactttgcatctgccatggctttgtggaccggtggccacaactgaatgcttgcgattggcaagtgctagtgatccatgttcatctttttcatgcacacagcaaattcattgccctatgtagctagtgttatggacctatcatgaacagatcaagagcatttctttcagttctcttcacgtgcacaatagaccacattatccttttaagctataaacttgtgatctccactattgatgtactttaaaatacataagcttcatctaaggagtattggttcaagtccccgttgaaaatatatgctattgaacctttcaggtttattttggtagtttcttgttggtctcagagtatttgccaatgtatttaagccaactagaaattgacaagaagtcaaaaagaagttgctgtttagcattgaaaatactatggatcttgggcatgataatgactaattgattattccatacttgtgaccttagcagattgaggatgagtctcatgaaattgatcatgcagaggaacaccttagctaggctggcaattctttgttactttctgttctgtttgccatcaatattgtcagtatgagcatcatttgatctgattgcactgatgccctttatctatttattgccccagttgcttatgtaaatcagaattgcatttttttctaaccctattaataaaggatattcatcgaaacaatttacacctttttatatcttattggctaatactttttttttgtcttctgttccttgataaaggtgatgatattgctggtcatccctaaatatgttgggttatcaactgcaaactatgctaagaatttactgcgtatcactgttcttcttcagtatgttccccgcatcatcagatttgtaccattgcttggtggtcagtctgactcatctgccaatggattcatattcgagtcagcgtgggctaactttgtgattaaccttctaatgtttgttttggcgggacatgttgttggttcatgttggtacctatttggattgcaggttagttcagcttctatttcagttttctgcacaaaaatattgtgtttattcatgttgaaccagtagtttttcatctggggaaattgatagtgtcacttaaatgttgaaatagggaaaccactcaaatcaacctttgcatccactcaaatattgaaacttaccagtatgccctccctttgtcttcttatttctccattctcctttaccccctcacaaagagcagcagtacgactgttccctctccctcatcattgttgccacctgctcaagcttcatcgtcatcacacacattgcaatggttgacttgtagtgctatctcaacctgctcaagcttcatcgtcatcactcgcctggatttttcacattttggtccttttgaaaaacttatttcgcaaatagacccctgaaaaaacttatcccagaaatggtcctttttggggcgtcagagtggctggcgccgtcatccaacgggacggcgccagcctctctggcgccgtcctcctgccaccgtggcacacgcgaaccgacgtggcaggagcgcccgagggaggggggcgccacacccccccccccacccctcacctccattcctatttctctgtatggagttgcaacggtgtcaattttgttttattttttcggatgttttttcacacttaggatcacgatacaaccaaatttaaactcgaactaccacttagctaagtctgaaaatagctagcataccacttagtctactttgcaccttcactaaaattagaccatagctcatttagtaaaaccctttgatcagcatgttatacataatgcactctatcactatatgaaattacttaatctaattcaaaatataaccacatgaaatgatagccataagttaaacagtacagagagatgcaattttttaatttttatttcatttttttgatatttttttcacacttaggagaacataggaaccaaccatataaaaaataaactcaaacggacaaaatgtgacttgtagaattttccaaaactctaccgaaacggacaaaatgtcatttattaaaataggcgtaattttctcatacggactcggaatcaggcaaataatatatccatggacatctacagaaaatgttacatccgattctccccagcttcgccgggttcggcgatattaaaacctccaaattccgcttgcaagattgtgttttcgaggagagaagtttctcggtagagctttggaaaattccataggccacatattttgtccatttgagttcattttttatatggttggttcttgtgagttcctaagtgtgaaaaaaatatcagaaaaataaaataaaaataaaaaagttgcacatctctctcctctgcactagttcggagagagaggagaggagaggaaaaattctacaggtcacatattacgtccatttgagttcattttttctatggtgggttcttatgtgtccctaagcgtgaaaaaaaaatatcaaaaaaataaaagaaaaataaaaaaattgggggggggggggggcgccagccactctggcgcgctccccctagctacctcagcatcgccccgccacgtcggcagggggacggcgccagccactctggcgccccaagaaggaccatttctgggataagtttttccaagggtctatttgcgaaataagtttttcaaaaggaccaaaatctgaaaaattcacctcgctactgttgtggccagccatgtcagaggtctcagaattggttgcagactagaggggttttataactcaatggctgatggagcctgtcagagtctaggccaccagaggtggagagcaattgtttggaaactgttggatttttgggatgaagagaaatggtgatagacagtggggtaggcatgcttttcttttcatatggctcgtaatcggcaaagaacaaggaattaaattaagaaatgcattttatggatgcaacactgactcgagtggcattttacaaattccaacaaattgaatgtcatattattaattgtttccttatatttggagaactatgccatgacaatgtgtgctttattattgctttattattgatacggagaaaacatatcttctgtttaatttgttgttttcatttagattgcattttattgtatacatgctgatttccttgtgtttttcgccgggccggcgtaagatacgcggccaaagtttattaagattgagaagaggttcaaactagtacaacagatacagctgccatggaggctaagagctgtacaacctctattgttacaacgatgcacatttgatttccttgtgttaaaaggggtgattgtaaattgctatattcacctgctccttttaagttgttcacgactcctttggtatttttaatagaggacttgatcatatcaagctactcaggagatgttaactaaagtagaggttcatgatgttattattccttttattttcatttgacagagggtcaaccaatgcctacggaatgcttgttctgcatcaaaaattccatcttgtgatggttttatagattgtggacgtggcattaatattgggaagcagaatcaactaagcagacagcagtggtttaatgattcagcctcaacagcttgtttcgacactggagacaacggtttccactatgggatttatgaacaggctgttttgctaactacagaggacaatgctgttaaacgttatatatattcattattttggggtttccaggtatttgacttttgttccttatattcttgtacttaagttgtgtctcatttgttccatttgatgtataaggtttctatacgtgattacagcatccatgctaacactgtacaattttgactaccctttactgatgttattttggtttgacgtcagcaaataagtacgctagctggtaatcttgtcccaagttattttgcatgggaagtcctgtttactatggctattattggtttggggctgttgcttttcgcattacttattgggaacatgcaaaattttctccaagctcttggaagacggtacgtggttatacatgcaaaatttgctagtgtttattgtgcaatattgtctaccttacaatcctgagatggacctctaattgttgtgttaatacacatcaggaattgacacctctatatagatataagctgtaccagctaacagaaaaaatatctagtcctgattctctcttcttctttttttggataggagactagaaatgcaacttaggaggcgtgatgttgaacagtggatgagccatagacgcctgccagaagatttaagaaggttcatctacataacttctaaacaaaattttactaatcttttctttaaaaaataacatcatatattccttaatcttgttgcaaatcgcaaccatttattaattcagactattaatatgttgttgttttttttgctttgtcttactttttattgtttatgtggctcctattattcagaagaagaaaaacgtgtacatattcaacagttatcaggctgcttttcttgataaatcatcttataagtggaatctcatgcaagctatgatctgtgttacagatctcattttgttttgtgggtaaaacgaatgcatgatatattttgaggaaacagatttagtggaaacatcatttgtttgatattgaaatttgtcaatttagttaccaagtttccatatgcagaagatgcacaacagtctcatggcaatgtcaatgagatacctgaattttggtttgctacattcttttaggatcattatttcgaactagtttatttgtgcggaaatcaatttttaactcgcccaaaagggtgcaattttatcttttctttgacaccaaggattgatattgagtatttgccactctaaatgtgcaactaaccaacaatcgctactcagtgtattctgtcgtctttaagaaaaatgagtgtcagtttgtgaaatgttcgaaataggcttttcctctttgcattctcttcttcatctccacaatcttaatcataccagaagttaaagatttgttggagagggagggaatggtaaatctggagtattcctataatgggcaaagaacacaaacttccccaggcagaacatgaacttttacatttgttggagttggcaagcaaatgatttcctctttatttttggactggaagattgtaatacttaatagttttatgaatgtccaggagggttagacgcgcagaaaggttcacctgggcagctacccaaggggtgaatgaagaggagcttttaagtaatttaccagaagatattcaaagggacatacgccgtcatttctttagatttcttaacaaggtttgtttatatgaggactctgactgttctgggagagcaagcactgcaactagttactctatcacatttttactttccatgctcatgatgcatttaaaatttgaggttgctgatgatttacccctacaattttcaaggaaatgctgactacaattattttgcaggtccgattattcacattgatggattggcctatcttggacgctatatgtgacaaactaagacaaaacttgtatattagcggaagtgacatcctttatcaaggtggtccagttgaaaaaatggtcttcatagtgaggggaaagctagaaagcatcagtgcagatggaagcaaagctccgttacatgaaggtgatgtatgtggagaggagctcctgacatggtacttggaacactcttcagctaacagaggtctgcagtttttgcattttgtgtttttattgttttctcttttctgtgatttatatttggtaagtctccatatttctattgtttcagatggtgggagaatgagattccatggtatgcgtttggttgctattcgtactgtaagatgtttaacaaatgttgaagcttttgtactaagggcaagcgatctcgaagaagtaacttcacaattttcacgattcttgcgcaatccacgagtgcagggtgcaatcaggtggagacttttttctttagtgtcacatgatcatatatgctcaccagaataattctctgattcaactagaattgtgtaggcttatgaatggtttatctgttgatttaaattaattttaccataagttagttgggaaaaaactaagggagttcatcatgcatcacagtaattgttattagctgggatatttgggataattagaaactactacggtactctgctccatgcaggtcatgcattcagttgtgtcagttgccgaatatctatcttctatgatatgtatgacaatgttcactaatgctggtgcgctactgttgcaactgcatccaacaggtatgagtcaccctactggagaaccattgctgcaacgcgtattcaagtcgcatggaggtatcggaataggcgattgaagcgagctgggatgtcgaagttgaacgatcaatcttataattctgcattggaacgtggcgcgcgtgaatgtgatgctcgtcagcatgggcgggtatgatttggatcgacaaggtgctaacgtttggtcacatttttatgcgctagagccctgacatccttgtggctatcttacttggcagaatgtattctatgtgagctacataattttttttttgccccacaattagatctggtagctagagtaccaaactggaggaactacatctcatgtatataatgacggctagtttttcactaataactgtttcattcttggcctgaaatcttgcctgcgtatctgctaagcaattgtgttagtttgttggttgcctgcaactggatcagggctcggcaagctgttgcgttaaagacgcttgtctcatggataagctctcgtcgcggcggggtgggaggccgtcggttcgccgttcccgtcgtcggtggagcagattaacggtacgatatgccctgctgcacactgatcgtagggtcatttttagttttgcttccctaccaaaattgtgcatttgcttttctctttctttttttttcacgcgtacgtttggcttttgaaacgacctcaaaccgctgtgttctggggtaaggattaggaaccaattagtgcacgattaattaagtattaacttaaaaaaactttaaaaataagttagtatgattttttaaaacatttcttctatagaatgtttatataaaaaatatataccgttttagcagtttggggaagcttgcccgcgaaaaagaagagccgaagacagcctaaactcatccgagcacaactctctcaataaaaaaaggaaaaagaaacagtaaaaagtgtgcaagcaaacgggccggggacggatgctgcggttgggcctgcctgggagcccgaagtttcttcttcaacgacaccagacgccgggggtcccgctcacactgtcgcttggctcgccgcatctcttccctcctcgcaatcacaagccgagcgggcgggcgcgcggcggagaaaaaaagccgctggcgctgcagctactcacgcgcagccaacaactccaccttgccgtgcattgtactcgtcccaagcaaacagcccgtgctgctctatcagcgcctccaaatttctggttcaggatcgagagatcgccccgccgagcctggcgaacttgaggtacccctggtgtcgcggtgaccacacgccgaaccggttgtaaaccatgattctgcacgcgtacatggtgtcccgtgtacatgtcccgcttcatctccaacacccttctccctttacgcaacgtgccgcacgggcgcgggcactgcccaacgggagctgaaggggcggatccaaagtagaagggctggtatcaggtgacaccgatgactttcgacaaaacatatagcgaaattgtttatccatatgttataacactataatctaagcataattagcatcctatgataccgatagacacgttatgacaccaacgaaacgattctctgaatccaccaccggagcttccagtaactgtgtcgcctccatatatatgctcacattaaggtggtgtttgaatctacttaagatgaagatgaacataaatattaattgtttcacgcaaaacgatgtggtaataacatatgattaattgaattttaattattacaaacttaaaaaatggattaatttcatgttttagaacaactttcgtatagaaagttttcgcacgaaacgaaccgtttagcagtttaaaaagtatatcacttttatcaaaaagtttatctagtttttattggaaaaaagaacagggccttacagttaagcttggtgtggctctcgtgtatgtatatttcctccatccaaaatataagatactttgattaatgtgatatatcatagtacgtattatatgttggaacgaatggagtatacgggaactaggataaagtttgtattggatcggaggtaggaacgttttggaaacgcggataaagtttgtattggatcggaggtaggaacgttttggaaacgctaacgtattcgtattcaactattcaaggtatagtcatgaattgatgcatgcgcggcaaacccttcatgtatagtactagctaaatacccatacattgcaaggaggttgaatatattcttttgttctttttcatagcttgggaatgaatattctgcgtgcttcactgtttattagtggcatcgacatgtcagctgatagtggaagtaagtgatgacagattcatcaatttctagtccccacatgtcagttgtgcgtggtgacgaattcacccctcaccactacgactagagttttaggagtataatatgcaactggtcgtattcagacggttgtatatacacaatgccatgccattaagcaacgggtcgcgcatggtacatctctaactagctccctcgcatacggatttttcactagctgcatattttcccttctattaatctcgtagcgacagagactagactggatgaactaaatcagatactaccttcttttcaaaatgtatgatacattgactttgcatacaacgtttaaccatttgtctcattaaaaaatttaatataagtatgtaaaagtataagttaagattatgttttatttgatgataaaataagttacaacaaaataaataatatttatatatatttttaatcagatgaatggtcaaacgttatgtgaaaaatcaataatatcatatattttgaaataaaggagtactgtattttcatgaaccactgtttcattcttggcttgaagcattgcctgcatccctgctcgcctacatgctggtagctgtgcaaactggtgaccctgcacctcagcacctggatcaggttagagatgcttgtccgttgctacacaagttactcagcttgtgagataacagtgtataccctattgcacgctagcactagtgcattttttttctcagcattgcagctctcaattaacaacaagggtcatgattcatggacacccgaaaagcaaccaaaaaccctactaattttcacaaaaagaacatcactatcgagtcacaactcacaacagctcatcaactgatgataccactaaacagttaggctgagcaatcacagattcacagtttgctggattggaatacgtatgtagtaacaatctttctacttgtcgcggtgatcgtagacatggccgtcgccggcggcggcggcgcggagcacgacgtggcgaatgttgtgtgcacgaactcctcccagccgagccacgatcgatccctccaccgccggatcgaagctcgccgagaacacgccgtacgggacgccgaggaggaggccgaagagcaggaacgccacccagagcggaggctgcaggtcgagtccggtcaccgcggccgccgcgcgcagcgccgcctcgccggcacccgcgccgcgccgtccaccgccacagcacctcctcctccgactcgaggaacgcgagctccccgtcgcgctcccgccgcccgacccacgcctcgtcgctgatcgacgcgtccgccaccagcagcgtcccgaccaggaacgacgcgtgtccgcgtcgatgagtgcccgcaggaactcgccctcctcgccgccgaacacggtcgcctcatcggcgacgccggcgtcgacgaggttcttgaatgattaggcgggggctcaccgctcacaagtgcagcacgccacgggtcaccagacgtgcacgatcttaattaggagtaccatgtaagtatgtttgtcatgttcttcggtccagttgattaacacttagagtcgtgtggtgatgttaagatagtatccgaaatgacctatgggaaagaggaattttacgaacattttagaaacgaactaactcgtgtgaagatttttgtaacgtttcagcgttccaaaggagccctcagctgcgagttgaatgttcttttagcataaaacggtcatgtacaactacaatctctattaatctgaatatatatatctgactacaagtcttaaaccactttactgagtatttcatggtttaatcgaacaaagtgctgtgaaatcgagttaattagtcagtgtcttcatcttctacttcttcctcatcttcgtcttcctcctcctcgtcctcgtcgtcgtccacttcgtcgtctatggaggaatgcttggccatggacagttcgctccagtggctagcggcgagctcccaccccaccagcgagcccctctccgcggcgttccacctcgacgacaggaacccgtagtggaaaccgagcagccccacggcgaacagcacggcggagcccgcggagccggcccaggccggcgccgcgtcgctcgccgcgccgtcaagcaccctcaggaacgcggcctccgccgcgaccgccgccgcgggtggcgccagcatccgccacatcatcccgcgcctcatgtcctccgacaggttgagcccgagcccgagcccgcccgccgcgcgccattcttggcggttcttggcgacgtcccccctcgccgccgccgcagcggtggtgtcgatgacctcgacgttgctggagcttgccaccgccgccggccgggcggtgaacacgccggcgacgcgtcgccggctcggttggtgaagcgggcgtgtggcggcgcctcgagaagggaggagcagcaactccatggccgcggcaggtgaggtccggtggtgcgagtgagtgagtgagaccgtacgtacgtttgtgaagacgagaaatgcgttatcctatcctaaaaggacctttctgggatagcaatgtggagatatttttttgcttagctttgcagtgacctaaccatgtgtcagttggcttggtcactgggtgagcttcacagtcaggccttctttgactttgaaacaaagtattgtgcctataagaaaatttcctgtttggctctttaaaacagatatttgaagcttttgaaatcctataaaagtcatttggaatggttcatgtagacttctagagaaattttctttcagtctttctctctcatctaactctatttttatttgcatcgtctgtccatctatttaaaagaccgtttctatgtttcttatgtgtttttagtattttattgtgtattattcctactaaaatcccttattttaccatttctatgttccataggggtctcaattttatttcatcaagttgaattgtcatttgaacaagtagtacacacaatggcaagctcaaaaaaaaattaaatgaatgatttactggatgttgcctcacaatcataacaatctaatgatgctttcctgaaaattttggagtcaagacaaatctatctctactacgtttgctataaaatgttacactttcaatctctaaattaatgctatatttttactgttcactcccagacgagcccagtcgacccaccagtgcctgaccatattgtcctatctagggattgacccttgaaatcaacggcacagataattcccctgcaaaatcgaacggatcagagtgcatttccttccattaagacataatcaccgattaatcacatgcatgaagctaagataataaggtaggttccccacactccaagtccattctgacacggtttttttgtcccaagcaacgatctcatgcactctctctggctagttgttccattgctgcctccagctagaagccatgcaagaagaggcaactgggcgatcgagctctactacagtggctagctagcttcccctccacatgcagctttgagatctgctagctcatccggatctcctctacgtgctaccatccaaaagcatctaacagacacatcatttttttgccctggccaattttttaaattttcttttttcttcttcttgatctcctgtgttcgttttgtgcctctcgtgatcatgcacaagctgccctacactgtgtctgtgtgtgtgagcgttaatgtgaagacggtttgtacgaatcctatgctatggcgagcgtgctttgatgagcctagaaacattggtagactagagcatgttgttagttactccctccctcccaaaataaatgcagccatggtttttcgtgcccaactttgaccgctcgtcttatttgaaaattttttgaaaaaaaaataagtcacgagtaaagtaccattcatgttgtatcatctcataacaataaaaatactaattataaaaaaatttcaaataagacggacaatcaaagttggacgcagaaacttatggctgcacttgtttcgggacggaggcagtagtagaagaggttatgatcaatgtactgtgagtacttaagtggctaagtactgccttgacactgacatccttcccctgtctgtcccggacaggcagccttgcgtcgcgtcaggctttatccggaatgttgcttccgctttccaggtgataattttgacgcaagtaattgctcgatcgatccgtgtggctgtagtacgtccatggatgtcggatcggagacgattgcacgacgcaaactaaatgcattctgacttcacgaattttttttgtggcttttttgcgtgtgggtgatcgatgaggaacagtgagatcaatgcggttgcattgcacccggcgagagtgcacaacggttttgcatggttttggatcctgggaatgcaaggggatcaatggaatctatcacgggaaattctggtcaagagcagatcatctgcagtgtgatcttccagttcttccacgaagacgccatggaatttgcaattcacagaaaacggaacatggaattcacattcatgattcaccaccaccaccacctgatatgcaccaccatcaccatagaacaaaagaatcttgcagttgaaccgatcgatcgatctcgcgtcgtctagcatggccgcacgaccggcggctcagccaccgccgccgccgccttgggcgccgcggcgacagcggcggcggcggtgttcttcctcggctcggtgcggccgagctggccggcgccgccgcggccgccggtgacgctccgcatccggcccttgccgaggtggtgctcgcagagggagtagccgaccagcgtcggctggctgcagcgccacccgcgcccgttcacgcgggtgcaacgtgacccctccatcagcaccgccgggccacgccgctttttggctccgccgccgccgccgccgtcgttcttggtctcttccttcgcgttcgcggccactggcattgcccggacgacgccgttgacgagacgctctcctgtagtactcctgatcgccggatcaggcttgctgtaatggccattctctaggctgcaaaatgcaagaacatcatcgagtcatctgtcaaccatctgacgaacaagcagctacagcaatgaatccaacccaatgcaatcagagatgcagcaacttatgatgccaaacacaagggaatagttcacgacgctcgcgacgcacatggtccatgtctgccgatcgatcagcatggcttgcacggttgcaccaatgcgatcatggaagaggacaagcaaaaaacaggctgtaagagaggcgatcacacaatcagccatagaacagccatggaagtggccgatcgaagatgccaagatcgagggtgcaagagcagtagtgcgctggatggattagcagtaaagaagccaagaacactagtagcagtagtacatgcctacatgagcagggccgtgtattaaattggttggattgatgtgtgtcatgtgtcaagctggcattgcccagtataaaacagtaaaaaccaagcccagaagatagaaaaagtcccttggatgctttccctttccatttattactaccccccactaccgctaccaccactactactgtcactcacacccacacaaatgacacaaatgacacaagttagcatagcagaggcactttcttgttttgttcctgttccagtttcagttgttcttcacatacctcctgtgaccatctgctgctccctgctgtgcaccaccacggggcctgatcttgctgcattccacaaccgcattgtcctggcaaaatggcatcaatccaagaacatgggggggggggggggttagttagatagatctgggcatccgccataaacgggtgtggtgcaacctatgatgatagtaactagtaacaagaatcattcataatggcaagtttcttgttttctctgtcgttggagcagattgggatcaaagggggtagtgtatacctgcgggaacaacggcaatgccgcggccgcgcgcatcgccgcgaacaagtcgtcgtcggcaagatccgcatttgggtgcaagtgcaaccgctccgacttcttctcctcctcatccaccttgtctaccgagagccagtaacgtccatggtttcttggtggaggctggggagcagtggatggatctgaggagggatgcagggaggagagagcctgcagggactgaggccgcctcctgatcctcatggatggatgagagagaaagagagagagaaggggagaaggaggagagagagagagagagagagagagagggagcaatggagatttggggagggtgcaaattaaaggaggggggctttggggtgttggttccttggttttggttggccttttatgcctcatggatggcatttatttatgggaaccagtaagcacaataggagtagattggtggtgcagtttttacactttgcatatttgcgcattgttgccttgattggcttttggccttttgggtttgggttggtttggctttggcctagtaggagatgagatgagatgggtgcacttatcaagactccagaggtggatggatggatggatggatggcgtgagtggtgggatgggtttgtttttgcatgcaatacgccatgtgcattagaactgttgtataggagatgggatggagaggcaggtgagatttgtctagtggacagtattgctatgcgtacaaatgaacaatacatgtgggggaaaaaagaaggtaggtgtacatttctagatctatggtttgtggttttcagttggcatgtcttcgtttgaggttccaaatgggggaggtaaagactgaaagaagacttgtgtgtgaattggtgtgatggatgtcttacaaataaatgtttgcataaaacaattttgtgcatgcgtttttatatccacatggttagccttaactcgtgtccgtatttacgtttaaaactgttcgttgattgtgagtttgattatcttccttaaataacactttatcctagcacacttattatgattatgagggtaactctagtattggttcgacatgtgtggtccatccaagcaaacaaattttcggttagatcgtggcagcgtgaaaattgatttgtgggacccacataaagtcaatctcaatcttacctacatttgccctccctcttgtgtgaccccacaaaaaatatttttaattggttacgatcacttctcttttgaagtcaattttattaatgatatactatagattctcataatatgcgcggttggaacttttggtgcaaggttcaatttcagtcttacattggagttactttgatgtgtatacacagttagtatattattttttgaaaagaaaatgttccataatagtccaatagccattaggatttaagagaaaccaaaacacgcaaagaaaaggatggcaatagcaacttttctctctcttttttttacactgatttctctctctctgtataaagggatcgaaaacatcgttttcaatgggattttttttactatctaatagtttgctaatgttattttcttttctttccaggtaggcggtttatcgcctaatcttgttagaggatcctggtgcatgaagcggggttgcccataatcgtggaattatccatgatgtggaataaatgatactcgcccccttctctgaaatacatgctattcaacacaacggtcgaactccactaacttctattttatgagttatttgtgatacacaacaaaattatgctatcacgaccatactcatttctataggaataacatcgtatatgatatttccatgtgtctaacctaaatattgaattcttgttttttttttaaaaaaaagtcaaatacaacgatgtattcataatcagagcatatagatctagaccactcacatcatgcaccagaaagtataaacacacaggcgtctacgaggcaggtcggcatggccttcagacatggaccatcagatggttcggttctgtgaatcgatatgcagctgatgggcaaccatctgatgggcatttgggacagaatgcgcacatctagatcctgggcgcacgtcctctgtcggcatgcatgtacaggctagtacaggcagcacataatgctccaaaaacccagctagctaaatggactcaccaacagcagactgctaattaatcagacaccacgtcgatcacatgcttgcaaggtagtactagcagtatacccatatatatagtccataccaaacaaaagcttcagtaaattatcggcattaattcattgtccaatcagccagaaaaaggtatgtttcgtcctcatgatccatgtataaacccaaataaaatgcgtatttaatttcataccatctatttaaagaggcgagaaattaaacgatgccatacgacaagggaaaggaccagcaagaatgccagatgcatggtccatgcaaaatcaaggtaaaacaccactagcagacaatagcctgctttctgatttatgtccccaaccaaagcgtaaacaacgtttgctacagactacagtgtagcaactagtacgttcacatcaactgcaagcatttttccccccaaaggcgaaaaaaaattcagacggcaaatgttgtttacgatagcaacttctgaggcttctacctgaatttgcaactcgtctagtagcaatgtgcagaagcgcattctgaagcttctacctgaatctgtgactcgtctagcagcaatgtgcagaagctcatatagtcatattgctacagcctacaggcctaaattggaatatgaattaatgatgagctgtttaacagggggtacttctcaatattcaagagagataacagctgagttgaaaccagaacagaaccatgcagcaaaatagtacctatgcaggatctcatcaaagttgaaactgctatcatattcaggtataacagctgccgtacttgcatctgacagatttaaccgaaacttcagtagtactgaaaaatctgttgtacaatcatattacctgacaaacttacttacaaagaacttaagtacgaatatacacagaacgaaacaccaatcattcaggattcaagagattgaggtgtcaatacaactatttctctatactttaatatatccaagaagaactcaaatgatactacatcaccatgctaagaatgtaaaaggtagtggtcagataacaaaaatggcagggattcttggaagaggatcctatatataccatctcatgtatgctatattgttgttctctgtttctgattaattctagctagacatgaactttacatcataaaatcctatgagcctatacagaatacgtgttggtcgtatatcgactgtcagactgtgactaactgactacttctctctatgaaaggataccaaaatccttaacctcactcatacaaacaacagctcatgtacaggaacaagtaattcaacacacttgcctttattggtgcaacatttgatgctgtttaaccataatctgtgcgtagagaagctcattccaggagtcgggtactccagggaggcaccagtggctgcagtcctgatatatctgaggcgatttcttctcctcctcagtcaacttctgcttgcggtagacagaagggtgtgcctccttcctgtagtcagtcatccttgtgatattcaggtaaacaacaggtgttttcatcccactgagcacgtcctccaggatgctcatcttccgtgggtatggtgtgaggaacttctcatttgttattggctcggtttccttgtcgcaactgcctcctgaattccattggcccccactgcacaatcgaaacacacaataaacatgatgtcagcagctactccgataacatgatattgcacatgatcaaactaaacttgccagaattcagaaaaggttttgccaacctgaaatgggatgatgagtagcctctgaagaacacagttgttttcttgggatttacactggaatcaacccacttggcccaggtaataagagctttctggaaggcatcatcaacattcagctcactgtatacacggttaccctcttggtagtaatctttcctgtgacaggttcaacatactaacagtggtaagcaacacttgaaatgcagaacgcatggcatgcagatcttcagcaaaatcagaaagcaccaattccaacttaccctagagaagttttttcatgagtccaccagtgcccggtattgaagatgatgatatccgcatccttgtacctcgggaaagagttgctgatcatgtcaagcctaagagtttccttggttaaacccttcctgacggggaactcccattcctgaacaaggaaaggggagcggaagaactccacgctgcagttgtagtcctagacaacaggaaatttgcaaatgagcattcattccttatgctgaaattagcgcagatgcaaagcatgagacatgattgaaatgcacaatatacctgaaacaagaaagaataggagccctcggctctgaattgttgcctgcctgacacctcaaagacctttctcttgtccttgacagaattcctcaagatgcaaaccagggattcccacatgttcctgttgagcgaatcaccgacaaacaccagcctcttccccctcagcctctccaacatgtcactcgggttcaatctgttatgaacatcatggaactgaattttcagctgtgtcacatgaaacaccaagaactgaataaaacagagttgctcaagtagtctcaactcaccttggaatgctgcatccgctgggctgccaccggagcctctggtaagcattatcagggcggccattgagcgggcagttgaaggactcatcgatgtgaggacatgatccctcgggatagagagggtatgagtcatctcggacccaatttccatagaacatatcgcagctcgccattgcttcaatccaatgggttttcttcttcttaccaccggcatcgacagcagcctctgtggtgttactagcaatcccctgtggtgtagcatccattgtactattgcttccacctgaagcagcagctctgcttccactcttgttctgatcgagtgcagccggcggatttgggacagtctggttcttgcctggggctcctcctctctgaggcgcagcgccattgccgtccgtggccactgctgcattcccagtcttattgatggatggagcagcagttccattgcttgaatctacgatcgcacttgcaccacctagctggtgagtagacccggcagcatttcttgcattagctttcactgcggtgacatctccagatgaactcgcgatcacgtcggtgccattgatccgatcaggggcaccatctttggtcatcgtgccgtttctggctgaactgcggcttggaactgcagcctcgccggcggaacccgtggtggagttattggctgcggcaccgcctcccgcttgatcattgggcggcgggttgctctgcatcgccgcagtagcgttgccggatggggagttgccgctcggaacacctcccgcattgctgcttgatacttcaactcctcttccctgctcaccggcaacaactgtactggagccattggttcccgcttgcccacccgtcgcggagaacccaccaccaccgctcgatcctcgccgattcgtcgctgctcctccaggaggctccggggaggtggagttggcggggaacagcgaggagaagtagcccgagacctgcgcgcggtagggcgacgcggaggcgaggaggccgtcgaaccacgctgccgccggcgaggagggcggcggcgccgaaagcgagggcgcgaaggcgaggaacgccgcgaacgcgccgaaggcgagcgcgaggccgtagaggcacagcctcgcccgtcgcgcgcggccgaccagcgccccgcctccgccgccgaggtagccaacgtgatcggccacgccgctctgcttccacgcgccgcccttcatctgatactgctcgcactcgcgcgcggcggccgcggcgagagctcccgagggtttcgatcgaagcgggagaaggagtaggcggtggcggtggcggtgggggaggaaaggaggcgctccgcgggtggagagagtgatctgcggcggaggattttgtaggggaggagacggcggcggcgccggcgcggcgcgcggtggcggcgagcgcgaggtggtgcggcgggttgggagcgaaactaactttcgcgatctttttgggtttggggggatttaaattccgtcgcgttttcgggtttagtaggaacgtgggcgacatgcgcttgagaatcgctcggggaatttgaatttggctgcgctgtcaacagcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctggtcaacagtcaatagacggcgaatctagaggaggattatggcaattttaaataatcatcactgcgataattcacattgctagtgtacgtattttaaaagaatcttacaaacaaatatctcaaccattaaatctaatcaattgctggttataaaaaaattttgtaaggatttcttttagttcgtgtatcattttcctaaataacccccgtgcaatttaggctatgtgaaaaattctagcttaattttacagggaattaaacagcgggatatcaaatttcagctaaaaatgttggttaaataggcttttaatggaactggttagttaaatagtgttcactatatggcaaataccattgatatttcgagatatccatacttacttaaaaaaattaaaaatatttaacaagtcagattaatatgtgatatatcatatatcatttcacaaacatataatatcaaattcgacattcatatattataaaaaaaaggcaaattaactatgaatgtgccaatccatctctggccccctacagtttcatggttttagatgttctagtcctccatttgttctattcattatattttttggctaaattaacgtaaatatataatcccttatattcatagacagagggagaaactactacacgtatattcacaatatttttttacaacatataatttaacttgcatatttgtgaaatcatatattgtaatattccttaccaattttttcataatatgattttttcataactttttagaagacatgtaaagaataagtagatatctctccatgggttaaaatggttcccactacagtggcgttgcaggcttgcgagttgcaatttcagtcaaactaaaactcaacaggcttcttcaaagtttaaatcatggtttccttacataaatcatggtgaagtacagcaagcagcactatgtttgcatggttgacttcctcaaaagggaagaaaagaaacagaaccgaagataagaagataagagtggtacgtttgaatgcagcattatcgcgtgatctgcctccacttggacaatccggggactgaagtgctatttgactgttcattgtttggcaccgccacgtcatctgccgtagtagcactagtgcgaccctgtccgtacgcacttgtacatcatcttctttggcggcctaactagtaaccacccaactcaaccgggtgcaactctgatctgggccgtccatgccaaatctgacgcatgggacgtgatctattgaaatcaatttttttgccataccaaaatgttggcggctttaatagtgtcaaacgactgttaggtcttgtttggtttatttgtgccaaaactaattcaaattctataccatcaaatttggttatgccaaaacttgttggcacaaattggcttcaaaccaaataggctctttatgatcaccatgactacaaactgaagaaggtttgagccattcacaacaggtgcaggcgtgcagcttcagaaataaatcagttagattggatcgtgttgaatgcgccggttaaatgtgaaactccaggtgatctgatctgaagtgatctacttgtgtcgtttaattagcgtgcctaattccaatgggctattagctatgtaagtgcaaaggttagccatgtcgatacatgtatatgtgcacttggaccatccgcacacgcctgaaacctatcaacagattgccgatttctgataggagagggacaagtctgctacactgcctaacttccaagataagattcataaaataaaaccgacgattgcatgcagatcaagttggattcttttcaatttttaataagtttgaaattttcattgcttcgcaaacctgaaaggctgcaaggtgccaactgccaaggtgtccattttcaggtgagtgtctacccaatgacactggggaacagcctaagttccttgactgatcagatgccaactccatgatccagagattaattaattgataattatactattacaacactgtaaagaacgctgcaaagaaagaaagaaaaagattccggcaaaaagtacacggcctgcgaaatagtgaagtcgagcctaacaccacgagacgtgtaagtgtgcaactgaagaagttgcatgatacatagtcgcccgaaaaagaagtgaaatgaactatgacaaatatcgatatttggagagggttaggtactggttcactcgcagttgtagtaggctatctcaagaggattcgatcgtgtcaacaagacatttgcacgtcgcgttgtagcgttggtaaccagctacttcagaggcagtttttttcctctcccttttgaccaactccttgtcatgcacttgtgaactgccgtgcaggtcacatgcctgcgaaaaagagctccactagagactaaagactacagaggctggtcgccactcaccaatgcctgtttttatgtgaaagcaatgagcataaaccttaagatttggcaatggaattgcatgaagaagtcatttgaatcattctttcggtgcatggggcctaatcgtcatcttcttccgtttcttttgagtgatcagattattgttcaccgtagtatcatcataagcaccacgaactaatcgatcatggccaattgacgacgacgagcaacattacgccgggagttcctttccaacccaaaaaaagcttttacgaatttcggcttttcgtaatgcccatttttttccgaacggtcaaacaggttacttgacgttatattaatagaaggagattaagctcattgagctctagcataaatccttgatgagaattgaggccggcttaagtggatcccagcatagtagtactagtactagaacaggaggagaaacagtaacattggaaagggaagatccatggagtacgggttaagcaagggtccgtgccttttttatggcttttaatttctgctgctgcttactgcgggaccaatcaaaggcgtaacaagcatgccggtgaaagccacgcatcctgcatcctgcatgcagctatgcgaggacgtcagttcgtacacaaaagcagcagcagcaacggattgaaagtgttccgtcgtgtaaaggagtaaagaagcatgattcgtacgtatacagcagtagagtacgtacctgtacgattagattagattactgaagcgtcgcaactcgcaagtggtgtacgaggatcttgaattcttgatgagatcttttagttttaggtgcggctactcctaactcaacggtgcagagtcatggctgttcggttcgagcatggctggctatccagcagtttaggcagctttggctgggcgaagtgtgtgatgtgtcgaccgatcgatgaactgagttcgcatcatgtcagctgtcgatcgagtgtccatctgccattgatgaactgcagcaaggagttgagtgaatgcgtgtctagatagatggtcatcaggccagaaacatgtaaattcgatggtcaggccagcaacatgtgaattctgaacactgaatctgaactcccatccgtttcagaaaaatcagaagtacgctttcagaaaaatcagaactacgcgacgtgaggaacgcaggcattaattcctttagagcccattgcctacttttgggcctccggaactaagattgggccgtcggggagacttgcgccgcatgtgacgcagctcgaaggaataagtccattttccccatatcattacatcaagtttaattcgcatccctagaccataacaccaaccacaacttacaaaaccgggttaaattttatcctccgatattacatatagctggtttttactggattggaaagtgacctagtccactagtgttgactaggcgtttagcaaaaataaaaatgagtccacatgtcattctcactcgccttccctcttctctctttccaccctcttttctcaatatctcctcccctcatattaaactatccaaacaccgtaggaatggcgaaagattagcgtgccatgtcatcattttttccaaaaaaacaccccgttcttctggttaatcatgtttgagttccacctaccctagcgctgttcaattctgtgttgggatcgatccagccatccacctgggctacggtgccggctcttccaccaccatcagatcaataagaggacaacagacagtcaagatcttcccaacatatccccacacagccaaaaccctagcaacactcacggcccgcacgcatatggctcatccgccgcggcgccgccacactgccgtagccctcacgcacgtggagggcgacacatcggcgcacaccgccggctctccgcctcgcacaacggagcgagggcgtggtgtgcgtgccccccggccgccgctagctccccacttcacgcccctctctttgcctcgccttctcttcttcccactcttctcgtgctctcgccggcttttctcctccgtcgtcgttggcccatcgatggtagttcgtccccaatcaagtgccattgtggcaacgtctatacaaagcatcatctcgacggtctgcgagcttgagctcgagatgcggtgtttccccatctcatgcgaatcatttgggccttgtgaatctcaactcccgaagtgtccagggtgaatgagtgtatccgtctccatcgtcagcctgctgatactcagacaatgctgatctaccatccctcctttcaaggtgaacacctatgcccaccttctcttccagtcctgtttcttctactttatcctcactctgtcattccctatttacatgaatatcattttgttcagtttcgtagttcaggtcaacattcatgacttcgacaaacagtctgccaccttcatcagctcagccactggggccatcaccatctcctacatcatgtagctactgatctgtaccatctttatccatcattaaaatttggctacaggaggatcgatttctgaatattttctaaacttggctgcaggaggatatgcacaatgtgctttgtacagagggatcgtgatctaggtgtttgcaaagagcatgcgtgagggtaacatatgttttcataacaaaaatatgttgcaattgtacataaatagtcatatcattcaaatgagacatttcaaatcgcaggctatataccattagaggagctcttacagacaatgcacagacaatatagtatttcaagcatcaggtaggctttcagtcatttacgaattagcatttttctttgtgtgtttgctctcagtacccacttggttcttcatgtagattctagacgatttaggtttggcactaatagaactagactttcagttaaatggatgatttatatgcaggaagatccaatttgcttgataccctattatctgtgtaccattttcagtacttttgttgtacgactgttatacctatcctgacaatgttatagatcattggatcaaatggactagatccttctttacacttttaattctcttagctggtagatcattgaatggttaatatggtcaattataggttgtatgctaacatggtgtatatttgtctgcaggattttttttcttccctttacccatcatcattctctgcggtgaggtattgttttttatttctattttactcatccaggccttctgcaataactattttgatgaaacaattgtagtttccacaattatattcagctctttgtcttttaaaactgaattactagctgtgagctcagaatagcaaagtatttgttgtcgaaaatagagatgatttcctacagcccactaaggagtgatagcaggatagatgtggctcttatgtattatggtgattcaccttgaactaaaaaaaatatttgtctagacaattaatgcctcctatttgcatcaatgaatagtcagtttaaatgcattgggtatattcgcccagttcattgtattgccagttgtttctgaatgttacttatttagtttttcaaaatatgtagagtaaatgacaccatagtgaaaattttccaattcaaccatatgctcatccattttcttcccttaaacgtggaaaacacttttactggcagttgcacttcaaagttttagcgagaaaagttatttcagtatctcaacttggccgttccttttcaccatatagttgatagcttgatattatagagagataacagaactcgccaaaagcgttataattttgattgaatgcaagataactgtagtatacttccctatgggattgtaaaattcatcattgcttaatctgtcaaccttcaaatcattgtcatcggcaagcatagactaatcttcttttgttttactgttataggactactagggagggagtttctgcggtaatatatgcaacaccaagcatatccgatatacttcccgtcagtgcaggagagtagtttagaggttgcataagtgcatgtcattgctggagtgtaccagtataaaatgtgctgaaattatttcgtagctaataaagtaaatttacaaccttttgtttatacgggttactggtaattagtaagtctctctgacgtgttccggctgttatgcttaattccatgtccagtttgtagttctgttggaccttcaagcaattatatattggttgttcggtgacatcttcaaccggcgcagcgtagcgcgccactatttctagtttctctgaaacacgatgcattgagcacaccgatagagagcagtgatcgggaggtgtgactgatgccggcgtggtgatcaggaggtgtgactgacaaggaagtagctcagggtaaggaggttcggtgcggcgcgtggcctgcttagcggcatacaaggacaaacctgagcaagaacaacctattggagcaagggcaccctactcggagcgggggctgccgaatcagagaagccatggttgtcatccaggctgggccctcccttctcgccttctcccccgagctaccaaggagcgacaaagaggtgtcgggccaggtcgccaccgcatatgtgatgcggagcgcatctcgctcatggaggaagatcaggaatttgcgggcaagctgggcagcgtgaaacagtttgatacggaaactaggatatggcgatggcaccactgcttgagcttgagttccgccgctaccgtcgtagcaccccttcctcatctctgccttcctccgccatcactgatagccgcgaccccatcctttccagcccgctcaccatcaccgtcgtcttcttgtggatggcaagtgagctcgagcttgctggctccttctccttcaccatcgtggactactcgaaccccctccgccaccaccgttgccgcttcccatggatgggctggccaaccgctgcccctctccctgctaatgagctcctgaaaaagagaggggatatgtggagagatggggaagggatgggataggtgaggagatccggaagttcacttacatgtaggttccacatgttttcaaattttctttttactgattaggatgccacgttagtcaaaacagtcattcatattgtcctacgacattactcgggcagcttttgttaggatgggagtgaatatttttaatattgcgatatactccctccgtttcagattataagactttctagcattgtccatattcatatagatgttaatgaatttagacacacatatatatctagtttctttaacatatatatgaaggtggataatgctagaaagtcttataatatgaaacggaggaagtagtgataccaactaaactcgaaaagatgaggggcggcaagtagacttatttccgctggaatatgctaccggatggtgctaagcccatgcagagaaacttgaccgagtcgcactaaaaaggaataagttcacttcatgacccttaaaagagacccgaatctaatccatgaccctaaaccgcaaaaccggatatcttcacccccaaactattgaaaccggtgcaatttgactcccttggtggttttggatggcggtttcgctgacgtggcgctgacgtggcagtgttgacctagtctgtgtgctgacgtggcgctgaggtggcatttcaattaaaaacatatatgtgggacccatttggcattcacacacacaagattgtggggcccactaacatgtgggccccacctgtcatctcttccctttcttcttcctctcgaacctcccctcctcctcccttctctctttttgttctacctctccacttcgggcgtctgcggggagcgagcggcggtgggcggggtctgaagcgacgcgaccggtgggagctgaagcggcggcgcgggcggcgtcgagagctagctggagcggcggcggccggagctagctggagcagcggcggcggcggtgggctggagttggcagcgtggggcgtgggccggattggtggcggtcggcgagagctgaagcggcggcgagctagagctacgcgagagaggacgacagcgccgacgccgacgagatcgagcggggggacggtggtctatgggccggctacagcttcggatccatccgcatcgccgggatcagagctcctcgtcgccttcctccaacacctccctgcatccatcctcgcatcgcgcgggacgtcgacggcggcggcgggcgcgggatgtcgacggcggcgggcgcgggacgtcgacggcggaggcatcgagcgggttgagcggcggctccggcggcgtgcgggcgagcgcgagtgcgggaggaggcaccggcggcggcaggtgcaggacgtcgacggcggcggcgggcgcgggacgtcgacggcggaggcatcgagcgggtcgagcggcagggctccggcggtgtgcgggcgagcacgagtgcgggaggaggcaccggcagcgacaacatgagctcggcggctccgcttcttccctctcccttncggncctcacgcgccaccgnncgctttngtgtaacccaccacctncgttccttcctcacctgctctcctctcctatcctctctccacttggcaaggctgatggcgaggctaccgccgccgccgccgctgccgctgttctggcccacccgccgccgctccagctccagccgcccgtgctccctcgcggccagccaaaggggagaaaagagaaagagaaagaaagagagaagggaggaggaagaaagggagagagaggatgacatgtggggcccacatgtcagtgggccccacaattttttattgtgtgtgaatgactaatgggtcccacgcatatttttttttctaatgtcacctaagtgccatgtcaacgccacgtggaaagaagaccgagtcaatactgccacgtcagcgccacgtcagcgaagccgtcatccaaaaccaccaagggagtcaaattgcaccggtttcaatagtttggggggtgaagatatccggttttacggtttagggtcatgaattagattggtcacttttgagggtcctgaagtgaacttattcccactaaaaaatctcgagatatttccgcgatccggtagggcccagtcgcccagacgccaacgcttttgtcccttcctaccccacctcgccgtcgccgcgcgctccacccctcctctcctctcctctcctctcctctctacgcaagcgcagcaatacggataagctcaggcttcccgccgccgccactgccacgaacagttcgctcaccgcctcaccggatcgccgccgccgaccaacgcgcagcgcgggcgccgcgtccccgaacaatggcgctcatagcgccgagcccccgggtgctgcgcgcgcgcgaggcgcccgccgcaggcgccctgcagccacccgcggctgcatgctcgaccgtcgctggcggtggcggggcggcggggaggccgctcgggatgtggagcggtggcagtggccggggcggggggaaggggaggaggagggagagaggggatgggatgttgagggcggaggcctacttctgggacgtgtcgaagccggtggagatggaggagatcgactccatggagaagctcgacgacgcgctccggtggtccgtcgagaacaagcagcccatcatcatcgactggtatgatccgcttttgcctttccctgtttcatttttctgatttactacgtgagcatccctgattttgccagcccatgaattctctctgaattcagcaattagaactgcgcttgagtgttacagagttcttagattcgctaggaatcgacctgggattctgcgaccaatgtagcatcgtgttagtttctgaaagttatcattctcttcagaaagtttctgaagataccatgaagtgaaaaagttttgttggaataccccgtttgtcaggttcaaattgcaacgggagtgtcacaagtttaactaaaagacatgtgattcctttcgaattgaagctttttgttaaaaatttgtatcggtggaagttccatgatgaatgttgatttcgaaatgggtgactggctggaatggcccacttggcccacttagtcttaagaaatgtgctaaaataattcatttggacccacctgaacgacttgtgattgttccatggacttgtgaggagtgtgatcaataattgagatgttgttgagatgaatgtctattttctttatcagaatgctagtcttcaaccattccctaaagaaatgcttccgcagatgctgaggttctcttaaattgttcttgccaggatggctagttggtgtcggaaatgcatatatctgaagcccagactggagaagatagcaggagaatttccagggttggtttaaatttcatcaaatgtttgtatgtagggctgacacaattgacaatatgaattcaatcaagttatagaggacagccttgcggggtatggactgtgagtgtcccattgcttcactcgaattaaaatggtatttctcatttcttttgtagagtcaggttctactttgtcgatgtcaacaaagttccacagactgtggtgaaaagagggaatataactgtgagtcagcaaattttgagcttgtcttttttttttctgtattaactgttgattcagagtgactccaatacttatcttattcattctcaatttctgtctttccacgtgtttggatgcacttctatcttcagaaaatgcccactatccaggtaactccacacttccttcacagttcattgtccatataccaaaatttgtaaatatctctcattctgcttaatataacaccagcaattgctggctttggtttcaaaaaaaaaaaaaccaaaatttgatcttagagttctcgttcatgttcagttatggaaggatggagaatgggcagcggaagtgataggaggccataaagcatggcttgtgatggatgaggttagggaaatgatccagaagcacaagtgactaactacctaaatcaagcaattgatatatactgtaaatagagatttgagatgatctcttcagatattaagttgtaacgagatcaataattaaagcaatattctctaatatattgacgtgcaattcttttgtgcgttcgcgaaaaaaaaataaagcaatattccagctcctactagtgcaaactctcaatccaatacttcgtactgtatagtataatactcctgtattagcatgtacataagaacttcagatttacgccatctgaatagtatacttccaatttacagattgaggaaagcagacaaattgtaaagaatcaaataatccaccattcagtattaacttaattcaatccacatatctacaagatccactctaataatctgcctctttcagagcccagttcccaaattttccatttccattaatcacaaaccaaaccaacccatgataattcaggtttcttcagagtaaccaaactagcacctagctggccagagcccagaagctagcactaaccgcttcaattaatcctcgcggcggctagcccagcggcgcgacaaggtcggcgacggcgaggacgacggcgacggccagggctcgtcggtgccgacggggacgtcggagagcggcgcgaggaagcgcctgacgctcatggaccgcatcgaccggaagctcatggacgacctcagcttgccgtccttggagaagacgctcgacgagctgcggaggatgaggtagaccagcgcctgcaccagcacgaacacggcaaccttcgtcaccgcgtcgcggatctccggcgagatcatcaagctcgtcgcctcgccgtccatggcgaacagaaggatcaaagcttgtgtgtttacgtgtatgcgcgtttgagccgtgtgggagagatcgatcaaagcttgtgtgtttggtcatctcggtctccgctttgctcgctttatatagactcgagccggactgcatgttgtttcggattttcttggtcgtgtacgcaagcggtgaagtgtagtatttttgtttttgttttttgtttttcttggtgggggatagcttcgttcatttgattggttggatttgctttgcaaggaaggaggtggcgagctgcctgcgagcctgaaactgtggaaaatttgtgtgtctgcgatttggtcgatttttttttattgtcgcgtttagtttgtctgatgcggcgtcgtttatgctttggtgtttgattattgggcttgatgacatcggttgtgtctggagatgcggctgctaagagtgcttggatggcttggataagttgtcatctgaagaaaggggaagcaaaggtgacatgcacgctgacatggcgtcctgaatctagataatgacctatcgcgtctacttgttttaaagtaatcactttcttgggatcaaagcagtggtttactggtttataatatacagacgtaattaccaaattagatcgagcacgtttcgtttgctgcaagccttggtcgattaatcaacatttcttcgtaaacggaaattctttactgaatgtttatacagttatgtcacattaatccttgctagattttctttttccttaatgaaacagaaaagactgtaccaatattaatccagtggcatagagtaaattctcctattcccggttgcattctctcgttccactatcttccctcctcttttctgcaagggtttgagtgcgcttcttgccatcatctccattgacactctccttcccagcctcgatacctttctctcctaacctacggtttccgcgcctgaccctttttccgcgcttgcagttgcagctacatcctggaacacgtagataagatgaacacgtagtagcacttgtgtttgaccctgtcactgtacctaattttcgccgcggaagatcccacccagaatattttgaaacaaacatcaaccgctgaaattgacccaaatcatccagaaaacaacagttggaagagaaaagtgatgaacttttggtcgaggcgtttcatactttcatctaatcaaaatttatcttctcttctagatgcatacttggactgtccagaatgcaaccgaattccaagccagatgtcacaatcttctagccgttttaccttttttttttcgccagaaacttctttggactcggcattccatgtgccaattcgattgggttcgatttctcaggaggaaatagcagaaggacccgaggaacgtgcatgcatgtaattcatttaatttcattcctgccgaattatcatcaccggcatgaagtccggccccgactagtagccagttgacagcttaattagaatcagagacagctagctcaggagttccagctagctttgaaccttgactcggtttgcaatggcgaggttagccaggcaaatgtgcgatggccggagtgggtcaaggcctctctcaataatggtcagccagcctcggcacagcttgacttgtgggaagagatgcgctagatgctataaacgcttgaaccgtgcacacgtgcagaacgtttgtgttcggtgtttacatacacggtgccggtgcccatgttatcaatcagcaaggttctacacttctaccgtagaagaataactaaagaaatcagtattatgcattgcatgagataaagagagttcatgaaacagagcaaaataatatttactagtaggcgtgcaaaacggaaccgtgattacctaaaatgacttgttttagagtcgagatcctcgacttgtagtccaaaacagcaccaggctcagcacaagcaagcaagcggaagccagagaagcagcatcacttccatgcaggattcattgtactcatgagtgaacagggtgaaaaaaaatatcacaatatcacgtccagtttgcgcgatgtatcgcaagcaaaaggagccaatgcaaccaagtcatgcattacaacccaactagacaggcctacgagcttaggtgtgttttcgtatgacaaaacttattacaacgcgcaaggtcctagtatcccggtctcttccaaaaaactactagctgctatctctaaaagcagggcaactgttagcacatgcggtttcacttcttgacctcctcgtactcagcctctggagcctgctcgcctccgccctgagatcctcctgtctctgaaccgcctgcgccaccaccaccaccagacatatgctgcccaatctttgaaacagccttgttggccgcttcgatattggccttgatcttctcgatgtcatctgaggtcatcacagagcggagatcggcgattgctgtctcaatctcagtggcaacctctgcaggaatcttgtccctgtactctcccagacttttctcaacgctgtaaatggtagtgtcagcgttgtttctgatgtcaatgagggctttccgctcctgatccttctgagagtgaagctcagcctcctggaccatcttctgaatctcagcttctgagaggccaccggaggatcggatggtgatttgctgctccttcccggtagacttgtcttttgcagagaccgtcacaattccattggcatcgatgtcaaatgtgacctcgatctgtggcatacctcttggcgctggtggaatgccaacaagatcaaactcaccaagaagcttgttgtctgtcgccatctcacgctcaccttgcaagacacgaatgcccacttgtgtctggttgtcagcagcagtggagaacacctgcagaatgcatggagtaaattaaggaggtcaaacatatgaaatggaaaccccttgaaagaggtggcaagcaatctatcactacagatagaagaacaaggtcctggcagataaaatcaaacagcaaggtcaagaataagtacgtagctaaaaagcaggaagttagtatatcatgtaatgcatgatataagagtattcatggatcaatcacaaaataatccatgataaagaccagagcaacactatgtaatctactctataccccaatatgaaaatacaaccaaaatttaatcacgtgacaatgaactagatgctaggtcattaaccattgggatgcttgctaacctgacttttcttcgtggggattgtagtgttccggttaatcagtctggtgaagataccaccaagagtctcgataccaagtgaaaggggggtcacatcaaggagaagcagctcctttacatctccacggagaataccaccctgtatggctgcacccatggctacagcttcatctgggttgacccctttgcttggggacttgccaaaaatctctgaaacaatttcctgcacttttggaactcttgtcattccaccaacaagaaggacctcatcaacctccttggtagttataccagcatccttcaagcaattcttgcatggctctctggtcctctcgatgaggctattcaccaaagattcaaactttgatcttgtaagtgtaatgttcaaatgtttagctccagaagcatcagctgtgatgaatggaaggttaatctcggtctgggcagtcgatgagagttcaattttagccttctcagcagcttcacgtaacctctgcagagccagcctgtcctttgccagatcaatagcttcactcctcttgaattcactcaccaagaactccaaaagagtgttatcaaagtcttctcctcccagaaaagtgtcaccatttgttgctttgacctgacaagaagataatcagtgaatcagcaggaaaaaggaatattatgtaactacattttctttgtacataaagttactagttagcatcagtgtgtagttcataaatactgacctcgaacaccccattggagatttcaagaattgagacatcaaaggtacctcctcccaggtcaaacacagctatcaaaccctccttgttgtttgttccataagacaaa

SEQ ID NO: 14923 - DNA, 860 bp, Oryza sativa
gggcaaaaaaaccatgaagatgttagagcatgctgcatacatattagctagattgtgtgtaaactgagattagaccattacctgaaagctcttgcaaaactaccccattgtgaacaaatattcgcagaatatgccgattgagcattggcggtcaactgaaaggtgtacaagtttcataaatatcgagaaggtaaaatgtaaaatgctaaacatagcttaagattgaatctgcaatccttcgtatagtctatgtgtacagatctagagtaatcttgaaacaagaaggggaattattaatctaggtgacactgggagtgtaaaacaaaatagtactcttcaaacagcaagagaaaataaaactacttatatgcatgagcaagacaaaagaggcagacctatatgtttcagtttcagggttaacttaacccaggtcccagagtggttctggtttatcactgaaagatattacaggccatccttttttggggccatccctttttggggagaagacccaccaaacacaatgtgtaaacacaatatgttgacagagataagaaaccgcatgttgaacaaactaaattgacaggatagaagatgatatagaaatactaacacagagctccacgtaggttcggatagaagatgaaatagaaatactaacacagagctccacgtaggttcggttcaattcatactacggaaacaaacagaacgctatctggccaagtggccataagctttagacaaacaaagctccagttcttccattagtgtattggcatgattgcatgaagctccaactgaatcgtagtacttacaaaagtgtcttatgtaagtatgcaagaagtgcagcaatcaca

SEQ ID NO: 14924 - DNA, 24744 bp, Oryza sativa
  unsure (1)..(24744): unsure at all n locations
atctttacccttcattttaacaaaacttttcaaatcatgttttatggcagtatatggatggtttggctgttgtgacatcctagtcaacaaagcagcagcacaagctcaacggttgagactaggaggaggcaaacgctgatgggggaatcggacaccagcctgccgatctagcgcggagagcacctctatctcctcggaggggggtgctactgcgcgcgttcgtgccagcaatttagctgccccccccccccccccnccctcccccccatttattttttcctatcctcattttttttcccgattttgacgttctcttttttttcgccgtttctttccgatttttttttcaatcacctctttacaaatgtagaattgaaagtttttaattttaagttgaaagattttaaatcttgacctgaaagttttcaaatctgggttgaaagttttaattatcggttgaaaattttcaaatctaggttgaaagtttttcaaatttgagatgaaaagttaaaagttttcgaattaaagttgaaagtcttaatttagaatatagtcttaaattatatttggaaagtcaaataaaacaaccgaacgctaatacagaggggaaaaaatctaaactaatcacgatactaatcacgtttcctaatacaacctaattacctaaactagcgctaatcatgacgttaattattttttaattctgattttaaccctatgcgtaacgacgcgtggtctccccaggcgaaaaaaagcaaaaaaaaaaaaaaaggaaacgatggactgtcgtgtgagggtttgggccgcgtgcaagggatgggcaagaaacacgcgcaacataagcttacgcgtgtgtacgcgcgaattaggaaaaccgctcctcggatctcttctctaggcagggatcctatcgagctcgcaatggcggcggccagcctcgctagtctccatgtctgccttgtacctctgcgcccagagcatggctaacgatgagagcaacaaaacgaggcatacgatccaggagcgcagcacggatttttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccaccgcctccttagacatgaatgcggagaggaagaggacaaggggtgaaggcttggaaggccaagaaggtgcagtagagggacgcatctccttgcaagtgccatcgaggcaggcctcccacagcacaacgtggcaggcgagtaggtcctccttgagccacttcaagatatgctaagcggcgtcgaaaacgccaaggtacacggcgcccttggtcgcgcggtccctccctgcattgcccccccccccccctccattttcactgaacccaaacaccaggagcgttcctatggtggagttgttcaggccggagcgacaccgcttgcatgataataacgattgaaacttgaggtctagcccagagagggcctagagggcatgttctccccatcgttggcatgctctgttgacctcgcgtgcgtggttgaggaaaaagagcgtggttgaggaaaaagagtagagaaagaagtaggagctgatacgtgggctcaacatatttttttcttctcacttacatgtgagctccgtatgttatttcttaaaaaaattctttttatcaactagaatgccacatcagcggaatcagttgtctgtactgccctggacctgtcttggacggttctggcaatacaaggggtgaagatttataatatcgatttttgggatgccaattaaactcaacgtgaagatgagggacagctggacttattccgctttggttttttgctggccttatgctttggcccagctcagcccgagaaggcacctagaacgctagacgtctggttgttcccctataagccgctggatcaagatggacgatccagattgaggcttgaaagcaggcaattctcgatatgcacactaggctctctaatgtttcattactatacttgcacaatggactgctgattttgccttttctttttggccggacaatgtggcctactaaagcaaaagtcatgtacacaggtggatttgacttcatagttgcatctctatccgacactgccgtgtcgatgaaactaagagtttctgaacatcaaacatggcgcactataatgtggacaagcagcagctacccttcacctctagcaaaagacaaaaacatcaaacatccatttactttggtactaagctccagcctccaaggcctccagcagtccagcctccaagccctcaccttggtctgagagtgttcttgggggcactaatccatggcgtccctgcgacggcgaacctccatggtgcagcaacatgctccggcgatgcgtattcgatgcctacacgggggccaaccaaaatgttctccggttctggcccgtctagtacctccaacccacctaagacatgtaatgtcaggcgaaaacatgttgatacgatctggcagttttgaacgatgttggagatcactgaatcataccaggtgtgtacagaggatggttggaccagtcagtggaaagccccagagcttgaccaacctgaataacacattcagagacagttataattcagttgtgtgggaacagtgatgatgcagaatacaaaacttggtattgaaaggcataaacctttcctggtccagtgagtagaagtggcttatcagtctgctggcctcgacgctgctgaatagttgccagccctacagtattttgcaagacaatgagaaaagatgccatcaagctcaaactagatgttacacaatagaatttacaggaggaacagacatttggcagtaactagtaacctgactgggtttttcttacatgaccaaatgcagatgatttatataagctctatggtctaagcatatagttgcttttgtaaaattggaactccagtagtccaaacaaagaaacagattttactttctgaagttaggagggacagacggaagaaaaacaattgccgaaacatgtgaggaaagattatcgcatatcctcttcctcttgctcacacagcaacgtcctcgtaaacttcccttgtgttctttaagtaaaacatattctctaatgcatacttcatatcacattaagtctgaagtgaaacatacatttcagaagtgaaaattattgcgattacagtatatatcttccgatctaaactaaacaagcaccaaacgaaactgcagccgaggtttataaactgtaagtcacccaaataacttggtcatgttcacttgttgttacttcaggaaaaaagctgatcagatcatacatgatgctccataatgctcaaaatacttgagagaaatcagaaatgcatactgctcaaaatacttgagagaaatcggaaatgcataccactaacgggagcacatgaccgaatcagaacagcagctccaactccctccttgtcagcgacgacattgagcatcatgtgcagtccatagcacaggtaaacatacgcatgccctcctgatccaaactacaccggatgaaggaaaacttcagcccacattgaagttcaagagactccccccaaatttgctaagcttatcgaagaatttaaggcaagagaagcatcggccttaccacaggagcagtcctcgccgtgatgccgaaccggccgtggcacgcggagtcatttggcctgtaagcctccacctggaggaacacgcaggaacaaatccacagtaatcgcacttggccgcagtgattactgattagtaggagtggtaaggtgaaagaacaagcacctcggtgatgcggaggacgacttcgtcgcggcgcagcagcttgccgaggaggcgtggggcgaggtcaagcgcgtccacctcgaagaaatcgcgcggcaatgcgggcccaaacggcgactgcaacgacaccgccgtacacgccgggtgcggtggtttccccgcggcgatggtctctccggcggcgacgcggcgggtacggggctgccgcttcttcctgtggggggatcgcttgaagcgtgggggcgtgggcgccccggaggtggtggtggtggtcatcggagatggccggctccctccggcgaccggcggcggcggtggcgtgggggtgtgtgcgtggggatggacggtgcagatggaaggaagggatttcatcgatggattggcaatacactacgagtactactgaactcaccggcccacgcgattagtatttacaaaaaaaaaaaaaagtcaacgattagactatggctgtgttcggattcatattacgcacggaaaacggaacgattcattagcacgtgattaattaaatattatcaaaaatagattaatttgattttttaaacaactttcgtatagaaacttttttaaaaaaacgtattgtttagcagtttgaaaagcgtgcgcgcggaaaacgccgaacacacccatatgtgtttttttaaaaaaacaaatggttgacagtttggaaataaatattacacttcaccattttattgtactctatctgtcctaaaatataagaatctataattggataggatatttcctaatactaggaatttagacaggccttatctggtcctatgtttttatattttgggactgatcaggtattgtatttgagttcatatttattagaggcatccatatcggttgcatatgtaaggtttacatttttaaagggtacgtcaagagaaaagcattcgagattagtctctaacaaaagttagaatggtcacccttttttttccattgctgatctctaccgattaggcatgaataatgtatcacggtgacaagtgaccatggtaatctatgtgggagaatctacatcataaaatatggtgaaaccttggaatctcagagagatacgtagggatgtcactagggttattgcactgtcatgcacacctctataagcatctatctttcttcctcattcgtttaggttagaaaaaaaatatgttagtagaaaaacgtattgacttatgttagccatttatgtctgatacccatgagttgtcacgtgtgatgtggctatttcgcagttagcaagaaaaacattgaagaatatagatgttggataatgtttgactatcaaaggggataccattgcctttacaataaactagcaataccagtgctaaatgagacatctatatgttgttgacccaataaaatttctactagagttagattacttgatgaaatttgaaactactttaccactcgtaacaaataattaaatatttctttgaactttgatggtctaacaaataatcccttgctaatactacctccgtaaaaaaaaaagtgcagttatggtttcccgtgtccaacgtttggccgtccgtattacttgaaaaaaatatggtcaatatttttattgttattagatgttaaaacatgaataatattttatatgtgactattttttaaaaaaaaactaaataaaatagacggtcacaactgtaattatattgggtcggagttagtatttgccaccatcttcattggctccgagatcgccatccaataatttggtggagacaattgaacaactcgtacggatgctccatcgatttctgtgtaccctgtatagcgagtgatagtgcctccatccatccacaggtgaccgtccgttcctagcctcggcccgtagagtgtcgacttggtggacagcacaaactcggtgtcaataatggtcttgggtgatggcccttgacctccatctccatggcgagtggtcgtcgtcgtaggaggactcagcaggttcaggttctcgttggacacaatcacatgcctcggccgcatccacaacggcattgatattgtgcagagcccgatgtttagctccaccattgctcttgccgcgctagcttctgcgtcatatgttggccctatggttccttcgcttgatgggggtgatggatatagagcgacctaattgattcgagcgatagttagcatagttagtgtctgttcataagcaattcattatttagataaaaaatatcattctcataatttacttgtttaatgtggtaggtgttaacactcttctctacaaaacatagcgaaactaatcttttatattttagaacggagtttttcttcttaaaaatatatatgggagtttaattcttttttatttacagaacttttggagagattcatatatatatatatatatatatatatatatatatatatatatatatatatatatatatacacataaataaattaatacatacctcgataatttcgggtttgatgaaacatattggaagagcgaggtggagaggcggaaccgcaaagtagagcccgtgttttgcctcttcctgcctatggaccgcgatcgcgacgctgtcttcgtccctgaagacaatcaccgtgttgtctagtatcacgcacaaggtgatcgcctcgatggcgccgaacgccaccatgtccgcctgcaggtcatcgagtttctggaaaataaaatcgagaccttgggccagaacgcatcgacgatggaggctgtgcatatccccaccctcggagatcagctggctcgtgatgggtaccaagagatctcgcgccagtgttgccctctcgacgatgtcaccgtgcagatcgcgtaggtttcccaaagagaccatgattgttactatttggcttggaattttcgaggctggagctgaattatacgtatgaattttgggcgaatacgaatatctctcgctagcctagacgcaataatacggcggctgaagtacgattgagatttgagagaggctctgatgaatatataagattttgtggccgaatacgaatacctctcggcctgtcgctggcctagtcgatggtagcagtcgggctgggcccgctcaggaagaggaaaacgagtcagaatcagacacggggttgggggctccatttagcccacgtgaaattgtttggcccatgctggcgaacataattgggcctcgggctcgggctgctcgcacgtgcagcgcgcgtgcgctgcggagtgcttcgtcgtgccatctcgcatcgcaccccagaccagaccatggcggcggcggcgctctgctccgcctccccggccatctccacggcggcagctctcggcgacggcgtggccacgctccgcctcgcggtcctactgcgccttcgcctctccaccgcgggctgtgggctgtggctgcggtggggaccccatcctggcaggcgcgtcggcggcttccacgactacggaggaagagggatcaggtgttagagatgatgatcccgacggcttcctccgctccgagaaggtcaggcttaaaaatcggctttaggtgaaaggagcccgtgaatttgcacagtagagatgtttgtacactctcccacactgatgtatgtacattttttgctggactagtgctgtgtgtttgcctatttactctgatacggtgcataagtgcatccgtctacaataagataatactatccttttagatgattacgtgccctataagtgtccagttacccccctcgatggcaggaagggaagataaaaacacaacagagtttgaatgtgctgagcatttcaaatataatgaaatgacaggttgctagaagcttagaagtgaaaatatatatcactgtatgtctgtatcaggcatatggtttctgctagtaatcttctagcattgaaaaatcaaatctgtttagtgctcaatggtagctcttggacgagatgatcttagctgttcaagcacaatgaaatctacaatgttaattgctaaatgaactagtagtagacaccgtatattatgaatgacggcattgagagattaaaactatttactgctactgttgtccttagacaaaacactttatgaactgcaatataacctcaagtactatggttgaatatgataaagttggtcttaaattgtgctagtaataaattacacatacattcgagtctctattgtttttcaagtttagctctggttacctgtttcaggtaaacgttgagcataaaagattcgattttgtttctgttccaggatcgaaagtgcggtatctgaagagtcacatgatgaccgcacagagaatgaacatattatacatgaccatgaacaccgtcatcaccatcatcatcatgagttcatgaccatgaacacaaacatggtaagtataaatgttgagacatgatcataatcactgtcatgatcctcaccaattatcattttgagaactcctgctaaactgaaaagtagtcgacgacaactactgaagacaggctaaccttagtagcaatatatccatgcctgaactgtgtaggcattcttatctgtttatatgaatcattagttcattactgcttgaagcttgatgctacttttctattaccatgtgaatagtccaaaaataatgattgttcattttctgatacacatcatatggtaacacccttttccttatggtaatattatactaccttagtagcaatataactggctttctgttccacaatcacataatgtactacattaacacctaaaatctcacatcaaggagcatgatggcatgtacgaggtttgcgcacactgcacactcacacacaatcttagatccatatggtcccttcgtccagtacctattcttttaggagttagctcatggaaacatttcataattaccgggaggctgggagttgagccatctgcattgtattatttcactcaatttcagaaagcataatatgatgactatcttaagtcatggcaatgctttccatatcttaagtgaaaatatattaatatcattcggaagtttttgaactgtttataccattgtctgcttttgtaaaattttaaatatgctagccccccatgatatgaagaacaggtaaactcattgtttttcttttccttatagatcatcatgcacacgagcatacccatgatcctggtgtttcttctgtaagcattgtttgcaaaggggagatggatcttgaaaaggttgattctaaatttatctgtcatgctctatttagtcattattgctacatgaaattttacatctaaatactatcacccatttaattgccccacacatgatggggttgtggatattgaaataagtggataacaattttacatgctctcacataagctggcatgtggttgggaaacctactgctagaatgtctttcaggtttatgttaaacttagcctgtagttttacatagttcactattgattcttccatcgtagtctcttactgggacatttacacaatgaaccaattactctatatgtgttcttatgtaagaaatgtctgtgttccttgggcagggatactctatatgtgttcttatgtaagaaatgtctgtgttccttgggcagggagtgcacatcattttccggggaagaataatgtgggaaccaaatgagccatgcatcaacaagattgtattcatagtcaataatctcaaatggggaagaactggagaaacggcttcaaagattgcctactctactgaaggaataagcgagaaacgggactccaacaggtggtgtatacttcaatccaaccaatcaaccacatgaaagtgcagcagcctaaagcaactaatataaggaggaggtgatcagtctaatgttttcatgtacacagcctgaaagcaagaagaatgcatgaatgggctggctatccgctgaggtcaaggagatggtccgtagaggctccggagccgggccaacttatctacaatgacagctgcaatgaagtcatgagtgtaggcggcgtatggcacccgtctgcagtcggtgaaccccaagctgtaccagtcctcagccggcctccgtcccagccttgctgccccatgccaagacttgaacacggccactgcgaccccccttcagacgggcgtggactagatcatccatcgcaccaaaggtggtggacagccgagcctccagatctgcgcggtccgtgtacattgggatacctgagaggatcaaggacctgtccgggaagctgctgctccagacggtagcagggttcgcgagagcacacagcgcgatgagcttgtgcacgatccgtctggcctcgaccaccctgttcacatggtatcctggtcctggagacatcaactcgtcggatagccagttcttggcttggcagtaggccacgggacccgcccagtccctcgtgctgaagctgagctgctgcggcggctgctgcggcggcggcgtcaggaaccgggaaacgtgcagccatgtcatcatcagacagtgaggagaaagcccccatctcatctcatcatcatcatcatcatcaccccatctcatcccaggagcgtgcagccatgtctcgggaggctcctgcagcagaagctcgacatcctccggactcccgagcacgaccaccacgacacccatggccctgtggatcacgacggcctccacctggtgcctcagctccacccggtgctccagccagtcggcgatctgggccgcgtcacactgccaccgctctgtgcccagccctctcagcagaatcacccggctcctgtactcttcctgctgcgccgccgccgcctgcgtgatcacgtacggcggaagcaggagacggagcaaggacgacgtgccaccctcgtccgggagcagcagcgaggaggagtccagcatccggaggcccgtcctgacgagcaaccgcggcgccctcctggcaaccaactccgtggcgtccgcgtcgtcgtacacgagcacgccggcgttcccgcccctccacgccaccacggggcacgcgtactcggccccggcgaggtggtctctcgccgcgcggcaaagaccgtaggctcctccaccaccaccatcggacgtgccagcgacgcggacgacgaagacgcacctcaggtggagatccgcgtcctcgtcgtccagcaggtaccgaggcggcacgagcgaccggaggagcccaggctcgggctcagcagtggtcctccgcctctccgcctcatcgtccagtgcgtccaagatgtatccgcgcgggtcgccgcgtccgctcgcctgaacaaatccacattcacattgtcacggagtactagctagtagtagtagtagtagtaattagttcacaaaatgtaactagcctggcaacatcatctcggctaattgagttgtttactgattcatttcttgtgtaataaaaagcgcagaatcatgccttgaatcctattaaaaagaaagattcaaacaacgcaaagcattgtcctatcgagttttggtgattttgctcttagcggacaggatgcattgggtaaccgatttcgtccaaaccttcaataaaaggctacaattctaggagagagctcatctgctcatgtatcattctccaaatacacgtgaaccagaagcactgagcagaaaacattatcgcacagacagcaggaaacaaactcgcatagacagagcgggatgcagagattcagagaaaacaaactcgcacagacacagcagaaaacaaacacaaactcaccgccggaatgcaggcgacgtagaagcccgggcgaggcgtcaggttcatcgcgctcgcgctgtctgcggcatccgcgaacaccaccagcccgacgcggtagcccgtcgagctgtctcgaactaagaccgcggcttccacagccaggacggagaagctctctcgcaggtcccgggggcttgtgctgggcgccacgccgtccacgagaaccgatctctccaggaagtctgggtcatcaagaaccccgggagcaacatagtaaagatcagagataaggcgattcatctgcctaaatgctgtgttgctcgcctgcaccaaacaagggacagcatccgatccatgtcaaatcaagcacaagactgaatggaagaagaagaagaacacgacaggtgtaggggggggggacgggaagccatgaattcggggcaaaatcaagaatccagcggcaagagaagcaaaatggcgccgaattcagagaagactcggcgttcacgcgaaagaaacgagaaaatgcgaatcatcaagaaatctgagaccatgaattcaagaaacgggaaaagaaaaatcaggaagcggaggcgagggacagaatcgaacagcaaaagaagcgacgaattcaagaaacgggaaaataaaaatcaagaagcggaggcgaggagaccgaatcgagcagcaacagaatggaccatgattcccttctagaaacgggaaatgaaaaatcaagaagtggaggcaaggaaacagaatcgagcagcaacagaagggaccatgattcccttcaagaaacgggtaaagaaaaaaaaatcaagaagcggaggcgaggcgacagaatcgagcagcaagatcaactacaagacaagtagcaaatggtggttgccgaattcagagaagacgccgccgaacacgcgaaacaagaaaggggaacgaacagaacaaatcagagaccacgaaatcgtcgaagaacacgagcaaacagcaaacaacccttccttacctctcttgccagccatagcctggcgaggctggggtggcgaaccgggatgataccagcgggaggaagaggagcggccatttccgccgatcggtgcgggtcagaggagaggatgaccgggggatggagggagctctgctctgctcgtttggtttcttggagggagaaaacgcaggcaggtgcagggagaagaccgcgctcaacgctggtttgggaggagacgtgattttgtttcagctcacctccgcgaaggcggtggatggaattggaattgggctttggaagatttggcccatttttgtgtggcccgttattctaaggggacgatcagttattaggccgaaagaacgaggaattttaagcagaataagttcaccagccgtctctcaactttacatcgaagttgtttcacatcccttagagcaagtataattgtgagttatcgtaggaccgagatatcgactagaggggagtgaatagacgatttaaaaactaaatgacacctaatcaaaactaacctaagttgctagactcggtgagggttaagtctaactaagcaactaagttatgtttgcaaacctagggtgatagtggctcaattaattctctaggaaagtaaatcacactcctatatcaatgttttgcaatcctagggtgatatgatatcaagaatgtctctaggaatgtaaattgcacaaatataaatgcgacaatcaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccatggagaggactacccaagcctcgatcactcggggtagttcttccttcactctgaaggtggtgaactccaaaccactcacaaccggcgccgggcctcctccacaatcttctcggagaggtcaccgggcaacttctccacaagccgtctaggaggcggcaacctccaagagtaacaagcaatgacccggcatggaaatgatcaatcaagtgccgcactagctctacaaatggaagtaatgcacttgactcttggctagaacaatctcaatcactacaatggatgaacactaagctcaaaggtgtgtgagagaggtgcaatgggtgtatgcaattgaattgggtgccaagagagcccccttactgctggaggagagtatttatactcccaccaaccaaaactagccgttgggggcgaaatcccccaactctgtgtactgccgttctgaccggaggtatgtggccggtcagaccgtgctactctgcaacggctagaaaactagccgttgtagccctgtcagagggccccatcggcctggccggtcagagcgacatggggtggccggtcagaccggcctcggctcggtcagacagccctcagctcggtctgaccgaatacggctccgtcggctctgtatcggccaccccgagcaccaccataccggcctccagggggccggtctgaccgcacaagtgccgtcggttagaccgaccttgtgcgctggtcagaccgcccgcttggggccggtcagactgccacaaggtggccggtctgaccgcccctggtcaggacgaaaaccagtgaatgcaaggtgttgtgtgtgttgtgtgaaatgtgagcacaagtctaaatgcataatgacctaatgtggcaattaaaatcttctctttgctaggtcattactcctcttaatagtacgacgaaactaaaaataaactagcaaatttgatcgccctacacctcgatcaattcaaaactaaagcacttgttttaccgtcttctttccctttgctttgcgccctcaattttaatccatcgataatcatctatgcgcacatctgacgtggatctaacttaaaatatatagctcaaaaacaacggttagtccacaattagtgcttgttattaattaccaaaattaacaacgggggcctagatacttcagctataaaccttctataagcttatgtagaggagagatataacaaaaaattaagggtgttggctgtcatgcaagagctagcttaacataagctccaaggtaaatacaattaatgtataagtgagagatagagagaggagaagaaaattatagccaaccttatagctaatctattatatgtgttggctttaagattggctaatagtaagaagtgagctctattattatccttgctcttatctctaataaaaaatcttcacctctaaactataaaaaaccgtgcaatttgggtccgttagcagtatggatatccggtttcgctgaggtggcatcctagtcaggaaaaaaaaagacccacatgtaagtgagaaggaaaagaaaatgtgaggtttgcataagaaagttacttaaaaaaaatcacattactccatctattatattattaagacagctcgaaaagaagccaccacgttcgctgtggaagctagaaattcccacattaatcgaagaaaaagaaaataagagtccaagtagaaatacaaactaaaaaataactgaaattcggaattaaaaataagcaatactgaaataggagtccatataagaacccaatacgagattaattaaaacctttggcaattctagattttaactgtttatagtagaaaagataagtctatagatctgtactgtgtacgttacatactaggagtctttgtccttttctatttctttggcggtgtacacagtacacgtataatctaattcaattacaaacctatacggagaagagttgtgctgccaaataaacaaagcttgcactgctgcacctatatattctgtagatttcaagcagcaacgattgggctagagcggcagaacccaatgatagcgggagccgaccatagtaaaaagacatgatatttacatagacattacaacaaacagatcaatacttgcaaccggcaatgcatcaaacaccaaaagtttctttgatgtttatgaaagtacaaatgatatcgacatattgtaattagtgtatatttttcacaggagatgagttagtgcaagccgctataaactgacagtcagattaaacgtttagattatagtggattcacaatttaacgttcataatttaacggttgagatataacacctatatataaatataggaattagagttgtagtgctaatacaggagtacaaagcgcgctgctcgatggaataatcgagatccaattccaaaactgttatctaaacctatttgattcctgtggaaaaaaaaagcaaaacaggaactaggtaggcagaaagccgtgtatatacgtgtgcacatgtaagtattattttttcagtataatcacttcaaaactatttagaacatactttgatatatttgttgccagtaaaaatgaagcgactgcctctttatctattcgatcctttttaatcaccaaatatacaaccagcaattcagatgatttataagtaactaaatttgaaataataataataataataataaagactatgaaaagaaaaaaaccatctacaacacaacatgtgattaattaaaattttaaaaaaaattatgaaattagaaaaataaaaacaaaagtttaagaaagaatacgatttatgaataacaaaagttcaaaataaaaaaaagaaatattaaaagaacaacccgtaacacaacaatggtaaataacaataaagagggagggataacgggtgagccgtaaataaataaatagggtgtagcggttgatgggacattttaaaacaataaaaatataaatgacgattagattcaattttaaaaatctcaatgacgattaagagaaacaacagcgggcaagccgtcaaggagcacagtcgtgacgtttgactggacttctaaaaagaaaaaaaaacaacgataatcataatatcatatttgactttttaaattccaatgacaattaagaggagacatcgggtggattgtagaacagtacaatgacgacatttgatgtaacttctaaaaatataaatatgtcaatcgacaagacaatgaactaaaaaactataagatctaaatatgaaagtttcaaagaggatgaataaaagttgtgacaggtcgggcgatcaaataaatgagtggtaaaaaagtaaggggtgacgacttattgacttttaaaaactaacccgatgataataagattcaatcttttaagatcggctagatggctatttaacaaatttaaataaaaccatgcttaaaaatatataattctggatgggtgctagccgtgcaacaaataaaggggtgacaaaggagtaagggtagcaacatgtgtgacttttaaaaattataaaattataaacccggggatgataatgttcgatctttgaaagtcctaaaacaacgagatagatatttaataaattttaagtagaatcatgtgaaaaattagataattttgttggtgctagccacgcaattgcgcggaccacccagctagtttgttttaaaaaagctaatttttaattaatcatacgctaatgagttgctccgttttttatgcgcgaggatgagttcccaacaccaaacaactcgaactctacgttagtgaccatcatattgatttgtggaagtgctagaagaacaggggtcatgactaaatacactgctcaaaatactacacaggcacaatagtttgagaatcaaccatcctaaccaggaaaattggagtatttaacaacaagaagtttcagaaaagattagcaaactgttagcagaatataactgatgacctgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttctgcctctgcgcgcgccgcgcgttccgcagctcggcgaacgtctcgcgctctgcggcgtcgcacatacgtgcgcccccacatgacatctccccctccgtcgagaggcagctcgtcctcgagctgtagagcagggtagcgggcgaagaatggctccctgtcctcccaggtagcagacgccgctgaagtgcccttccactggaccagaacttggcgcaccccacgggccaagcgggctttgatgactcgctcgggctcacaggccaccgcgccgtggtgcacgttcggcagcggcgggggagcgtctggaggcgcgccgtgccacttcttgagcagcccgatgtggaacacgtcgtgaaggcgggcgccggccggcaatgccaagcgagcagccacctcgttgatcatctccgcgatgcggtagggcccgaaataccgcagcttcagcttgccggagactgccagcgacagggacgctggggcgcgctggcggagacgcagaaggacccagtccccaacctgaaacgacactgcacgatgggacttgtcgtagtacttcttctggatggcctgagcttgttccaggcggtagcgaatgtcctccaggaactctgagcgctcctccatgcttttggccacagctgccacgcgggtgtcccccggttcatacgaccggatggagggagggtcgcggccatagaccacccggaacggggtatgccgcagcgaggtctggtaggcggtgttgaagacaaattccgcccacgggagccagcgcagccactgccgggggcgatcaccagtaaggcaccgcaggtacatgatgatgacacggttggatgcctccgactggccgtcggactgagggtggaaggccgtcgtcatgtggagcttcgtacccaccagacgcatcagctcgctccagaacgcggacgtgaagaccgggtcgcgatccgacaccatggattgtggaacgccatggagacggacgatctcggcgaagaagacttgagcgacggattccgccgagtatgggtgcgccaaagggatgaagtggcagtacttgctgaatctgtccaccacagtcagtatgacggacttgccgcgaacacggggcagcgcttcgacaaagtccagtgcgacgtcagtccacactccttgtggcaccggcagtggaaggagaagaccggcaggctggaggtgctcggccttgtagcgctgacagacctcgcaggtccgcacaaaaatcctgcacaacgctcttcatgttaggaaagtggaaatcccggcggagtcggtggagagtgcgctggacgccttcatgtccctcctcatggacagcgcgcaggacctcctggagcaggggcgacgctgggggcaggtacaggcggccagcgaacaggaccatgccgtcggccatggaccacggccctgcgcgtgtgccggagcggatctccgcctgtagcgccaccagcgccgggtcgacgtcctgtgcttggcgaagccgctcgatgaagtcgaaccgtggcgcagacagcaccaagacagaagcgtcctcggtggtgtcgcgacgagacagcgcgtccgccacagtatttgctgcgcccggcttgtactccaccgtgaagtcgaagcccagcagtttgcccacccaatggtgctggggaatggtggacagccgctgatccagaagatatttcaggctgtagtggtcggtcttgacggtgaagtgccggccccaaagatacggcctccaatgccggacggccagcaccaagccgatgagctcgcgctcgtacgcagcgagggcgcggtgacgtggcgccacaggacggctgaagaaggcgagcggatggccgtcttgaatgaggaccgcgccaaagccgtgggaggaggcgtcgcactccacggtgaaggccttggtgaagtccggcatggcgaggatcggcgccgaggagaccgcggctttgagggcgtcgaacgccgccgtggctgcctcggtccaggcgaatccttccttcttgagcagggcggtgaggggcgcagcgatggtgccgtagttgtggacgaatttgcggtagtaccccgccaagccgaggaagccgcgcaccgcacgcgccgagcgtggctgaggccactcccgaatggcctggaccttcgccgggtccatggcaacaccagcagccgagataacgtggccaaggtatgccacggagtcgacgccaaaggcacacttgctgcgcttgatgaagagtttgtgctccctgagcaccgtcagcacagcccggaggtgacggagatgatcagcccatgtgtcactgtagatcaaaatatcatcaaaaaacacaaggacaaagcggcgcaagaaggagcggagcacatcgttcatgagggcttggaatgtcgccggggcgttgcaaagcccgaacggcatgaccaagaactcatacagcccgtcgtgggtgcggaacgccgtcttgtggatatcttcgggccgcatgcgcacttggtgatagccggaccgcaggtcgagcttggagaagaagcgcgcgccatggagctcgtccagaagctcgtcgacgacggggatcggaaaagcgtccttgacggtaagcgcatttagcgctctgtagtcgacgcagaagcgccacgaaccgtccgccttcttgacgaggaggaccggcgacgagaacgccgagtcgctgcggcggacgatgccttgggagatcatggcggcgcattgccgctcgagctcatctttatgagccgccgggtaacggtagggccggacagccaccggcgacgtgccctgcttgaggacgatggcgtggtcacggccgcgctgtggaggcaggcctgtgggctcggtgaagacgtcggcgaaggagtcgaggagcccccccaatagggagtcgtctgcgctggccgcgcggactgccggcccgtcctggtttggcgcgccctgccagcagatggtacggccctccaggtcgaacgtcagggcgcgtgtggtgacatcccaggacatccggcccagcttggccatccactgggtgccgaggacgatgtcatatccggcgagaggcatgacgtacaagtcgacgtggaacggcatgccctcgatggtgatgggcgcgtggcggaggacgcctgggcaggccaccttttcgccgttggcgaccgtggccgtcatccgtggccgcggctggacggacagcccggtgcgagcggccgccgactcgccgatgaagttgtgggtcgaccctgtatcaaccaaggcgacgagcgtggtcgcgcccagctgaacccggagcaggatcgggtgtcccacggcgacgccggccacggcatggagagaaaacaccggtgcctccgcgtcgacctcgtcctccggcgcttcctcgtcctcgtcctccacgctgtccacaaagaacagacgtttgcaaaccttgttgtggccgcgactgtacttttcgtcgcagttgaagcacaagccgaggcggcgacgttcctcctgttcggcctggttcaggcgcctgaccggccggttatcagcagcggtggcggcgggcggcgcgggcttggcagccccagctggagccggcaaggcgagttgcggccgaggcgcaggtgccggcaggacaccccgaccaggagctttggcgggaacggcggtgtactgctcgatcagctcgaactggcgggcgaggctcatggcagccgccagcgactggggattctgcatctggacttggaggctgagcggaggaagaaggcctccggtgaacagctgcactcgctgttcttcgtcgaggcgaccggcgcgggggagcagggcctggaaccggtcctggtagtcctccactgtgcccgtgcggcgacaggaggacagctcgaacaggggagcggaccgcagaggtggcccgtagcggagattgaggagctccttgaagcgagtccacgtcggcgtgccgcgctcgtcttcttggacctgcatgtaccaaagttgggcgccctcgaggaggttgtgggaggccatccaaaccttctcctcttgcatgattcgctgttgcaggaagaaggattcgcagcggttgatgaagattagcgggtcgctcttgccgtcgtagtgcgggaagtcgggtcgccagtgcttgggcggccggtctggcggctgatcgccaaagccggggcgggcgccggacgtagatgaactggtggtggtggcgagcgcagcgatcgccttggcgttggccgcgatggaggcggcgttggccttgatcgactcgtgcatcagcgccatgtccttggagagggcctcgatggaggccttgaggtcgtcacccatgtggtgggccgagcaggacgcgactgagggtgaggacgcaggggaggcggcggcagcaggtgggaaattgggcggagcgacagcagggccggcggctggagtggtggtggagtcgtagatgggatcggtggtggctggggcagaggtggagtcggcaacggaagacgaagatcgacgtgaccgcgataccaggttgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttccgcagctcggcgaacgtctcgcgctctgcggcgtcgcacatacgtgcgcccccacatgacatgaccaccagcataacattactgctaatatattatgcacatatgcttccttcaaaaatattatgcacaacacaaaagtagttgcagacttgcagtaaatgcaaagttcactagctcaattgaagcatatttctccccgggaaaacaaccaaactgcaagggccatctaacaaacacagggaggatacaccatcatcgaattcaaatgtacatatctcgtggcagaataagcccacttaagagcctcattggtcagcctaataagccaaagcaaaagctaaaatttaaaatttcgaacttaattttagagttaattttaagatatttttaatgtaactttgattttaagttgctacgaacaaatacataaaaactttacctataaattaatttgtattccctagtaaactgttttggtttattagaaaatatgggtaaccgatgaggctctaagtttcgaaatttcacccgaaatttccgttgacccttaacaattacaagaagacagacatgtaatactgccacacagatcttcgtaagatcgtaagagacataactttgcagcggaaataatacggggggatttgaatccttgcggcggatcagcacatggattccgccccaaacttcatcgtgtccgcccagaacttggcctcctgcgcgcgggtaaaaccccactaatcacctggatccagcgtgttagggtttcgagggcacggaacaaatcgcgccaagagagagaagaagaacaagcggcgggtagatctccttcttcacgacgctgccgctcgccattgtcacctgctgctgcgaagctctctttctctctctcctctcttcagcctcacttcctctttcttctttcttttgggcttgactcgttttcctcttcctgggccggctcggcccggtctgactgctaccatgggcttggccagcgagtggccaagacatattcgtattcggtcacaaaatcttatatactcagcaccctctctcaaatcaatcacagccgagccgccggattattgcggccaaaaatcatacgtgcaattcagctccagtctcaagaattccaaagatatatcatcaagtcgatcaccagccatggtccctctagaaaacctacgcgacatgtgcggcgacatcatcgagaaggcgaccctggcgcgagatctcatggtacccatcgcaagccaactgatctccgaggacagggacaggtacaacgacctccatcgacattgtgtcctagcccaggatttcacgaacttcctccagaagctcaacaaggtgagcgcgctcgaccaggtgtgcacggacatggtgacgttcggtgccattgaagctatagccttgtgcgagaggccgagcaacgccttgattgtctttagggatgaagacagtgtagctatcacggtccataggcaggaagaggtcgaaaatgggctctatttcgcggtcccgcctctccaccttgccctcccatcctgtttcatcgaatccaaaattatcaaggtacgtattagtttgatcgatgtatgtatgcatgtatgtatgtttcaatctaatctctccaaaagttttaaaaaataaactagtaaagaattcagactctaataacttttaaaaatatatgttctaaaatataagagattatctgttgtcctatgtcaaactatcctaagtttagtttaattaagttttgtaaagtagagtaataacatcaaacaaataaattataagaaatatatttcataatgatgcttatttggtatcataacacgtaaacattcttatttcttcttttttttctataacgaggtaagaaaatctaaggacgcatggcactaatggcactgtgcaattttatctctattttatgtagagaaaaagaagttagctagcagggacaagtaattcgatctctagtactaacaatgattttttatctaaaccatgcataaattgtttatgaacaaaaaattgttatgctaactatcactagaatcaattaggtcgctctgtatccatcagatccgtcaagtgaaggaaccacgaggccagcatatgatgcagaagctagcgca

SEQ ID NO: 14925 - DNA, 16030 bp, Oryza sativa
ttttgaccatcaaagttcaaagagattttttgattctttgttaataagtggaaaggtggaatctaatttcaaagaataagctaactcttgtagaaatcttactgtatcaacaacatgttatctctttccataacatataattaatcatttactgtaaattaagggcatgttcaaattgtaaccaaaataaaccttaccaaattttggcattgtcaaaattttgacaattttacaatattgccaaattttggcatgatttcttatttatttactagagtttggtaagaaactaaatggatgcatatatttagcaactttaccaaaaaaatggtatggcttgaaatggcattaatctgaacaagccctaagataataatgttccctttgacatcactacctaggctgtgtttgattctactggttgggaactcattccttctgcacagaaaacggagcagttcattagcgtgtgattaattaagtatattagttttttttcaaaaatggatcaatatgattttttaagcaactttcgtatataaactttttgcaaaaaaaaacatatcatttagcagtttgaaagtatgcgcgcggaaaaagagagaagtgagttaggaaccatgggtatcgaactctgcctagtgttacatctacatcactactccttccgtaccgaaaaaaacgaatctaaaactagatgtgacatattctagtacaatgaatttggacagaattatgtccagattcgtaatactaggatgtgtcatagccagtactaggttggggcctcatcggatagaggtatgggctgaggcttttcagccaaagcccattgaattgcttattgggctgaggactttaagccgaattgcttattgggctgaagactttaggcctcattaagccaaataagctaatcaatggcttttctttagcttaagaagaaaaggcaactttggcttatcagtcaaagctctagaataaccgatgagggccttggttttttatgggacgaaggaagtacatggatatatactatatcaaagattagccatataatatccaatatatataatataatctttcatgttttccttactactaactgccaaatactgcaacagttagacacatcatacatgactactcgtgtactcagggataaatggctaacataatttatggtttcttactaatatatttttctaacctaaatgaaggaagaaaaacaaatagaacagtggtgagcagggtattgcaactagggacatataacgtggaaaccatcgaataattgaaaacccgtaaaaaccgaatctacaaatttgtgtaaattcatggaaaaaattgctactacctctattctaaaataattcaaactagataaaatgtgacatatttatttatccggatatattgttgtagaatagataatattactagggccctgtttaaattccaacttttttcttcaaacttttaacttttttcatcacatcgaactttcctacacacacaaacttctaacttttccatcacatcgtttcaatttcttcaaactttcaattttggcatggaattaaacacaacctagaaatagatatatgcatggatagattactagaaatagaaatacatatataccttccttgttggtatgaatgtatttcatgcatatatttatttctaataatctttttacgaactagaaaggtagccctcacacgtgcgtgggttaccttatttaatgtgcgtaaaattttattacgaatatctatgggtggatgactttgtattaaaatattcttttactatatctaaactaaaactaaacatattttaatgtgctctgaacgttggttacaattttcttctagttataaccttacaatacatatataaattctaaactaaaattacttgaaaccgtgcagtgttcaaaataaataaaatgccctaactaaagctccgttcccatgctgcaggcctgtttgacacagctccagctccagctccacccttcgtggagctgaagctcagccaaaaagtgtcagcttcattcaaaatggaagcggagctgggtggagttttctcacaaaataaactggagttgtggagctgggtttaggcagttccataactctactacagacccaacttctgaagctaaatttagaagttggagttgtaacaaacaggatatcaacgcgctaaggaactgtcattaggacgtgccgtcgagctgtctctttgagatggcaccggagcaaggagacactgaggaagcctttgtgagttgctaatattataaacagaaaatggcatacctcctgaactttctagaaacatagctggtaaatgttagtaaaagaaacatcgctgtaataaaatagaatccagaaactccccagatctcactactgaatagtataaaaatcaaactcaaaattccaaaaaaattctcaaaaagtggaggcgaccagttcatcccccgctcgctgcacacccgacccgctcaagtgcggagacccccccccccccccccccgcgtcgccgacggccgacggcgatggacggcgacgaccggcggaccccgctgctgggcggcgagggcggcagcacccgcccgccgtcgctgcggcgccgcgactcggcgcgctcgctgcggagcaccttcctgtcgcggctgcccgacaaggtgcgcggcggcggcgaccccgagcgccccgccgccgacgtcgacctcacccgcgccaaaggcctctcccaaggtagtacctgatttcctcgctaagctcgcgcttaatccatggaggaaagtcgcaaagctttgttctacacttctacttagtgaatagtagaagtgattgcttcttcccttgtgagtaggtgaaaaggagtactatgagaagcagttggctacactgaaaatcttcgaggaggtggaggcgctgtgcatgcccggcgaattcgagtcggatgccgaggtgctcgagctcgaggacaaggagcagaagcagagcgagtccgccatgaagatatcaaactacgccaatatcatcctcttggttttcaaggtgaattgattttgatttctcgcatcagggtagcggagtcaagagtcagagtgacaattgatcgttgggacacggatgcgaaaggttgagaagcacagtttgaatgatccgtttggttggcatatgcaggtttatgccacgatcaagacgggctccatggcgattgctgcatccacgcttgattccttgctggatttcttggctgggggtatcctttatttcacacatcttacaatgaagagtgtgaacatttacaagtatccgatcgggaaattgcgtgttcagcctgttgggatcatcgtcttcgcggccatcatggccactctaggtgtgagatccacctccattaggagactgatattagtcaactgcaatttgcacgctagaagtttagagttatgaatatctttgcattctttttaggtttccaagtcttgatccaagctattgaacaactggtggagaacaaggcgggagagaagatgacaccggagcagttgatatggttgtactcgatcatgctttcagcaactgtggtgaaacttgccctctacatatactgcagaagctcagggaatagcattgtccaggcatatgcaaaggtatacctgccttgactatataataatcaattttgaagcaattgcagaagagcgtcacttgatttattcgaacgcaagagtgaaactatgaattgccttattgaaccggtgaaaactttgctgctctaaaattcagttgcctttgtgccgctcaggaccattacttcgatgtcgtaaccaatgttgttggtttagtggctgctgtgcttggagataagttcttctggtggattgacccagtaggggctgtgctacttgctgtgtataccattgtgaattggtctgaaactgtatacgaaaatgcaggtttgccctctagatttcttaatacttcgctcccctttttttaaaccagctcttttcgtttttttttaaccaagtgagattttttcattagcaaaagagtgaaactgaaacgactcataaaagaatgtgaaccacttaacaaggaaaatgatgtttagagtttaatggcagattgctcggcctcaattgcaccagttgtcaatagttttggcaccacaaatcttgacagtttgtggttgtaaatctttatgcagttacactggtgggtcagtgtgccccttcagatatgctgcagaaactgacatacctcgccatgaagcacgatccacgtgtgaggcgggttgacacggttcgagcttccagctttggagctctctactttgtcgaggtcagccattgcagctattcagaattacagattctgcaccaataagtttgttttttttttaatttttcgtgccactccatatcttcctcatgctagccaatacaacttaggatatttctgataatctgaatacacaggttgacatcgagctatctgaggatatgcgcttgggtgaggcgcactccattggtgaatcgctgcaggacaagatcgagaagcttccagaagttgagcgtgcttttgttcatgtggattttgagagcactcataagccggagcacagggttcggagcagattgccctctactgagccttgagcccttgacagctccagttttactcttgtgcagtgtactgaaattctggtactgtagtacagtcttccactggtttggtttgtcgctgaggcagcagaaggcttatggttacacgtacacggtgacggtaggtcggtagctggcttttgggtagaggaatctgtatgtctgagtgaaataatactggattcgccatttggtgcgtttccttttttgtttccttttggctggcctgctttcttgcttcgtaacttgaccaaaaagttctggccgtcgcaaagagctggaactgtgaatacattttctactgcataaaacgttacacgcatcatgcatcacctacacggttacacccgatagaattcggttacagttcaattacaaggcactcccgagtcccagaagctagcacgtcgagcagacaaaccctacagataaaatttctcctcgccatgcttttaagctttacgctaaccacatgcttataataataacgagcattgccgcgtcatttccagattgaagtggcagtgaagggcaacaaaatgatcatcaccttgctgaaattagtgggcagcagcaaccatagccgtgcgagcacccgtgaaagttgatatcagcgcccccagctgtaacttgtcattgcaagcaaagcttagccggtacctgcacacagacgccatgaacaacgtgccatcttaagggaaaaggccataaatggttatactacctacctttccaagaagactaaaggctaaaaatatttggaatatttcataatattaatcagttattatacttccataagtattccagatagccaaaggtcaactttaggtaattgcatcatgaaagcaacccaaagactcattttccccccaaatgcaaacattccacaaggcacaaataagcaattccaacatgtgaggtttgcttaacaactattgctttgcagtatgcaaccatttaactgtaatggctaaattgtgaaacacatacaataaagtatgttagctggtttaaattatttattattatttttcttacgtaagatactccatactagttatttgatgtgatgacataaatgactatcttgaagcatataatatgaataaatcagcaaaatgttccgtcaaagttttgaaaaaaaagggtactgagtagaaaatcagccaaaaatcacaaatgatttatgatcaaataaaatattatatgcaagttctaggtgaactaagcaaggcacactaaatttgacaagtaatcaactttacagctgaaaacaggacgtactcgatatcagccagatcattaatcagctttatgcgtacatcagatggcatctgtattttgaacacaaacctgcaagaaatttcttttgcgtattaggagaaggttttagaggatttgaggaataagaaggtttagagaaatatagggcatgaaagagggcatacatagtgacctcccgtatgatatcaaccaaggccagtccttttctcatcttcatatcagatatacctgaagcagataggacagtgttttcacaagactgacagcaaagaacaaattgcacaattcatgtttaaaccatgaattgtaattgttaggagtatgactttgataattaagaatacatttgaagctggttgaaaatgattcattcagcaaccagtatgctatctgttcaatgtctttcggcatggggtttcctgtgcaaaggtacacagcttcctctgttatttgcttagatgccatgtgtgttgactgcacataaaaggtaaagcaaatcagtgtaaaacatatatatatatatatatatatatcagttcattgtacaaaaacaattagtataacaaaacaggttttaatggtttggttgaataatttacaggcatctcacaagtaaatgatgtgatatcattgccaatatggcatggattagctaaatctagcatcacatgttcttgttatgaagtgagggataagtatggttcatccagatctatcttaacaggcaaaattttcttgtctattccaacacaacccccatgcacatgggcctttatgtttttcataaactaaatataatgattaatggttaaaaaaaagtaggtaaagaatgctcagcaaacgcttattcacacataacctgcaatatgttcaaagccttcctcatatcaccattacttaaccgcacaagggctgtcaaaccaccgtcatcaacatcaagcctgcaagaacacaaagatgtggcaacaaaaatttagactaccacatgaagatagtgacacaatgatattatttcaaaacaaaaccaactgaattctcaagtctcaacagtcaacatgagcaagaaactttacaagagaaacatatcgaaggttctagtataatctgcaaaggagcattaagtgcttacccctcggattgtattatatgtttaagacgttccctaacatgagtgccatcaaggggtgcaaatctaaacctggtgcaccttgattgcagtgctggaatgattttgttcacatggttgcatatcagcgcaaaccttgtgctccttgtatgcttctcaatgactgtaagatgggggagattagaagatgtagctgaaagaaaaacacagcaatattgtggtgacacaatgagaaactctgaacaacagaccaacctcttcgcaatgcaaactgtgcatccttggtcatggcatctgcttcatccaatagaaccatcttaacagattgctttgctctacgcaagataaatatcagatatatgacaaaattgaattaaattgtataccagatctttagtaatgcaaattatgcaataccagtagctccaataaagcataagaaaacaagcataaaaaagatccatgagacaatatgcaacctccatgggattattggctcacaagatgactgcataatgcatgctaattacaacaaagtatgaccactcatacacaaacaacaggaatactctctcaacatgcatttccaaacccacgatagatcgtgtataggtaggtctaggaccaacaaagatcaaatctggtatatgctaaaacacgttcccccttattagaaagaaaatactactcaaatatcttcccaaaataataacatcaaaaaatgtaaagcatacccgaaagagagactgcgggcacttgcgaagtcttggatttgctgccttacaacatcaataccacgctcatctgatgcattgagttcaagaatcatgttgccatactgtgacccatacaacttccttgcaacggccagtattgtcgatgttttcccagtgcccggaggcccataaagcaacaaatgtggaagcctgttctcatttgtaagcctatcaactacaatataatgaaatgacacaaaatcatcagattagcttaatggtctaaatcagaaattaataaataggttgaaacagaaaaaaaaatcgctatttacttctaataatgtgtcaaaactcaacaacccaaaatatgtgacagcttacaataagctaaatttgggagagagagagagagagagagagagaaatatcagcaggtcattatatcacatactaaaacagttcctcactacctaaatggctaaatataatacagtcacacaaaacaagcagaaaacccaattgcatgactcaaatgaccccaggctcctaacaggatgcaacatagaggaacaactaagacaaatatggtgaaaactaaccatcacaattcatggcaccaagttaacaacagatcacaagctggagctcactagcacgaattgccaaatcccctgaaagaccaaatcaaccgccaaatcctaaatgtggagctggaggggagacatgagtgtagaaccacaaaatccccatcatgacactagcaaatagatagtgattattcacaaaaacaaaatagcgatactacctacagaaatcccgtgggctcgcaccacctcgccaataaaggcaaaacaacccccaaatcagtaacccaatcgagtcgctccgctcctaaaaccctaaaacgccgagcggcagccaccgactacgcagtagctcaatcatcggcgcaggcgaaaccaaaggggggagcggcggaagcttactggtgtcgacgatgtcgcggtgggcggcgacatcgccgagggattgggggcggtacttctcgacccagggcgcggccctaccgccgggagtggaggagagaggcgccttgcccttggcggccgcccccggcggcggcgcggcggcgtcgatgtccatcggagtggcggcggtggctcccgccatggcgtagcgcagagagaggcggaaaccctagagctggaggagggaatcggggggaatggttggcgccaattcgaaacccctctcgcggcctcgccttggcgaggggaagaaatggaagatggtcaacgtggtcagcgatgcggaggagggttgttatctgggccgattatgggcccagcccatttagccgctgcaactgggccttcgagagtagaattaggggaagaggttaattaaatttccaatcaccatatgtgaattcgaattgtcttattcaaaaacatgtgagttcaaatttgaagtgagtatagtcagtttagttcaaccgtttttaaattagcgaaaattggctattataactcatgattagtgcagtgcacaagctgaacagccacgctagaagccttatctgaacccatggtaaaagacgtgaacagccacgataggggaagctgaaagtgcagatgtgtgaagaataatctgtattcttttttatcttttctgcttttcggcaacatgtatatatacgggagtagacggccgctgccccgcaccgtcattagcgcagaaagcagctttagccgtccatcaacagccgaaagaagagagagacggtgccaggttctgaacggaaagtcaagaacgagattccatcttttctgtcctttattaatcttttccatgctatttcccatgtttgattaattaacatactgataacaaacggcacatttctgtcggtattgaggtgtttgtttatcaaatattctggtttggtatcggatcttcagtccttttctaaagaagtgtaccgcactacttggccactgttgccaacatgatttacatgccaggcttgtgctcactgataattaattaaggagaaaatgctctaaaaacgtttagcaaactgatctgggtacagtcaacgcagttagttaccaaactggtcgaaagttgcgatttgttcgtctgagaaaaaaataatatcgacttgattttgaactgttctttatttatagcacacaatagtgtgtcagtgtcacagtatgctgctgccattacatttacatccaagattaattgatactgtagttattaatgcctaatagctcaagacaccagagtccagacagtccgggctccaatgatcatgcagcaaaaatatcccctacctatcattttccatttttcctcttctccagcggtgaagccagtgatgagtagaagtaacagagtaactatactaaaatggagcatacatggctcggctaggtttcatccgtggaatgaaccgattcaaagttttgaacctgcacctgctaatcgatcgatcgattgatgatctttgcaaatttcattgctctcgtcggtgatctcggctcaccggcggcggttgacgagcgggaaccaccaatcttggaagcaagactggtaggagatgagcagcagcacgagcgccagcgccagcgcgacgccccacggcgaggagccgtcgcggcgctggtcgtaccagccgccgccgccgccgctgtgctcccctaccagcggcgccatgagcagcgacgagagccccgaccggcgcccgccgcgcgccggcggccgccggccagtactgcatcgcgagcaggagcagcagcggggacaggacgacgacgacccggacctggtcgaacaggctctccaccgcggactcgcaccgcgagtagagcgaggcggcgccgagcagcgacgcggtggcgaggaagatgaaaaggtggaacgacgtccccgccccgtccgccgcctgccgcgcgttgtagcggtaggacgacggcgcgccacggtcgtcgtagtagccaaggctcgccatgtctacaaggctacacctcctgctgcgctgctgttcttgccggcgatggacgaaagtccgaagctgcaagggagaagacgagatggctgctggtttatattggcgggagagaaaggaataacaacacttgcgagagagagagagagttgagctgcgctttacttggcgggagggggattccgcgattccttcacgagggaggtgaggtgaaacgcgagagcggacgaaccgcgcggcgacgcgtgtgccgccgccgaggcgtcgaccagtcagcttgggcttggaaagcgtcgcgcctttattgtcctactactacgagagcaggtacaatatcagcttataagcaagctccaaacatattttaaaaagataaaaaaaaagcaaagtagcgaactatagatctgtagctagctgcgcatgaactctaagatgtaatgtgtgtatggcaggtgggaccagattctaattttatagtaagcgactattatatgaattcaatattttattggttataaataatttggagctagtagtggactatagtcactatactattaaacttactctgaaaggatgtgcctttttgttttggaggcacttggcgagttggcgaaaaggatcttttgcgatgaggcgatgaccatgccacaatggcatagacggtgagggcaatggctggcaagttggaaagcttttggagaacggtgcgggtgactgggttgagtatggtgatgaggcctttgttgcctacgggttacactgtcacttgcacacttaactgtgaaaaagaacccaatggtccagtcatataatcaacgttaaagtacacaataacacatatataaaagttttacctaaaaatttatttttatttttggtttattagggaaaaagccaacgatgagagcctgaaagagaagtagtctcctatctacacccaagcaacaaagtgaagctttgctcaaggattagtacagcgctgcctatgaactacagtacataggacaacaccaggtgggcctttttttgttgaaaggccatcaggcagcagtttggttcctgcatggctgcaccggttgatttacgctggctttgtcagtggtcacccgagcgaggtaactgtgttggatgcgtagtactatggcctgtatggttcatgggcccggtattgtcggtgttactgcgtcccacccgactatcattttgctttcccagtatcaccatcactgttcttttttatatgatgttggttagtccatatatttaggatggagttagtaacatgccagaagaggtgcgcacttcaaggcaagaaaagggtatgcatgaaggtatcaccacatgccagcaataaaagatcatcatcctcatgttgcatcgcgaattctgtttattgaaccaaatgaaggcagggctggtatcaagtatgagcattgtatggaagtaaatggagcaggtatgatatgacaaagcaaacgtttgcatttccaaaaccaacgccggaccacaagaggcctgactattacattattactgaagcaagcatcccacaggaaaaacttacaaaaggttaactgatgatacaatcaatgtgattcactcacgcggaatatattcacaaaccgatgttctccccaagtgcaggatgggcagagccaatacatgttagtagatatatttggtaggggcaccagtgacaggagaatccaaaaacccattgcagcaattatggaagctctcagcacatcagcccaacaaggcctcacaactttgatcaaccggcgaatatacaagatgggaactaattcacactgcaacaggaaacctggtataaatctcttatcttacatacagacgtacccaagccagtcgcactactaataattaattagcctagagttatgatgttacgagccaatatatttggtgtcaaaatcctcaagatcatggccttgagactttttcagttttgccactagaacccacatgtttgcaagttcactttccaagaaggcttccttttgcttcgactcctcaattctcctttggagttctgcttccttttgttccttctccataagcacagcttctaatgccttttctctctcgtagcctgcgttgttgtctcttcttggagctggctcatgtcgtctactgatgctatccctccgagtacctctcagtccactgttggctctacgcggggttggacttctcaccgatgccaactcagaagcaagcttctcgttttggttcatgagcttggtgacttcttccgacaacgctttcaattcaactcccgcagccgaagccaagcctttcgcgtacgtgctttcctctagtagcttctggttgcgagtctctagttgagcttttacttcaatcagctcacacaccttctgcttcagctcatcaatctcaactgactgaaggacaccccccaaaagaagtaagttaaatgtgcaaaccaaccaagtcatagagaggcagcaccataatgaagagcaagattgcttagaacctcaaatggtacaagcagagatcattttgagtcatatggtgtaaaaataagaagctgcaataaatgtttttgaaatctacagtatgcaaagattatgagatagtgcttgcgtggaagtgcatgatcaatgatttgggataactgcctattggaacagatcagtttaaactgaaaatctgatcctcgctccataacacagggtcaactggccaagataaactttttgatcatactaaaacaatgttttcttcgatgtctgtgttgctgtggggaaatagaagtgtgcatagttgtgagggatacagtgacaatttggtgttaataagctattatatggcaagcagacatagattaactgaggaacttaaattttgaaggaggttctaagtggtctaggttctgatctgttggcccagttatgaaatgaaaggaaggcaaaagaaagaagatagaattaaacctgtggttcttttggcgacgtttcaccagggacctctctaggaactgatagttcttgatcagcatgattatcagtttcatggttaattcctgcattcttctgcatcataatgctatttgacagtgaatccttagcttgaagagtttggtaaagttgctctttcaggtgagcaacctcctcttgtaattccatgcattcagttgtctggcaacaaaagaaattcaaaaaagcaatacgaactgatttcagttatccaccattcaactttcagcaaaaaaaacaaattgattttctagcacatctaaccttttcattaagttggtcttgtattactctgttatctgctgccttcacctgcaataaaaaaaggggaaaatgaagcttcacagactaaacttgttgtgcgcattcacatgatagaaacaaatgcgctgttctgttcataacaaaccacacaaagctgtatctaattatgcacatgtatagcgaagggacaagaccaatcctgatctgaatttaaaccatcttaagtttgtgaggggagtaacaatttgtttgttcaccatatgttccatgacaatagagtaatattgcacaacaaagggaatactatggatgaaaaaactattacatacaattcgaatattatacagtcaataaaactaattgaaagttgtatattatctagcatagcacaataatctgctaccaaaaattggtgtgctagattcagttgcaataactttggaaggaatcaaggaactagttttaaaaattgggtattggctgataaaaggtttgcggcgatgactcctgttgcatgcaacgtagtggtgataattgagcttgaaacttgataatactggctgtgcatcataaatacctcataggaagtttacagttgataaaattcatatatataagtttctcttctctttttggttcatgactttttaataaacccttgtacaatacacatgaaagactgcaaagtgcacaaactttttcagtacctcgagatcaaaggatttctcgttgagttgctcaagcagttcagcataagactgaaaaaccaatagtaaaaccatcaaattgtttaatagaatacttggaacaaaacaacatgaactgaagcgaatgcaggatgttaccggagtaagttctaacttgtcagccatcccttgattatttgagatggaatgaggtatctgcctttctaaagacgctatctgatgcttctttcccttaatttcatcattaaccttcttcatttccatcttcatatgtaaagaagatagagtttcaaggtgaaaagcttttagcaacatacgaaactgaatatcaggtaaggtatagagtacctgaatcttctcattatttgggctccttccagcttcctcggtaaggcgctttaggacacttgtatgaagtgcaacctcccctgacaaaatcttcaattgctctctcagtaagtcaacgtgatctattgtttttctgctggcctgtcaacatatcacgtatcaaaatatgccaaaaagaagtccatagtaagacatcatgctgtttatattacatcactaggatttgcaactatattaatcttctacctgtgtctataaagaagtccacactagtaaatatttgagcggtttagttgtcttggtaatgctaaaaatgtatcatgtaccccacaccatgtgccatccatgtatagcacttcaaaatttaaattatgctcttagttaatacacgttagccaacaaaatatactacaacaaacaaacttcagctgttggctatgagttcaaaaataacacattataaaccagtaagccaatcatgactcattagtcgatcaaagattgtttaaaagtggattgctggtttaaaactttaactaagtcatccttttctgctttagatgtatttgtttagctgatatttcacatccgacaaatttcggcctttaattaccaacaatgcatgttacctaccagaggtgtttcttctccatgaaggctgtcagtagcgaactccccatggccaatgctaaagagatcaaccgatgcactctcaccaaccaaagaatttgatattcttggttcggaaggaaaattaacactctccccaataggtgttgaaggagcagttaatttagtcaaactggacttgtcactttctgaacttgtcagaatagaa
